United States Patent 8,114,976 (CRYPTOSPORIDIUM HOMINIS GENES AND GENE PRODUCTS FOR CHEMOTHERAPEUTIC, IMMUNOPROPHYLACTIC AND DIAGNOSTIC APPLICATIONS) - sequence listing, part 2

SEQ ID NO: 2206 - DNA, 1614 bp, Cryptosporidium hominis
atggaagcttttccaaataattggaaatttttcaaggtaaattttgacgaaacaaaatgggacttccttgtagatggaggaatgcactccgtattcttaacaaattccaacataaagctaagttttaataaatgtctccgatataatcaattttatttttccgaaaagaacaactctgcaattatttctatttttaatgatcaagaaaatcaagtatttgatgattttgaagttattatgagttattttgttctaaagattgaaaagaagcctacaaatgttattgaagatataataaataaaattctctttgaatttggacttaacaaaactcaattatccagatgtattatttcaccaagagttcctcttctatttattcaaaaaaatttatttcggcttggatggtttgaaccaaatctatctttaattaatattccattttttccattaagtgcatgcaatatgcacacaaagtgcgcgccccatttttttaatttagaatttaagcctaaatgtgtattaccattattaattggtgattttacactttacagagttcttcagaaattgatttcagataattcttggttaatatgttcttctggtctaaatcaggaaaaaattgaccaagagtttggtttattattaagatttaacagattatgtggggtaaaaaatataccttgccagatttctatacaaaaattatcaaaagatgaccattttgaaaatatatactctcctattcatttattcttttctaaatcaaaagatcaaattttttctgaactcctaaaagcattaaaaatctctggaaaagttatacaaaataattcaattattaacttcaatcatttattaaaaaattctaactttaaagaaattattcagaatgaaatccctatattttctgactctcttccacatttttcacaactttttcataagttaatattatgccaaactttttgtgctggacaacaaattttggcttattatttatttattgttcttaaatttattatacctattaatgagataaagaaattaattaataatcaaactgtcaatatttctactgtaatggaagaaatatcatcaatttcttcaagtttaatgaatattgaattttatcatgataaagctgttgagaattttcaatttggattattatatttaacaaaacttatttttcatattaaaaagaattctttatataaagatcaattcaataaaaatatcaaggaggtaatagataatgatgtagaattcagctatgctattaaaaataccactctatggctttctaaatatttctttggaagatctgtatgtgattgttcattaattatagtagttctatatacaaatcaaaatagtttaactcctaattattctgattttaaactaattaagacattcagtacagatcacaaattgaatctaaattattctaaagtttgggctcaaattaagataattgatgtttccaacaaacctttggaaaaaattgatttttggaagtctcaattcttacgcttagttaagaagttactaatcaattataaaaagacaaaaaaagcgaaattaaaggacatgaaaatactttaa

SEQ ID NO: 2207 - DNA, 177 bp, Cryptosporidium hominis
atgattaattatggaaaactcactcaaaatgaaagaattaataaatttaatgctaaaagtaatatttcgaataaagagcccgccaaacatcgtgagtatttgcatgaaatgaggaataaagtcaatcaaaaacaaatttcttctttagaagaaagaatgaagtttatgaaaaattga

SEQ ID NO: 2208 - DNA, 369 bp, Cryptosporidium hominis
atggttaatacatgtaaacttttggatatatcatcgaatttagtattaagaaatatcaataagcatttacgtacttttgaaatagatggaaatgaattactttctgtgattaatgaaaaaattaatatcaaggaagattttgattttaagcatgatttgttaattcatcaaatagaacttaagaaacaaaactttattgaggattgccaagttcaaattagctatagatggttttgtattcatttattaccaaaatattatttaataattcagttttctatcactaataagtcatcaatagtcagaatttacacggatttccctgagattctttctcattgtgatgatttttttgattcttggttataa

SEQ ID NO: 2209 - DNA, 1476 bp, Cryptosporidium hominis
atggttaatacatgtaaacttttggatatatcatcgaatttagtattaagaaatatcaataagcatttacgtacttttgaaatagatggaaatgaattactttctgtgattaatgaaaaaattaatatcaaggaagattttgattttaagcatgatttgttaattcatcaaatagaacttaagaaacaaaactttattgaggattgccaagttcaaattagctatagatggttttgtattcatttattaccaaaatattatttaataattcagttttctatcactaataagtcatcaatagtcagaatttacacggatttccctgagattctttctcattgtgatgatttttttgattcttggttataaatggttaatacatgtaaacttttggatatatcatcgaatttagtattaagaaatatcaataagcatttacgtacttttgaaatagatggaaatgaattactttctgtgattaatgaaaaaattaatatcaaggaagattttgattttaagcatgatttgttaattcatcaaatagaacttaagaaacaaaactttattgaggattgccaagttcaaattagctatagatggttttgtattcatttattaccaaaatattatttaataattcagttttctatcactaataagtcatcaatagtcagaatttacacggatttccctgagattctttctcattgtgatgatttttttgattcttggttataaatggttaatacatgtaaacttttggatatatcatcgaatttagtattaagaaatatcaataagcatttacgtacttttgaaatagatggaaatgaattactttctgtgattaatgaaaaaattaatatcaaggaagattttgattttaagcatgatttgttaattcatcaaatagaacttaagaaacaaaactttattgaggattgccaagttcaaattagctatagatggttttgtattcatttattaccaaaatattatttaataattcagttttctatcactaataagtcatcaatagtcagaatttacacggatttccctgagattctttctcattgtgatgatttttttgattcttggttataaatggttaatacatgtaaacttttggatatatcatcgaatttagtattaagaaatatcaataagcatttacgtacttttgaaatagatggaaatgaattactttctgtgattaatgaaaaaattaatatcaaggaagattttgattttaagcatgatttgttaattcatcaaatagaacttaagaaacaaaactttattgaggattgccaagttcaaattagctatagatggttttgtattcatttattaccaaaatattatttaataattcagttttctatcactaataagtcatcaatagtcagaatttacacggatttccctgagattctttctcattgtgatgatttttttgattcttggttataa

SEQ ID NO: 2210 - DNA, 504 bp, Cryptosporidium hominis
atgggagaaatgaaaggagaagaatatggaaatggaagactcattttaatgaagaaggaatatataaataaaacgacagaattaacaactgggggtacacttaatagtgatatgaatagtttaaaatcaaaatgcatatggaaatcagttaggatgattaacattcctaaagaagctaattttcaagattactcatcaattgatgtaagaggtaataaagtagcaataacttcacaggaagactcaagtatatggattggagaaatagattatggagacggagaatatttggatccttataagattcaactacttcccaatgggcgggtctattatttcccaagagaccatgtttgtgactttaaatattgtaacattgaaggagtttctttcatttctgataatatgattgtaacagtttcagataaaatgaagaagaaaaacagacaatcaccaaaatgcttacataaggatcaatctatacatatttttgcaattccataa

SEQ ID NO: 2211 - DNA, 2100 bp, Cryptosporidium hominis
atgccaaattcattagaaatttctacagaagaagttgctataatgagaaataatggctttgctacagaagaggaacagaatcacttaaatgaaagttttggttcgaggaatgaagaaaatatagagttaactgaaaatcaaagagttataagaaattctcaaaatgaagaaaactcaagtaatctagtgaatagacaacaaaataactctgaaggtacaagattaataaaattatggaggaaatatgcagaaaaagtgcgtgagtgtttaatacaacttgaatataattcaagagcacaacttccattaatcaagtttgttctaagaatctttattatcttatctttaacaatactaccactaattaacgaaatccactcagttactcctctcttgtcagtttttctaagagaaagtgattggtttctaattccaatgtcaatgaataaacatgcaattaacaatgacttattattaagaataaatcagcatgaatataatatgttattacaaaagaaaaactatcaacaaagaattaaccatagtatttttccaggattattgaatccctacgatgataacggacttttttcacaaaatttaaaaccaaaaaagtcaaaaaataactcaaatgtgtgcattaatagggatgcccgccttttgatttcaaaagaaactagtttaaattatgagcatttgtcactattagtaccgactatttggtgtccaatatctaatttgaataatgaatttaatcaagtgatttataatacaagaagagaagggcagagcaggaaggtcaagatattatatatgaacaaggatcaaaatacacgaaataatattctgggattaacttctttgaagatgcataaaaatacatatagatataggccaaccaaaatttttaagattatctctacttcttttgtaattataagatggtttatgttaatttcaagaatggttatgcagctttggagttttaatacattttttccaaacactggaaatggtaataatattaatagtattgcacaatttcagtttatccaagaatttaagtcattagtttcttttagcatcttctatatttggtcattatcatgtgtatatttattatttgggcttacaactagtaaatgcagtatttttccaaaaattgcaatacatgagaaagtacaatggctactttggatttgtgtactaattactacaatttgtttctatgctactaggttgccatactttgactatcaagaagactctagtaattcaaacttttctggttctagtagttctgtaaataataataacaatcaattagaagaagaaaattatcgcttaaagaaaaggaaaatttttatccaacatatcctctcagtgatttcttgttgtggatttggattttcattaagtggtagtgtccttttactatctacgagaattactagtccttgggttaattcttgctttattacaatcatctcgcaatctttagaccttctattaagaggttatttggggcttattattgatcaccatagctttgaagaaaaaaagattagatattataaatatgtatttccttcataccttttaaaagatgaagagaagatccattgcaataataatggccaaagagagtgggttgtaaagtgtaactataactcccaacctcctcctttaatctttaagcattcttttatttcaatcagtttaaccaaaatatcatccacattcttttcacttaataacttctctaataatgaagatccaacagattctcaatcaaataatgctactcaaacaactaattgtatgatatgttatgaaaatccaagtaatatagttttttctccatgtttacatagtggaatatgcgataattgtatagatgaactaatgaagtggacagtatgtaaattaaagaaaattccatgctgtcacctttgccgttcacctattgaaattgcatggcaacttaatcctaatgaatccaattctaatgaaaataattacttttctgaaaaatgtactgaagttatttatcccaagttacaaatttatgatgattctaatgaaaagagcaacttataa

SEQ ID NO: 2212 - DNA, 1101 bp, Cryptosporidium hominis
atgaacttaaaatacgtaatcacattaatctgttttataacactttgcttctatcaaggctcttcctgtgtaattaactctgattttgcagatttgaaagctggaagaactttttatactatgactaaaaaagaacaaaaaaaaagaattgtaatggtacatggtttgttagcagcttcaacccaatttgataattggaggtgtatattttcccatactggttatcaagttttaacctatgatttattaggacatggtaacactgaatggaaacttcctggttttttctcacaaaaaagatttgttgatcaattaaatgaattgcttaaacatgttgggtgggttgatagtgataataaagctgtagagaagatttcattattaggtgtttcaatgggaggattaatcattatcaattatgcattagaacacccagatcatattagtaacttaataccaatgtgtccacctggaataatgacaaaatatgattttccaaaattatacaaattatcaaattcttctcttgttaatgccattaagaacattcacaattttaaaagaatgtttagatgtggattttattgtgcctccaaattgggatatgttaaattggggaaacaaactaaagaagaaaaaaaagccactacgaatgtttctcaccaaatgttctcaacatatattaaatcaggcggagatggcagcttatttgacagacatttggattttgaaagattatccgaatatgaaaatacttttaaaataattttcttttggggaatgaaagacgatttagttccttttgctcccgcattggactttctagtaaagcattttaacagtactcctatagtcgtttacccaaatatcaaacatattcctgcatatataatgtattccccagccttagttactttggattttttggagtcaaacttcacagtaggagttcctttgggtcaagttaaagaattgaaatatttttatgataatgaagtaaatattgttacaggattaaactttactatttctagtgaagtaattgttaaatctaacaaagaaaattttactgaatcatatttagactttatggattattga

SEQ ID NO: 2213 - DNA, 657 bp, Cryptosporidium hominis
atgagtgaacctgaaaagaagtttgaattaggaactccaaatcctgcaactcaggaaccaaagccaagtgaggatgcaacggcagagggtggaaacgcaagtggagatgagagatattatccagaggaggaattaaccgaaggtaactggaacactcctcaagttgaattgaaacaagttgaggtaatgacaggagaagaggatgaagaagagttctggaaacatagggcaaagttataccgctttgtaaatggagaatggaaggagagaggtgtcgggaatgcaaaattattacaacacaaagaaaccaagaaaatcagatttcttctgagacaagaaaaaactctaaaaattgttgctaatcattatgtaattcaaaaggacagtttctgcaagcttactccaaatagtggaagtaacaagatatgggtttggactgttcaagatttctctgaagagcaaaagctcgaacaatttgccctcaaatttggtcaaactgaacaagctgacatctttaagtccaaatttgaagaggctgttgaaattaatagcaaactcttcaacactgctgaagaggaagatgctgaaagcaaaaaacaaaaagatgacgaaaaaaaagaagatactaatgataggcaaaatgaagagaaaaagtaa

SEQ ID NO: 2214 - DNA, 1080 bp, Cryptosporidium hominis
atgtcatgcagaggtatatctatttggaatgatatattaatgttatataacgcatcaagagtttattttgatgtaaattttgaaaatcaaaattcatcttttctatatttaaataacttaccaaaatattgggatcctatttcaatttattggagcgagccaaaacaatctggatttgtttatgatgatgctctaagtctatttcaaatctacaattttgagatatgtggttcaaacattatggaaaatatttcttcaaattggcttgctgctttggacttatcatcaacttgtctatctttacctccctttttattcgcaagactaatggcatggttacctttggattgtcccgaatatagtattaataatgataaactcgagcttgataaattaaaagaaaattattcacaaaataatgaattacttccatattcatctttatgcgttgttaaaaagaagcctctccctgttatatctttttggttaagtcaaactgattcgaatgataataaagtcgagcctataaagatctttttggatgattatattattcattttaataatattgactatctatgtgtaatcaattcaacactaggtacttttggaaaagttaattacataccttacagtgaaggtaatagttataactacttcactccttattattcatcctctaatactcccttgatactctttggttctctttttctcaaatcatatggcattgtaattgataacaactcgagaaaagttggattttatccaaaatataaatacaagggttataattctaacactattgaacactctgtgaattcaaattgtgctcctaaaaaagagtgtctattagaaaatggatttaaatatgattcatctattaatgaatgcatccccccgaattgctcagactggctcctttacgaatttaatgttgaaactaatacatgtgaactaaactcaatatttcctctcgttctcacatttattatcgttctatttactttctttgaaatacatataatgtacctaaaacaatatattcttgacagatctagtgaaatttctaattcatga

SEQ ID NO: 2215 - DNA, 606 bp, Cryptosporidium hominis
  misc_feature (556)..(556): n is a, c, g, or t
atgaatgctactttattttttttaatattatttttagtttatgcaaagtcacaaaagcccattaaaaacgaaatcgaactacgagaaaatgaaaatataaagatacctgtatttcttgataatttcagtaataagttgggattggatttggttataggaaaaaaaactgttcgattggttattgatacattgaatgaaggaattcgactatttcaagatggtacagaagcttgcaataaaggcaagttaagttactcatttagaagtggaaccgggtttgaagacgatagtgaaattagtagggttgggaaagctcaatggaataatgatagttgttatgatccgctctcatcagactcggcttcttggtgttataataaggatcactgcagaattagttattatatggattcttatatatgtgaaaagaaaaaggaatttccagatactagagaaaatgggatttttaatactttttttcattcaaatgaaagggtttatgatggtataagtaaatttgaagtaatgttagaaggaaatgagcttgtgatagttncatggatgggtccagaatgggtttacaagaattcccaattaaacttataa

SEQ ID NO: 2216 - DNA, 525 bp, Cryptosporidium hominis
atgaaaattaaaagtttagttgctatactggtcattaaaggcttgttactaacaactagagttaatagttgtggaattcatgatttagatattaatgatgaaaatagcaactgcaaagattcctattttgagattacagaagaaatttctttaaatagtcttgattcgttaaagctcaatgaattgatttttgatagtattgaattgattattaatcagatcaaatggagatttgagaaagaccatgaaagatatctttctgaaagtcagaaatctctttcttttgtaaataatatctcacttgacgaaagaatagataattacattaaaaattctaactttttaactggagaagaaataaaaaaaggggtattacaaatactaaagaattaccaaaagaatgataaactaaataactttgattcctcgaacagaattatccattctgaagtaattgaaaataataaaattccattaaatcaaggatttattaacctagttgtattcccaaatgaatatatttga

SEQ ID NO: 2217 - DNA, 663 bp, Cryptosporidium hominis
atgtcagaatcatcaaatataagaaatgggaatgcaaccgtgaaaatttctgcattatatggagaggagcaattttgtccaattgtgggagatgcaaaggaaaagagtatggaaactagtacaaggagaattccatttggtatgactgaattgactttggaacatgaggcagcattgaaaggtttatttgatacattgaatacatatggagatggtaaaattagacttaatgatttaattattgctttaagaagagcttttgacaatggtactgtcacattctcaagacatgaggcttcagcagcagaaattactggtgagcatattgatagtgagcttgagaaacttaaggaagattttgacatgaatggagatggaacattggattttgatgaatttagacgcttagcaagaatgaagattttgagattaagtcgtgatgatgaaattcaattaggtttcagactcttagatagaaataatagtggatatattactactttagaattgaagcaattattaacaacaaaaggaatttccccacttacatcagaagaggctgatgagcttttatttattgcagatgttgatcatgatggattaataagttatgatgagattaagagatacttggaatataataggagacctcttctcaattag

SEQ ID NO: 2218 - DNA, 1050 bp, Cryptosporidium hominis
atgtttagtaattctgtcagcacaagtttaaattcatacgagaattttgatgagaaccaagaattaaaattgacaggtgaaaaaaaaatcgaaatagatcattttcaaaatgaaattagtccaagaaatataattaataattttcctgtaataacaggttactatggagttgtgttaagaaaaaaaaaacatccgctttttgggtcatattggaataaggaatattgtttattacaatccaatatttttttatgtcatgaattaaaatatccatataaaatcaaaaggagcatatcaatagcttctatttccaaatgtgaaatttcaaaaatggatccttgtgtatactgtttaacaataaataataatgaagagaacttggaaaaagctggaatttcacaagttagtggattttcatgttttaacttcaagtctaggaaaattgaaataattaaaataaaatgtacatcaactttagatactcagaaatggaatctatatattaataatacacttaaaaattggagatcaaataaaaataatactaaaaatctatataatggaaatcaatatatcgaaaaaactatagctcaagaattatttgaaaagatgaataaaaagttaaaaaaaattattattcaatcatcaataaataatatgattttaatattcagacaaatagaaaaaagaaatctttataatagtttatacaagattaagattaatagtataatcaattcaaataatgatatagaacaggaaagtatatcatcaaaaaatacaaattattcatccatatctaataatgattttacatttaaaaaagatttattattgattaaaagaagaattattttatttaaaattgagcaaggatcaaatcacttaaaaagattaataattaaaagaatgtcagaatattggaaattattaaaagaacattctttaaataatcatgaagatcatgaatttatggaaatgcattataaattaatattaaaaagaccgattctcttattttggagagaatacttcgagttattttgttaa

SEQ ID NO: 2219 - DNA, 654 bp, Cryptosporidium hominis
atgttttggtatgaatattttatatttagtccaacaaatgaattatctgatggtcatattttagatgttttaaataaatttactcttccaaaaagtcagttttgctccttcattctgagaaaggatattttcttaaattcaagctattcattggattgttgtaattttcataatattccttataacggtaaatatttgacatctgaagtaaagagaacgattattgaatacatagatttctctaaagaaaaaaatgggaatgaatactttaattttgataagaaaatacacgaaaaatatctcaaatttcaaatcgagttagcatgcactaattttgatttttgtaatcaagaaactaatagaaatattcaagaatacataattaatttaccaagagcttcatctttaaattataatacagatttatgttcattatgcaactctaaattattttttttggaaaataaaaaactttcaagcaaagtaattcttaatcattgcaaacataattatcattacgagtgctatttaaaacaagcttatgttgacaaaaagagtcataaatttaaaattgttatagagaacgatatttcaaagaataatattaaatgtattatttgtcaatataaattactaattaatcatcattcttaa

SEQ ID NO: 2220 - DNA, 444 bp, Cryptosporidium hominis
atgcggggtttcgtcggcaagagatcgaatcaaaagaatcaagaaggtgacattaatataggacagatgattcggggttcggtaactgataataagatcattcaagctagtcgaattgttagtgatgataatattaaaaataacgtaaagaatagcaataatgataatagcggtaataatcgcaatattcctgataaaaataatattatcaataacgtggaaagtaagagtagttcagaaaagacagtaattaatgattcagttcagaaacttttacattttcaagatattttaggaaaaggtagtaaaatagagagtgattatagccgaaaaaatgaaaatattactccagaagcaattacagatgttattaagaatgtactatcttcgagacaggtttataatatgataaatacgagtaatgaacttttactgagaaaataa

SEQ ID NO: 2221 - DNA, 1257 bp, Cryptosporidium hominis
atgaataaatttgaaaatggtttggaacatgtaaaattaaggatttctaatattgaagatgaaatatataatataacagagttgagggaaagaaatattattgagaaggagaaattagaagatgaaatatatgaaattattgaaattgagaaaatactatcagagctttatgatgaattgtacagaatttcaaatttccatgaggctaataatgttttaattactagagcttttgaagagaaattggtgaaaatatttaaagattattactcaaataaattggagaatttaaataacattaattttttagactatgaacaaattaagtatagttatcaaaattccagattatcattaattaatgagttgaaagctaattttgggcaagatttgctgaatattgaagttttgaataatattattaaaaaattaatcgagtcaaatgagaaaatcttttatgctatattcaaagttgaagatttatacaaaatacttttatgctttatatatacagattttttgatttgggatcctttttcagattctcaaaatactgatttactttctttttcaagcattataaatgatgtattaaaacaagatggtgtaactactttgaatgtaagtttttttaatactgaaaagcttgtggaaaaattatatcttgaaaagctcatgaattatatttgtgaaatagtaaaactgtattggactcctttttatttcaaagaaacagagaactttgttaaatctataagaaatgttaaagatattcttgaaattgatatggcagaagttgtgtccgaactcatgaaaaaacttcaagataattttaattttttgatttcagagaattttttaaaacccgaaaatgaatttaagtttgtattactcatcttaaattgggctgcttcagtactcatggttacaaaagcatttgaagtaaaacaagagtatattaatttattaataagcaagtccattcttcatttttcccaaaactcgatccaaaaccacgaaaataaaaatttaaaaaaactactctgcgaaacagaaattgacgttgaagaaatcaataattattcagtaaatgaacaaaagttagattccagtatattattgaatcctaaggttgttggcttactaaatattaatgaggctttatatcaaattaaaaacagctttaaattaaatattcctaaaaaaaaatatatcttaattgatattatattagaaattatatcaaattataattaa

SEQ ID NO: 2222 - DNA, 1101 bp, Cryptosporidium hominis
atggactctctattagaattctttgagaaacagttattaatgaatattagtgagaaaaatgagcaaattgaagacaaattcacagttaaagttaatattgaggtaaaagagaatagtctggaggaaattagaataagaagaataaatcaattaatgtcaatcccaaatggaaaaaatcaaacagtagactctgataaagtcattgaaaccatttcaaaaagtacaattctaaaaggtggaatagtaagccagaaatttgagaaaggacgtgaaactaactactgccatgaaaatgatcagatatattcaattcttgatccaaaaataattgatatgctaagcatttatattaataaaagttcacataacaaatttagattttataatcatcagagtgatgcaattaaagctattttgagagataaaaagaatgtaatcattacaaccagtacatcaagtggaaagtctatgtgttatttactaccatgcattcaatttgccattcaaaaccaaaaaaatttggctttattaatatttccaacaaaggcattatctgaagatcagtttatgaagattacacaaattctaagtttttttcatcctgaacctccaactattttgccaaaggttaataaacttgatggagatacaaatatgaatcaaagaagagaaatattattaaaaagtaatattattctaactaatattgattttattcattggaatatagaacttttatcttgtatgatttataatcgtctaaaattgcttgttattgatgaagctcatatttatacaggccattttggaattaatacaagctatatattaaaaagacttcacagaggcattctatattacaaacaaaaaaataattatatagattctgaaacatatactcagtatattgtatgtactgcaacaataaataaccctattgagcattttaaaaacttgattggttctgaatttaaagattttaacgatattgcacttattgataatgattcaagttcaaagggagaatcatcaatattaatttgggattgtaataagtatattattaaagataatacaaaaaattataatcaaataaaataa

SEQ ID NO: 2223 - DNA, 375 bp, Cryptosporidium hominis
atgcaaggaaatggcgaaagatatacattgaatgaaagcttggaaagtgatattattagtatgaatatatatataacaggagcaagagttacttttgatatatatagttattcaatatttgagataattaataatgaatggatttttatggaagagaaatatattcaaaatcctttagtttattcctttaatacaatgggaatgcagataaaattagaattaagtgataaatttgaagttgaaataattaatatagctatacatggaattattcacaatgttattaattcacttccgaagtttatatcttgtaatattaatgatatttcttgtgagtgccctgacagtaagtttattaagtataatttttcttga

SEQ ID NO: 2224 - DNA, 1977 bp, Cryptosporidium hominis
  misc_feature (1950)..(1950): n is a, c, g, or t
atgtcaataaagctacgcgaactaattagacaagttagaaactgcaaaactgcagcagaagaaaggtctataatttcaaaagaatgtgcccatatcagagcactctttaaagaagatgaaaatcaatatagacaaagaaatattgcgaaattattatttattcatatgcttggatatccaagtcaatttggacaagttgaatgcttaaaactaattgctagcaataaattttgtgaaaaaagaattggatatcttgcaatttgtcaattattagatgaagattctgaaattttattacttgcaaccaatagtatcaagaatgatctaaatcactcaaaccaatatattaatggacttgcactttctgctataggtaacacagctcctaaagagatgtgtagagcagtttttagagaagttagtgaacttttactagttggaaatccattcatcaagaaaagagcattacttgcatcagtacatattattcgagttcttgaagatgcagaaattgagtcatttattaactgtattccttctttacttgaagataagcatcatggagttcttttaggtacttgtcatatgattaattcaataatacaataccatcctgagaatattgaagctttaggaccttttgtacctttattagtaaaaatattaaacacaataagtatggcaggatatcttaattctatggaatatgataatggaggagttacagaccaatttctacaagtacatatactaattacaattggtgatctcagaactgttattgcagatgatattaaagagaatatttgtgctgtattagctcaattattgactaatactgatcattccaaaaatggcgggaattctattttatatgaatctgttagaaccattattaaattattaccatatattaatgaggatggattatatatgttagctgttaatacggtaacaaaattcttacaaaatactgatttaaatatccgttttgttgcccttggtttattagaaaatatgaaagagttcccaaataactccagtacttgttcaatagccccaaatattaatgagaacttaactggaaataatgacaagagtaatgatgaatctgcgcatgcaggtttggcgccacatcatgcattaattttagactgtttgaaagattctgactcgtctattaaacttagggcattaaaagttttgttttctgtaataaatgaaaacaatataaagatttttattaaggaattattgaattcattattgatttcaacagaaaatgaagaaattgatttttctatagaattagcaacaggaatgtgtattgcggtaaggaaatgtaagcatttaaccccacaatggtatattgatacttatattaaactattttgcttagctggaaatattattaaagaagaagaaagggattactttatttcttacctttcttctttaagtgattcaagcattcattcatatactgtcaaaaagttatatttatcattattatcaagaaatgaccaaattttactaattcaagttactttatgggcaatcggcgaatattctcagcatttatttactaataataatggaattagctcttttgaagaacaaaaatctttagatacctcagaaattgatatctctgaagaatctgttatgagtttaattgaaaatattttaatttgtaattcaagggaaatgtcaaatagtaactactcattatcaatatcaggaatcaacaatttgtgcattgattattctcatcctataaaaggagttggaacttatggctctattagctctatagagactacaatcaactttgcattggtagctttgatcaaagctagtattcgactcaagacccaaaaaaataagatactacagcttattcagactcaagcatcatctccatcagtggaaatacaacaaagggctttnagaatatatacaaattttgaattctaa

SEQ ID NO: 2225 - DNA, 381 bp, Cryptosporidium hominis
atgcaagataatgtttttccatggtttcatattgttcaatggtcaagcgaagaactacctacaaatactgttttgaaatggaactataaaagtattaaagaaaaagttcagagcttaacattgaataagcaagtatttttaacgaattgtccggtatcaagaatacaaggattttctctagacgaagatgatccggattgtattattccttttgcagaatgggcagcagcattactttcacaaatggatgaattaaataatattagatatgaattagtaccaagtagaatgtccgagagtatattttggcaaagttattttaacgctataagaaatattattatcaaagatgtaagtttgtttttttttcttttattttaa

SEQ ID NO: 2226 - DNA, 543 bp, Cryptosporidium hominis
atggacgaattaaaatccaagattgaaccaaatgagcgtcatattgagattcattcaaatgagttagaagtagatactgaaactattgacgaaattgaacaagataaaaatcacgataaaaatttagaaagtgattatcaacaccaagatcaaaatcttgatcttaatcaagaacaagagcaggatcaagaagaacaagatcaaaccaaggaccaatataaatcggaaacagatattgaaacaagacaaaaagaacgtgaaattgataacgagttatatatccaaaatgattgtatttatggagatggagatggagatggagatgaagatgtaaagctctataacaacaataacaatgataataacaaccaactagatagaaagattagtgatatttacacaaaccatatggacaataattccgatcatcagttagagacatctgattatgaacaagaacctaacgatttcaatgactctaacaacattgatgatcataatagtgcacttttctcagaggaaataccaattaatcaagaatag

SEQ ID NO: 2227 - DNA, 231 bp, Cryptosporidium hominis
atgaatgagcaatctggaaatcctatttcatcatctttgaattccaataatattagtaaaataaataacaattggtgggaagttattataagtaaaatccaaattacttccttattttcatggattactatttttgttgttgttttatttgcaatttctatcattaatgaggcagcaaaatatcaagatgaagccatcagaaataaggagaacaaagttaaaaaggactaa

SEQ ID NO: 2228 - DNA, 93 bp, Cryptosporidium hominis
atggctcagaataaagaagattctactcacatttttaatgtaatacaatatcctgattggattccatccaacggagattattatactcattga

SEQ ID NO: 2229 - DNA, 411 bp, Cryptosporidium hominis
atgactcaggataaaagaactcgaattagtgcagaagttgaagatttcgaaggtgaaagtagtaaccataagaaaataaatagagaaaatgaacaagaaataagtgaaatagttcaactactaaaaaagcatatacgaaattttgaaatggaaaaagtatactatatctttgagaagattaatcagagagagattttttttaaagatattgaagattatttaaatgtgagcttttctaaagtcattaatgaatgtttgctaggcttaaatattattgtttcacctgatcatgatcaagtaattattaatgggttaaggatcaaaattcttaaattgattttaaatattcttttagatatttcagagtttcaggatgaaagttctcagattggagaaaattcaaatattaat

SEQ ID NO: 2230 - DNA, 618 bp, Cryptosporidium hominis
atgtttttgtttcgtagaaaacaggaaaaagaagagacaaatcccctttctgaaatagaatcagctcatgaaaaagcattaaaagcatcacaagcaattcaaaggtctttacttgatttggaggagaaagaaaagaagcttgaaaatgaagcagctaatttagcattacaaggagataagaattctgcattgttagtattaagaagaaaaaaattggtcactcaggaaagagagaaattattaagttcaagtttgttattagaacaacaattacttaatttggagacagcaaagactcaacagatgacaatgtctgcattatctgcaagtgctatggctcatcaatccataatatcatccacaaatactgataaattggagaaaatttctgatacaattaaggagcaacaatcaattcatgatgaaatttctcaaataattaatcaatctcttccttcaatgaatgaagctgatcttatggaggaattaagtgcaatacaagcaaaagaaattgacagaaaaattcttgaatcatctgaaatatttaccactaataataaagtactattaaattctagtgccagtaatttggacgagaagattatggaaaaactataa

SEQ ID NO: 2231 - DNA, 633 bp, Cryptosporidium hominis
atgtggagagatttcaacttattagaggaaatgagaagaagaatattgaatgcatcaaggcatcaaggaaaagagaaacacattgagaatcagataatacaggaaaattttgggttaattagtagtttaagaggaagaatcggagaatataaagggagggttaaaattaataaagagcaaaagctcgttacagtaataaaagaaactagcaaattaccaaggcatagtccaatcccattgttgaagaaagcatgtagtattagaaagattaagatatatttttgcccaataaatgagatggaaataagaaagaataacacaacttattataataagaaagatgatttattattatggaaaatggaatttaatatatatcaagataataatctaatagaaaagaagtatttggataatatttcagaaaatgagatagttatagaaacaatactaaaattaatgataaatttagataagaataatattaaacaagtacttttaatgaataactttaaagatgaaaataataaagcttttcaagaaatggatttaaataaaagctttaaagaaaatttaataggcaaaaatattatagaatttccaagattcaaggtagaaatacataaatcatga

SEQ ID NO: 2232 - DNA, 441 bp, Cryptosporidium hominis
atgaaaatgagaagtaatgattttaagacaggaaaacataaacaaaatagtctttttaatgaaacagtcagagaaataagaaaattagtatatcctcatttggataagtttcaacgtcaacaatatgataatgctagggcaaaggttttaggtataaaacaaaaaaagtctcaaaagatgcctttaccagaattaatttctcgtcaaaaagctacaaaaagacatattgataaaagaaagcaattagaagaggaattagatgttaaattgcatattggtgataaggctaatagatttgaagcagaaaaggatatcaagaatcgtaagaaaaataaaattgagaagagaaatatgtccacaagtttaagtggaaaaggattttctgaaaaatcgggagttgtttatgtaggcaaaaacattgttaagagaagaaaacattga

SEQ ID NO: 2233 - DNA, 666 bp, Cryptosporidium hominis
atgataagaattggacaatatgttatacttgaacaaaactgtattgtaagaccttgttttaaaaagatcaaaggtaaatacggatcagttcctatttcaataggagattgcgttcaaataggtgaaaattctgttgttatggcatcttcgataggttcaaatgtttatattggaaaaaattcaattattggatcaggctctataattaaagataattgtataattttgccagatacaacaatagctccaaatactttaattccgccatttacagagtggggaggaactcctggagtaatgctaagaagacttcctgaatctcaaaatattctattacaacaaagtgctatagaatattataataattttgagttagtttccaataaagtacaagaagagccagagaaaattcaacattcaaatacaacattgatcaaatcaatgaagactggaatatctaattttgccaagaataaaggagacaatggcgatggtgatgatgatgataatgatgatgatgatgatgataataataataataataataataataataataatagcaatagcgatgttgataataatgacagagcaaatgaagaaagtagagaagatagagaaggtaaggaaggtgaggatggtagagaaggaggagaaagtgaatga

SEQ ID NO: 2234 - DNA, 432 bp, Cryptosporidium hominis
atgtctgacgttgaaattgatcaggaaggtacccaagttcaagttgaacaagaagttgtcaatgatttaacaactgctattagatatgttttaaagaattcttttgttagaggtggattattacgtggattaaatgaggttgttttggctttagattccaagaaggctcaagtatgtttcttagctgagtcttgtgaggaggattgctataaacaattggttgaggctttatgccgtgaaagaggaattcctttgattatggttccagattctaaggagttaggagaaatggcaggtttatgtaaagttgatagagaaggtaatccacgtaaagttgttggagcagcatccgtagctatagtagactatggtgttgaatcagaggcttaccattatctccagaaacacattgctgagaactgtcgctcttaa

SEQ ID NO: 2235 - DNA, 1413 bp, Cryptosporidium hominis
atgttggataagtgtataagatatattagcaaatcaaatgttgatgatctaaaagagttacttggctttgatgataatatttcagatgaaaatgatgattacttaataatttcaaatctagaagatattaataagaaatcaaaaaaaggtgttattccaatacatttggcatgtaaaatccaagattttgatattttaaggctacttttaagatgtgaagatctagatgtaaatataagagatccaaccaattcatttactccaataataaccttaatcaacaatggtggagatattgagtgcttaaatttattattaaaaagatctccaaatctagatttgtgtgatgaagaatttggagattcaccattacactgggcagtaagattagaattacctaaggttgtacatagattagtaaaatctggaatggatgttaatctacttaatcataaaactggtcaaactcctcttcatcttgctgttttgattggaaatgaggaagttattatggaattaattggattatctgcaaatcctataataaatgatgataatgatttagaaaggaactctattttacatttatgtattcttggaaatataccaaatattgctttatatatatttaactcagctacagagtatcaaaaagatattatgagaaaatcagtgaatagaaatggtaatactgctttgcatttagcctatatgtatggtatgattggattagcagaatttcttattaacaatggatttgataagaatgcattgaatgatcaaaacttatctcctttagacttaaagttggaatatcaagaaaacaatagaaaagaaagcaaagaagataataagatttctcaaagtcagtataaaaaaacagaaattagacagagaagagcaaataaaatacgagaagaaatatatgaaacaccagtttcagagtttttagtaaaatacaatattgcagaaaaaccaaacttaataataaataatgatgaagaagaaaataatgacaaagttttaggtaaacatgattttgttttcaaactcttttataagaaaggctattactatcttgattcaagtttcacaagtctaacttttaatgatttaacaaatattggaatcaaagacaaaagtttaaaagagttaatactagaaagcttaagccaagaagaaaaaattaaccaagaaaagattcaaaaatcattaaaacaacaacaagataaaaagaaaagaaacacaggctattctttaatagcaatttcaacttgcatattcatattcttcatattatatattgttttaaatgcattatctagaaacagagaaatacaaacaaaccctagtaaaaagccaagaaattattcatcctcctacactaaatataaagctagatatgatatttaa

SEQ ID NO: 2236 - DNA, 396 bp, Cryptosporidium hominis
atgggtagagttagaacaaagacagtcaaaagagcagcaagacttattgttgagaaatatgtatcaaaacttactttagatttccaaaccaataagaagattgctgaagaagttgcttcaatcccaactaagcgtcttagaaataagattgcaggatttgttactcatttaatgagaagaatccaaaagggtccagtacgtggtatttcattgaaactccaagaagaagagagagaaagacgtatggaaaaactcccagataaatccgaagtcgatttggacgttatcttggttgatcaagataccaaggatatgcttgttggattgggtcttgatatccctgttgaagttgtctctccaacacgtgtattccaaggtaaatcaggtagacactag

SEQ ID NO: 2237 - DNA, 363 bp, Cryptosporidium hominis
atgagagacttaaattacgatagaacacataatgaagattcaagtccgaatcaaaatgatgagataaatagcaataatagtaataataataataatcaaacttctttatcatcatggatgctttgtttagaggaagatctggacaaggaaatatatgttgtattgagacacgcagaggcgagggtgatggtatttttagacagttttgatccatatggaagtttatgtcttgaaaggtcttttgcaatactcagtaataatgaccgcgagaatgcaatttaccagggacgtatgatatttagaggacacagaaaaatgttatgtggtctcccgaaccagaatattaagtcatataaggccagt

SEQ ID NO: 2238 - DNA, 2001 bp, Cryptosporidium hominis
atggatttcaatattcaagaatctcagaaaatagctatagggaatatgttaaatttgtcccaacaaataaacaattcctctggaggatcttctatgggatcttatggaacaaataaaaataatgtgtggatattagaaggacctcatatttggaaagttttgatttatgataaaatggggcaaaccatattatccccattaatgaaggttgggagtttaagacatcatggagttacattacatattcaattaaatacacaaaaaagtaatatcccagaagtgccagcattatattttattaaaccaacagaagaaaatattgacaaattgtgcgatgatttaagaaatttatattacgaaagttattacgtaaatttcataagcccttgtacagataaacttttggaatattttgcaaaaaaagctttagaaactggtaatgctaataggattactaaagtaattgatagatatttggactttgtatcattatctccgaccaaatttagtttaggtatggataaagtttattctgaattttttaattcaaaaacaacagattcaaagattcaatctattattgatggtattgttacaggattaatatgtgttttatctagcttaggaacaataccaattatcagatgttccaataaacaattttctccaagccaaatgattgctagagaattagataaaagggttcgagaaatcctaagacaatcaaataacaatattttaaatattaattctaataatagaccagtattaatccttcttgatcgagatattgatctatctacaatgattaatcatagctggatttatcaaggtttaatacatgatgtttataacttgaaattgaatagaataactattgacgacccaaatagtggaaagaaagtatttgatttagattctaatgatgaattctggattaaacattccggagaacattttactcaagttgcaaattctgtaagtgaaatgcttggagaatataataaaaagttatccgagttaaattgtaataatgatgactcttctcaaatggcaacaaacttagcagttgctatacatgctttaccagaaatgacagaaaagaagagaggtattgatactcatacaaatattgctacaaagcttgtagatgagattaaaaaaagagaattagataaattctttgaaattgaggaatcatttgacaatatcccaacagtatctggatgtattagtgaagttgaagctcttttcaactcagaatctagtaagaatttcttagagaatgataaacttagagttgttttatcgcttttattacacgaaaggcatggacaaaatttgaatcaacaacaaatagaacaacttattaaactatttaacaatgaacaatcaacatcaataaaaattattagatatatttataattctcaaattcaaacaaagaattcgtcaggagttggtggattttcatcaaatttaaataaccaagatttaagctctggtctaggaaattctacaacatataataaacaagatatattaatagagaacaatttaagcaaggcaggaataacatctctagcaaaaaatgttggaggtaaagtatttgatatggcaggaaaaaacattctccaaggtgttagagccctgcttcctattaacaaaactctcaaagttacttctattattgacaatattatggaaaagaaatctttttcatcttcacaactttctactagctcttcaaatttggacgatgaattcctttactttgatccaaaacaaccgtgtatgcatgatcaagattctagcaaagtttcaagaattaaaactttaccgaaacaaggcattgtattcattatcggaggtgggaactttactgaagctcatgatatacttaattatgcaaagaagagtcaaaaaaacataatttatggctgcacagagtttattaacccatctgagtttattaaggagctagacattattgcaagctaa

SEQ ID NO: 2239 - DNA, 975 bp, Cryptosporidium hominis
atggatgctgaaactatcagactaattaacgaaagagaaggctacaacttttcacgttgttatgttttcatattaacaatattttttggatttttctttctatatttagagaggatcaaaactgaaaaagtattgtatttatttattccctcaagagttaaaaagttgatttctgaaggtattaaaagtgaaaaaaaggaaattaagaaatggaacttaagaattcgtggtatttccctaattcatgctttgttatcaacaatattttccataatagtactatttagtcgggaaattagacaagatccatacagtgggaagccaaacttttggctaattactagttcatattctatgggatattttttatgggatgtttcaataattattagagaatggaatcagaataaagactcagttgtatggtttttccatggatttgtatccttaatttccttatcaacatcttattttgtatcagaacagcctttgattgaaatactttctcttggtataattacagagttttcaacagtaattctaagtattagatattgctatcatattattggagatacaacatctttgtcatgtaaattagtaagctatttattccttgttgctttcttttttacaagaaatatcatacttccatatgcctttcatacccaaatgtttaatgcctttaagtttggcccaacctttaaatcaaaagcaagagtttgtatattcttccctattggagaattatttaacattatgaatatttactggttatataaggtggtaaaaaatgtgtttaatccaaatgatgttcctgataattctggaaaaaaagaatgtaataaaccacaacttgatgatatagatgaattgcaaatcccagaatcacaagataatatacttcttgattctagacaaaatacttccgaaattgacactaaattcgactcttctaaagagaaaaaagactaa

SEQ ID NO: 2240 - DNA, 546 bp, Cryptosporidium hominis
  misc_feature (412)..(412): n is a, c, g, or t
  misc_feature (450)..(450): n is a, c, g, or t
  misc_feature (499)..(499): n is a, c, g, or t
atggtaagaattactaatgtagaagttttaatatataataatgaaagtaacgaccttgaaataggatatttatatgatcatatttttagtccagtaggtggagtacattggatgcctagaaatggagttaaccttgaagagagtatacttggaacagctagtgatagtataagactctttaaagaaggaaatttgatttgtgatttaaggcttaaagacttagagttaaatagtatgcgcttagagagtgtatataactcatatcacacaaaaataaccagtttttcattttcagaatatattgagggagatatagtttcttcaacattggatggaaggtgtataatttggagtattaatgaagcagaacaaataaaatattcaaaaggagctattttagagaatcttttanatgaatataagagtagatctattctcagtatttctcanatggagaattttacaataatggatgtttggtttgggtattctaaagatnatatccttataggagtaaacattgggctctgcagttctatgggttaa

SEQ ID NO: 2241 - DNA, 81 bp, Cryptosporidium hominis
atgtgtaatcagaaacttctaaagctttctcttactgttaataatatatgcgatgctgttaaacacaagcttaagatgtaa

SEQ ID NO: 2242 - DNA, 549 bp, Cryptosporidium hominis
atgatgattcaaccacaaaattttgtaatggcaagaagagttctaggaacttcattacctctaattactagaaggttagtttttaaaagtgggggagacatatttggaagaataagaagcaatcaatggattacgaatacttttgtgagaagctttacaatgccaacatcatgtaagaaatttatttcaacaataaacaataaatttacagagagtaagatggaaataaagtcgaaacaagcttactcaaattacgataataatgaattaaaagataatcaagagaaggtggatctaaataatattcagggtactttggattatggagaagatggattgtatgtttttagttgtgtatgtaatgtttgtaatagcaagattacaaaaaagtttagcaagaaggcttataatgaagggattgtcataattagatgtgataattgcaaaaatcatcatctggtatctgataagcttggatggtttgaagataataaagataactttgatgtatttaagtatataaataacaaagagatttcagtttgttga

SEQ ID NO: 2243 - DNA, 576 bp, Cryptosporidium hominis
atgacgggtgaattagtttccagattacaaagagtgagagctcagatggatgaccatgcagttcattatgtaggaggaggtgaatcttcaagagctgatgcaagaaattcagtctttaagcttaaatggaaatttgcaacaatgccagataagaacaagataaagattgcaatggatatgcatggccatgttttaggagagcaggatccttcagatgatgaggcatggggtaactggaatacaagcaaattaaaacagtgtaaaatggttggtaaactagagcaaacaaaagatattggtagtgttttagtttctgaatttgaaaatgtaaccaagacagaaaaggaaatggaagcaaaaggtttgattaatacaccatatttgaacgaaaaaagtgaaacagagaaaagagatgaaattttgagagaagaagaagcttcatcatcttcttctgatgatgaatattctcaaaaagacaagaatggtgtacaaagattcaacacattacagaaagagtttatgctccaaaacttgacagaatggtatagagaaattgttaagcagtataaagaagga

SEQ ID NO: 2244 - DNA, 777 bp, Cryptosporidium hominis
atgttttgtagattttttgatcagttatttgaatgttgtaaacttccgaatgaaagtggatcaaatattgaaccggagtttgagtttgaagaatttgtcaaaaataatccccaatgttatggaatgatgaattatattcatgtttcaggggcctgttttggaaatacctccaactatagttctttcagaccgaacacctcaataaggtacttgaccagtaatttacgccaaagatttggaactaaccaattatctttattacctaaatacgaagctaaaaggttcgaagaaatgaactttgagacaaacgacatggatagtaattttattagaaatataattggaagtggacctcaaattagtaatcacttgttaaatttcatccaaatattaaacaaaggaatcatggtaaaacaagttatagacttaacaataggtgacacgaagtatattgcaatatacctttcaaagaatctaagcagcttaatattggataattttggcggagtattgctagaggtgcctttaaagtttgtcctagacgtagcttttagtgatttttcaaactacaaaaaaacactgatcaaccaattcacaactagaaagggatatgaaccagtaaaattgaatgaagatattcaatatctagtttctatagatcttggaacacaaatgaaatctatctgcttaacatttagctcagaattagatgggatgagcttttgtaccaacctttgtaacttaattaattatctaaatctcaaaagaattggatga

SEQ ID NO: 2245 - DNA, 498 bp, Cryptosporidium hominis
atgttggatggttatttgggtaaatctattaaaatggcacctcaagtttctcatctactattcactgcaaacagatgggaacttaacaactatattaaggagaacttagaaaatggaattgatgttgtgtgcgatagatactcattctcaggaattgcttattcttcgggagcaattaatctagattttgaatggtgtaaatctagagagcaaggcttaatttctccagatattgttgtttttctagaagttaatttaggcttatcctctactagatcaggctttggtgtcgaaatctatgagaatatttcagaccaaatcagtgtacgcaaagtctatcaaaagttctcaaattattctttctggagaaacattaatgcatctcaaagtcctgatgtaagtttaaacatttattcaacttattcttttaattctaatattatttttgattctacatatttatttcaattaactataataaaatatctacaaaattaa

SEQ ID NO: 2246 - DNA, 1602 bp, Cryptosporidium hominis
atgtactcagcgagtaaaccagatgaaaatattagtccaaatatagatagtaaggaagaaaagaagatgaaatcagcattaagttggagccaaattctaaattctggggattctggtagtggaggcacatcaaataaaagaagaaaaaggagtgtgagtagatttaagtctggtgtacaatctaattcaagtgtctactcaagttcagtcattaatccttcaaatcaaagtaattcatctttacccttaaattctagttcttcaaacaaagccaataaggaaaacctattaaaaaagagaagagaatggagacagaattttcagattaatcgaatattttttgaagaattcccaatatatagaaaggagtaccaatatccaagtgattacaaacaaaaaggtacacaaaatacagagtatgatgatttatatgtcaagaatataagagaatcgcttaagcttatacctagaaaatccaaaattgaatttgaacaaaatagaaatccttacttggatttttttggtaataagaaagtttgtttacttggggacgaagaatatttgtatcatagtaagagacaactaatattgaaattaagatggtatggagctaaaactctggattactattcatcaagagctgattatgtgatttgtccttcaacatataatgaggttatggaaaagcttaaaaatctttcaatgcctagagagaaaggacatcaaaactccttgcataaacttcaaattgatcgagacattaatgctgttcaatttgagaatttacgtggagttagaattggacagcaaattaagcttacagagttggaattgttagagtttgtaggtgaagattttgaagtcgcattggaaatgataaatatttctgaatttgaaagaaatacttggaacggcattgaaaattcacattctaaagtgaagctggaactttcaagaccaaaaacaatgtgggagtttattggaaacaaggattgtgcagatgagttatataatagcctattgtatctgagactccaatgtgaagatgaagatatattaaaaaagcagggtataattcaccaaaatttaggtgattcagatgaattccagagaaaccgtcaagtagaagctctagaagatgaatcatgtggtatatttgtattaatttctccaggtaacgttggttctcaaatttgtgcagagcttgcagctcttggatgtggttatgatataaaaatatatagaggttcagatgtagtggaaccaatagtgaaacagtggaagaaaggtcattttttcaaactatttgaggattctgaatctcccccaatttgcactataatgacagattgtagtggggtaattaagacaggagacatattaaagatcaagaattcttattatagttctgtatttttgagggatgaagctagtggtggctttagtacaggaaatcgtaaagggaaaagagaaaagtccgtaaaatcccaaaaatatcctgtaaatagcaaagtggaatcttgggaaaattctcaagaaactaaattagtagctaagaaacagaatccaggagctattttattcatattagaagaaacttga

SEQ ID NO: 2247 - DNA, 855 bp, Cryptosporidium hominis
atgagggaggagatttggagctttagttcttttggtcttatagatgatcaaataggaaattttgaagtattactcaaagtaatgcatgacttagttacatctataattgcttgcttggatttagtagaggaaagtaatgatagcaataacaatcataaagaacatcatcttgaatctaagaatgaaagaacctcaaattactctttaggttttgaatctccacaaatcatgatgaatgaatcttctcaaagttcaaacagcttcatatatgcaaaatttctccatgatttaactgaaatggattctcaataccaaatagagaagtttcctcatttggtttttcattcctcaggaaactcttcccaacaacctcaaaaccaattaaaccaaagccagagccaattacaagtacaacaatatgagcaaagagtaatttgtgagtcttattttacaactttatattctgtttctctctttaatctaattgctattctcaaacaaaacattccaattgaatcactttattctgaagaggtgatcaatttagttaatgataagctactcaaatatagtccaattaatactggctatgataagaatcttaccaactaccatgttaacaaaaagcaggaatattcttcaagttggaaatacatggaatatttatttttgaagcaggcgggaaagtcaacatcagcagtaacctggagatcagtttctattgattccagtataacaaatttatattataagagagaagtttgtcaggctaagtaccatgatgtgattgcttatgttccttcaaagattcccaaattgagtataagaattcccgatttactcagacataactaa

SEQ ID NO: 2248 - DNA, 1320 bp, Cryptosporidium hominis
atgggaaacaccaatgaaaaagtgaatatatctgagaaagatacggtaaataatgattcaggaggagctaaattaaagaaagaaaagggtgagatcacaaaagaaatgaagaataaagctaataaaagcgatgaaaaggaaaaaataaaagtaagtaaaggtaaaggagagcttgaaaaggaaggcaataatgatgagaaaaaaagcaaaaaacagatagaaaagatggatataatgaatgataataatacacctgaaaaacatgaaaaaagagatagtgttgtcaaatttgaaatacctctcaaggacaaactcagtcttaaaagaaggtgcaagttaaatattcctccatgctctagagtccctgagccggattatgaaattaaactgttaattaatgataagtatgatggtccatttaaattagaaatgaagaataatccatgtgaaatacatattacaggatttgaaggaatattattaaagagaattaagaagagagacattatgtttgtacaaactattaagaatgaatgcattagaatgtttataaaaggttcagaagaccaagaaactgataatttaacaaatagtgaacaattagatagtacaaatatgtatacatctcagtatttgggtgatgttatgcaaattatatgtaaatttgtaaataaacaagattgtgaatcatttgaattctttttttcatttatatatggattaattgttcatagtgataaagttaagattcctgtttcagattttgttgatttcggtgaatatgttataggtactagtaagcatatattaaaaagattggatgaatataagaattttaatgataagatttgtgaagataatatgagtattgatgaagaaaatgaggatgatttattagattcatatgaaaaaaagatgatagctcaagaaagggaatttttctcgagaagtaatttggagttaatatatagagcagaatcaccttttggtttagaaattcctaattcttcagatgataatattcaagataaagaagaagaagaaagaattttgagagagaaacaggaaaaatattcaaagtttttccctgtttctatcataggagaagcagaatctggaggaatcattacatttaaagatatatcttcaataggattaaaatatgtaccagaagttatagaatggagaatatccaaaaatattggtggtaataaagctgagtatgaagaggtaccaatatcagttagtaaatcatttcagattaatatagatcatgtaagtttaatattaaagaattctttttcatttacattttactaa

SEQ ID NO: 2249 - DNA, 780 bp, Cryptosporidium hominis
atggctattggtgaacattttattaatattaaaaatatttttattcaagaacaaaattttgatccaaataattggttattagcacaaggtacattatatcctgatattattgaatctggtggtacaaaaaattcaaatactattaaaacacatcataatcgtgttgatatgatttatgatttaataaaaaaagggcttattattgaacctttacgtgaattatataaagatgaagttcgtatgattggaaaaaaaattggtcttaatgatgaacttattatgcgtcatccatttccaggacctggattatctattaatgtaatttgttatgatggtaaatcatggaatgaaaatgataataatgaatatcaatcagcagaaaaagaattaaatcaaattattaatacaattaataataataataataataataataataataataataataacaatgacaatgataataataataataatattaaatatagttatatacttcctatacgttctgttggtgtacaaggtgattttagaacatataaatttcctgcaatattaatttatgataattattctttattaaatggtttttttaattttcctaataatagagattatattgaagaaatttctagttatattactaatcatacaaattttattaatcgtacttgtatacaattatatcaaaatccacaagtaaatttaactgatatgaaattacaacaaggttattgtgataaatatcgtcttgatcaattaagggaagtgggataa

SEQ ID NO: 2250 - DNA, 664 bp, Cryptosporidium hominis
atggaagttaaaaaacaaagccaatttaaaacaatattagcagatattgaatttattaaaataacatttcaacaattactaaaagaatcattagatttaattcgtatttcagcacctttgtttcttgaaaaagaatcaggtttaaatgatgatttatctggttatgaagaaaaagtatcatttacatttaacaataaagtattagaaatagtgcaatcattagcaaaatggaaaagatatgcattaaaaaaatatgaattaaatggtttatatgcagatatgaatgcaatacgtaaatcagaagaattagataatttacattcaatatatgtagatcaatgggattgggaaatggtaatagatacaaataaaggtaaaacaaaagatgagatattagtagatatagcaagaataatacataataatatatataatttagaaagattatattggaatatgaaaaaagaaaaacaagatataataaatataccaaatgaaaatgaaatgataaaaaaagaattatatataatatcatctgaagaattattaaatatgtatccaaatttatcaagtaatgatagagagagagaaatatgtaaaaaatatggatcagtatttattaaacaaataggtaaaaaattgagtaataatacagtacatgatt

SEQ ID NO: 2251 - DNA, 1230 bp, Cryptosporidium hominis
atgacagataatacttatttaaataatttcccagattcaaatggttattttggtaaatatggtggaaaatatgtacctgaagtaattaataatgcaatgaaagaaatagaagatgcttataataaaataagtaaaagtgaagattttattaatgaattaaaaaaaattagaaaagaatttcaaggaagaccaacaccaatatattatgcaaaaaatttgacaaaaaaatatggtggtgcagaaatatatttaaaaagagaagatttaaattataccggtgcacataaattaaatcattgtatgggagaagcattattagcaaaatatatgggtaaaaaaaaattaatagcagaaacaggagcaggacaacatggtgtagcattagcaacagcagcagcatattttggtttagaatgtgaaatacatatgggagaagtagatgtaaaaaaagaatatccaaatgtaattagaatgaaaatattaggtgcaaaagtagtatgtgtagaatttggtgataaaacattaaaagaagcagtagattcagcatttgaagcatatataaaagatatagataatacattttatgcaataggttcagtagtaggaccacatccatttccaaaaatggtacgtgattttcaatcaattgtaggtatagaatcaagagaacaatttatagaaatgaatggtgatggtatattaccagatattgttacagcatgtgtaggtggtggtagtaatgcaatgggtatatttagtggttttatatcagataaacaagtagaattaatttgtgttgaaccattaggtaaaggaaataaaataggtgaacatgcagcaagtataacatatggtagtgaaggaataatgcatggatttaattcaataatgttaaaagatgaagaaggaaatccatcaaaagtacatagtatagcaagtggtttagattatccaagtgtaggtccagaaattgcatatttaaatagtattggtcgtacaaaaactgtttgtattacagatcaagaagcaattaatggattttttgaattaagtagaacagagggtataataccagcaatagaatcaagtcatgcaattggatatgtattaaaaatagcaaaagaaatgaaaggaaagaaaattttgataaatttgagtggtagaggagataaagatttagattgtgtgtacaaaattatggatatggtaataattaatattatcaaataa

SEQ ID NO: 2252 - DNA, 753 bp, Cryptosporidium hominis
atgattacttatgaacaaacaaataaacaatttgtaaatattattttaaattgtattggaaatgctaatgttaaatttgatcatggtaaacttactattattattgaaaaaaataaatataatagtattgaagcaacttcatataaaataaaagattttcctgcattaccaaaatttttaataaattttagagatgatttatttgcattaaattttaaacatgaagttgatcaatcttttcatatatctatatatattccacaatatattggttatataagtcttgattcacaatattattatgaagtaacctttgatcaaaaatatgttcatattccttattctgataaatatagatatattatttttgaatctactgattataattatgctgtaccaattcataatgaatgtcatgcaaaagttaatgttaaagaaggtattattgaaaatacttgtggtaatttggaatatttgtatgatattagaaatggtttattattttataaaggtgttgaattattaactagaaatattggtggtttaagagtaataattactaataatatgaaaaatttaattattttatctaaagaaacattatattatgttgaacaattatcaaaaaattatgaaaaaaaacaacaagaaaagaaaattagtcaagttaatcaacaagaacaacttattattaaagaaacaagtgaaaaaaaaattttcagaaaaggttttgatccatttaatcaaaattaa

SEQ ID NO: 2253 - DNA, 720 bp, Cryptosporidium hominis
atgtttattaaaaacaaaatattattattattattatttatttacttgatattattgtttgaaaatgtaaccgatgattttttggttaaaaaagatgtttcattaataaaaattaagaatgaaacaccaaataaaagttcttcaagttctgataataataattctgaaggtttgagtagaggtggaggaggtagaggtgggaaaaagcctgtgcttaagatgatgaaatcattaccattagaaggccccgaaaagttttctcattgtaatcatcatcatcatcataaaagaaaacattgtgttgataaaaaacgaaacactgcttatcaatatatccctgatgaatcatcaggaaagaatatgatccgtttgtcgcctaatctactaatgaaagatctagatgatcctagttcatacccatctgatatgccatcagatgagcctagtcataatcctgatgatgatgaagaatcttgcaatgatgatgatgatgatgataatgacgatgatgaagatgaactatgcgatgatgaagaggaagaagaagaaaaatatcagagagaaaaggaaaaagaaaaaaatgaggataaacatgatcaagtagattcaggtcgaaaacgtcgacgtaaaagaaaagtaaaaaaaaataaaagcaaatcaaggttaagaggttctggaaagcactttaaaaaaaatatgtgggtcatggaaaaatattaa

SEQ ID NO: 2254 - DNA, 1233 bp, Cryptosporidium hominis
attgatcatttaaaaaatttgaatattggaggaatatatatagggcctgtttttgaatcggaagcgcatggatatgatacaacagatttgttttcaatagacaaaaggctaggaagcaatgaagattttaaaaatcttgtaaaaatatatcattcaaatggaattaaggtaattatcgatgcagtatttaatcatgttggtagaaacttctttgcattcaacgatattaagataaatgggaaatattcgaggtattgtgattggtttaaaggcttggatttttcaaaaaaatctcaaaaaggagataattttacttacaccccttgggaaggttattatgagttggtaactttgaatcatgaaaattatgaggtgaagaaatacttatttgatgctgtagagttttggtttaaagaatatgaaattgatggcttaagattagatgcagctgattgtatttcaattgaattctggagaatattcagggacttttgtaaaactaaatttggagaaaattttgctttattagcagaaattattcatggcgaccaaagaatttgggtgagaccaaatccatctgcaagcattaaatatgaatatactaatcagccatttgatggggtaactaattatgttttatgggatgcaatatggaaatcacaccgttttaataatcttgaattgcttgcaaatgtgatctctcaacaaaatgatttatttagtagtggatggatgtataattttgttgataatcatgatgtaactagaattgcaagccaaattgaaatagaagacgatcttttaactgtatatataattctctttatgttaaatggctctccttcaatttattatggaagtgaatttagatttaaaggagttaaaggaaaaggtcgacgagctgactttcagcttagaccaaagcttacaattaaggatcttgagtggcttaattctgataaaaatgatggatttttggttttgattaggtttatttctcaaattagaggtcatccaattataggtaaaattctaactaaaggaaattatttattattattgaataccaaaaccttgttggtattcgaaaggcgtattaaagaagaatttatttttgttgcaattaatattgataccaaatctgttgaagattttgaagttgattggaaagaaaaagatggccaatggagggatattttatctccttcagatacttatcaatcaaaaaacggg

SEQ ID NO: 2255 - DNA, 165 bp, Cryptosporidium hominis
  misc_feature (150)..(150): n is a, c, g, or t
atgaaatggccagatttcaatgatgattcaattaaagaatttagattctctccaaatcatagtaaaatgttgaatttgataataaagtcaattgaagattttagaaaacaatggataaatggagtagtgctaaaaaggtggatctgcatncacaggaggtggtaa

SEQ ID NO: 2256 - DNA, 120 bp, Cryptosporidium hominis
atgagtgctaagactaataatttaaataacaatatcaatagcaaagatgaaataactaacagttatgttgatttaaaaaatgatgaacaaggctctgatattcaagatgagcctttcaat

SEQ ID NO: 2257 - DNA, 153 bp, Cryptosporidium hominis
atgagtggctatatacatgaaaatccgtccattgatattttaaaagaacttaagttagcaggaaatcatcagattacaacacataatgaaaaccaatttgatgatattgctaaaattaatttaaattatatcgaaaatggtcaatacttgaaa

SEQ ID NO: 2258 - DNA, 156 bp, Cryptosporidium hominis
atgaattttaatgaattaatagaaatttcattattattattattttcctcgtttaatttattaaagaaaattgtggaatttggcgccatacttatgttaattttgacattaataggtgcacagggtaggagatcacaaattataagaaataattaa

SEQ ID NO: 2259 - DNA, 51 bp, Cryptosporidium hominis
actcaagatgaaattgatggtatcaaagagattctttctcaagaatgctaa

SEQ ID NO: 2260 - DNA, 32 bp, Cryptosporidium hominis
caagcaaaacttagaattgtaacaacaactta

SEQ ID NO: 2261 - DNA, 969 bp, Cryptosporidium hominis
atgaagcttttttttatattgactttttttttaacaatttgcttagaaatatgggaaactgaaggaaatagattacaaataccatacaaaaaaaaaagattaacaaaagggctaaaatggaaaaaaagaaaagatagcaaaaaaaatgaagatgaaaatgaagatgaagaagcttacgaaaatcaaatttataatacaggaccacttctcctagtctctattattgcaaaaacaaatactatttatccttatgtggggaatgctagcaataaaaaaaaatgtaaagaaataaaaaatgttgttttttacgcatatactacaaaactgttttatgttgcagaagttgaatgtaaaaaagatgttattattcatggagaaaatggagaattcagctttgattttgaagacaaagaattttttgttaatacagatataattgttacaagaaaaactattaaacatccaagttatgttaaagtaacatcatacaaagttggagaggtaccattgcattgcccaagtgtaaataacttaaatactgcactaattgatcggagctttgatgtaaaaattgatcaaaaatacatcaaacatctggaactggtttttattggaattgttaaaaaaacaacccttgaaatagaatttccgcttgtagatgtcgaaactggaagtataaaaaattatcaatttagtgaattttcatatatcatttatgaaggaagtcaaatttttacttcaatcccaattataggtggaaatatctgtgatattaaggtttctagtacgattaaatgtagtccaggaagcccaatcaactttatttatgaattagaaaacggaaatttagtgagcaatcaagttaaagtactgaccattaacctgtttggaaaacatgtttatcaagatcaaaatctaaataaactattagaacgtgtaaaaaaagcgctcattgatgataatgattaa

SEQ ID NO: 2262 - DNA, 714 bp, Cryptosporidium hominis
atgttcaattatttgaagttatttttgattttcgctgctttatgtaatctcttatcgcttttacctgatcaggttttttttaatcatctttcaaatacatccatcaatccaaattttgtctccaaatattcctatgtaaagttgaaatctggtttcgttcgccccttagctcaagctgcgaatcgaggagcttctagtacaggctctttatttagaggtatttcacaaagtcatgctggtggatctggtagatctttattccaaccaggccctcaaggttcaccaaatacaggattgcgtcatccccttggctcttcgcaagctgttgctcgagcaataagtagagctcttggaacttccccaagttctagttcacgatttataggctcatcttccggagcaaatcccagagcaaatgttggcgcggcttcacaagatcttcgtggttctacatcagctggatctagtatatttccaagaagttcttcatcgactcaaaatttgcaatcaagaaattttggtcttcaatctcatcataggggttctcattctgctacaggagctgcgtcagcaccctctcgttatggccctggttttcctccactcacaagacctgtaggctatctttctgtaccatgtcctaataacccaaattccaatcattttttaaaaccaggaaatggaaaaagacaacattgccaatattgtgattaa

SEQ ID NO: 2263 - DNA, 228 bp, Cryptosporidium hominis
atggttccagaaggtattgaaggtagagttaaatataaaggtgaaatggaaggtgtagtatatcagcttgttggaggactaagatcctgcatgggctatttaggttctgcctcaattgaagaattatggaagaaatcaagctatgttgaaataacaacatctggattaagagaaagtcatgttcatgatgttgaaatcgtaaaagaagtaatgaattatagtaaatag

SEQ ID NO: 2264 - DNA, 822 bp, Cryptosporidium hominis
atgaaaatttttgaaattttatttctttttgcaacacattttttaacaaagactggattcagaaattccgaaagcatctctaacttttcattattgtcgttaaaagaaggcatacaagaaaaaaatgaaacaaaagaatattattcaaagtataatattacagaaagagttccaactctatttacaaatatgctaatattggatatgaacccttcagaggaatcaaaaaatagccatttgttcaaatattcaaatactagttatgcattagattgttaccagaaattaccacaatactcaataatcattggtcttgttaaagaatactcatatttcttatctgtttattacagattaagatgtgaaaatgggaacgagtaccatgatggaacaaaatgcggtgatatcctttatttagttgatttattggagaataaagcagaaatattgaaagaaaagaagaatcttaaaaagaataaatgttttgcaattgaatcaaatattgtttcgactcaatataggttttacaatcatactggatttgtgggaagagctggtaaaactttggtagaatcagaatttgttttagttgaaaaatcattcttaagaagaattatgtcagaatttgagcaattactcataagcaaaacaatttcttatgaattacactgtatttcaaaattggaaaataaggaagaaggtgaagttgactgttatcgcttaagattggaaaactggattttagaacaagaacttgttttaatttcagaagaattctttaaaagaatgtcaaggtttgaaaggttgagggatataatttaa

SEQ ID NO: 2265 - DNA, 819 bp, Cryptosporidium hominis
atgaaatttttatcaaatttgtcgattatctcaatattggctgttattgcagtcttttacagttttacctctactgaatctgatcttgtatcaagtggccactacgagttttcttttatcaaggttaaatgtggtggcaaattttgcagtaggcttagaaaggcactttgctgttgtaccggcggtgatgatgaagatcaacaacaaccaatagaaattggtcccccaactaatttccaacacctacaaacaggtggtctaaacatgagaggtccagatggacaacttgtttctcaacttccatctcccactgcttccggttctggtcttaataacgagggctatcaatcagacaatgaagatgacaatgaagatgaaaatgaagacggagatgactcaggtagtgtaacttcatcaagttcatcatcatcatcatcatcaagttcatcatcatcaagttcatcatcatcaagttcatcatcatcaagttcatcatcatcatcatcaggttcatcatcatcaggttcatcatcatcatctccttatgcaaatgatcgagaatatgacacaagattttaaatgcctcctgaaataccgaaaaagccagttttcaatccttatcttaataaatatggcctcgttggtaattctgcaagagcaaaatcaatctcaaatcaatcaagccattttgagactaataacgagcctgaaccagtagaagagaggggagagaaagaattaacggcaattccaccaccaccaccaccaccaccaccaccctcagcaatcaaatcagtggttataaacaggattttttga

SEQ ID NO: 2266 - DNA, 240 bp, Cryptosporidium hominis
atgcctcctgaaataccgaaaaagccagttttcaatccttatcttaataaatatggcctcgttggtaattctgcaagagcaaaatcaatctcaaatcaatcaagccattttgagactaataacgagcctgaaccagtagaagagaggggagagaaagaattaacggcaattccaccaccaccaccaccaccaccaccaccctcagcaatcaaatcagtggttataaacaggattttttga

SEQ ID NO: 2267 - DNA, 4710 bp, Cryptosporidium hominis
atgattaataaatatattagcaaaaaaaaacttaccattctaatacacgtgttcataatatattttcttgtgatatataataatgaatggaattctcttgatttttattatttaaagttttcacataacaatagcttattaaaagttaaaccaaaaaaacatcttggaaagtatttagctagaattaaaagggcaattccaacaaaaaaaccatccaagccatgttcatgggaaacggttggtcctgcagctcgtggtttaacatgtaatagaaatgttcacatgactactagaatggaaaaaggttctacagtgaagaaaaatgaattagtagccaagatagagtataatggaaacaaacaaaatttaattaaagagaatattcgttcaccatgcacaggagttgttcaggtgataaatcctaattttgggtctaaccacaagattgtaatcgtttgtcaggctgtagttagtgttaaagaaacagaattgtccttttcagatggaatctttacctactcttttgatactaggctcttgttaggtaaaacagctgttacaatttcaggttaccatcaatcttcagcggctttacattctcaagttcaagtaaaaaagccagttggagtttacactcctgatactgaatcacaagcaaagactacagaaaaaacatacacagcttgtactggattattgaaagagttaaaaactcaaagaataacagcgcctggaactataatagttacagaaaattgcaagaaacccttttgggtcgtggttcatgagagaagtcaaccacatgctgctcaagatattgttcctagttactctcctttgtatccttcaggaattatttatcctcaatcgccaattaatttaccaggaatgagctcctcttcttatggaattccaccttctcaaggaacaccttttccaggatctcttgtaactggacctttttctatttcgatcagacaagtttcacatctatctattgcagaaataaaggttcaagaaaaaggaagcacacaattctcaaaaaaatcaggatatgttactcaagcaaattttgggcattttctttcgcaagattctcaaacaggtttgatgaaaacttatcttgttccacttccatgtttaggttttttaacctcagtatttgagggagaagtctttcctgaatatattattgctcaagttatttgtaattttcaagacttggatatcaatgctcctcattcggttactagtgattgggtagttccaaaagaagaagaccttgattgcatttatttaacttcaacagatatgaaaacggaaatcagagtagcagatggtgcagatggtattcccaatattgaaacaaggtttttaacatcaaattcaatggcatttgcaggtgaagtggttggaaagtttaaatgtaatgttggttcaaagaaaggaaaagaagtggtattattttccccttgtactggcccagcaaattcggctgaaaacttaaagactcaaatgaaacaagtttcttctcattctcaaatatttacagttggctgtacaatgcccttaaatcctaaagataagtttgaaaaaatggttcttgatcaaaccatttttaaacaattatcagcaaccctcagcaaatgtatttcatatagatttaaaggcaaaaaagtttccattgtctctaattctcattctacattcatggaacttaatcctaaagtcaggtccgaaatgaaagttacaaaaggtgggaatattggtaaatttacttgtattattggtagcagtatgtttagtgaagatcttaaatcagatatttctggcgatgttgtttatgaaattgcagataaaactcaagtaggcgtggatgttgtaatgcttataattaaatctgatcaaaagtggcaaattgtcaagccaactgttactctagttggacaactaggtgatgtacttgctactaagactgatccacatcagccaatttctctacagatgtgggaaagtgcttacctctcttggaaaagaaatgattttaagtatctagtaccgcatgctactcagtctttagcttccgatcctaattggaaaagtggggatcaagttattcaattgcctcatttacttcaaaaccctaaccccccttctccaacacatgtatttttacaatcaggttattcccagatttatggtggtatttttattcaagaagaaagtaggggaggacgttatgttagaagtgttggagtaactaaaacagctcatgttactttgactgaaattgaagaatgtgtgaaagatgcgccgcttggaacagtttctctacattcctacggggctcctacaatgatacatgttacttgcccatgtactggtgtagttacttcattacttaagcataaagttgacgtttcttccggtcaacagatccaagctggtcaaacatttgcagaagtcgcttgcagaaagagtacaatcgcatggatggataatccaaagctcctcactaaaactggtcagaaagttcatacaactaaaaaatttacagaagttcaaggacttggtacgccgctatatcctgtagaaaatggtgatgagattacaatctactcaaaactctctggagttttcagaattacttctaaagatcagagatttgtacaagaaggacaagttattggcgcattcgtttattcattaggattagaatacaatgccatgatatatgttacatcgccatgtactggaaaaatgacttatccttcaggttcaatagaaactatggatgtttctgaacattctattggaggattgaaaatttgttctgtattatgtagcgtagttgcaagaatcgaacaaaccagttttaatgaacagcaattatattttaattatgttttctcttcttttagcttagaaggtcaagaaaaatgctacaaggctacagctcgtactggagtcaaaattatttatgttccagccatactcgtatcttcttctgaatctttgaatgtagaagctggtgatgaaattgcatttttggctcttgatgaaaatcgttctttacaagtcattataaaaactccttgctctggagttattaaaggacctgcatctcttaagatgaaatcaggaagtatatttgctgcaggcgatattatcttcaaagtttactgtgactctattagtactcctgtaattgaagatttgccttcagcccctcctttaagtactttaagcgcatctcctatccagtatttacataaggaagggtatgattttgttattacttccacccactgcaaaattagcttcaaaaatgatggtgtaatcggtacagtcggagaaaaagaaattgtaggaaaagcatcatgcactagttcaactaatgcccaaattgatgttgatatagtcaaccaaaaccctggtactaatatcttctttttaacaatggccgctcatggccaattagtgttatctggaactacgatcatgatggttaaaaaggatacgggacaacaattaatggataggatccctcaagaaactcatactggtagtttagttacgaaggttggagatttgacaaaatatggttatatttgggcagctatgtctggtactcctattttcaaagatcaagcaaaaatcgatctcgctacaaaaggtgaatcattgggggtttttgttactcagaatggtggaaatccagaaaatattattcctccctgttcaggagcagttcatgctccaagtgtaaccttacttaataatactcttactttgcctggaactgaaatacttagggtattttgtggttcaccttcagtcccatctcaggctatggaaatgactcctccaactgctcaacaactttctgtaaaagatagagatccaattattacaaaaaatatgcttggaatatacacattatcttggccgatgtataatggtattgttcagtactctcccaactggattgtttacacacaaattgttcttcaggaaggagcttcatttggaacttttatttacactgatgatgatggaaattctaaatctgtaaatttgattgcttcctgtaatggaaggctggacaagagtgtcgcttctaaagtagatggaaagatggttaaagcaggagagaatgttatttccaaagtacactgcgtaaatattcactatgttggtagctctattagtgtatttgatgatgttagcgcaatttcttcccaggcattatctggaagttcttcagggtcatcttcatcagcaccaccaccgccaacaccgtcaccatcttcatcatcaccttcatcatccccatcatcttcatctaaatcccaaaaaccttcaaaaaaaacccaaaaaccaaaaaaagccccaaaggcttcatctccaaaagttaaagagaaaaaagagaaacctagcagtgaagatgattcagagagttattcgatggacgaagttaagaaaaggctattaaataaatcaggcttttctggctctggagcgagaaatggtagtcccagtgctgggagtggatcaaactctccaccactaccaccgccatcatcgtcttcaccgtcgccaccacctcctccaccaccaccgcctccaccaccatcatcatcttcaccatcgccaccacctcctccgccaccactgcctccaccacctccaccacctccacctaaataa

SEQ ID NO: 2268 - DNA, 2634 bp, Cryptosporidium hominis
atgcaaacagtaattggaaataaattggttcagggaatctttctgatcaacttaatcaaatatttactctacttatacgttgatcttagacaaaaaaaatgttatgatatcaaagagattcctaagtatatattagatgcctacaaagactgtggagaagtttccaatgaagaatttaagaagtcccaatcatacagcaattcaaagatggtatttggactgattagtagagcagtcacctttgttattaactgggtatttgttttttatgtaatttatccattgatgtgggaaattatttacacaagaattagttcgaatgaatacgtctcatctttattattttgtggggtaatgatgttattagattatcctattagtcttgctttcgatctttattacacgtttgttctggaagagaaatatggttttaacaactcaacattgaagatatttataatggatcagatcaagtcaggacttcttgtttctgtatttggaacgattctaatttctgtaatgatatacattgctaataatacaggtaaatacttttatgtatatattgctctagtacaatttggtttcatatttatcatttcaataatatatccaattattattgtccctatttttaacaaactcactccagttgagaatcaagaacttgcagaaaaaatcagtaaactttgtaaagatgttaatttcccattaaagaatctatatcaaatggatgcttctctcagatcgaatcatggaaatgcattcttttcaggtgcattcaaatctaaatctatcattttatatgatactattcttgatttcccccaagatgagatagttgcaattatagggcatgaaataggccactggaagaactgggataactacaaactattgttcttttcatttatccaaacatttgtaactcttttcattttccacttaacgttttcatggaatgaactttacttatcatttggtttctctttagatccaaaacttggaggtaggaatttagttctatctctccttgttttctcctatgtattgggtcctttcagctcaattgttggaattctttattctatcatgtctcaacgtgctgagtataaagctgatgagttttcatttaatcttggatttggggattttcttgcaaattcactatttagactctcaaagaaatcaagttcttgcatgatattcgaccctatttatagttttatccacttatctcatcccactgtatgtgacagaattgtcaacctaaagaagttgaaagataaaaaaaactaaatggcaaaaagaatttcatatttctatgatggagacataggaagttattattatggcccaggccatccaatgaagcctcaaagaattagaatggctcacaacttaatactttcatacgacctatataagcatatggaaatttacaagcctcacaaatcgccacagagtgagttagtttattttcatgaggaagactatatcaatttcctttcaagtattaaccctgataactctaaagattttgggctacaacttaaaagatttaatctaggagaaacaactgattgtcctgtatttgatggtctttttgaattccagcaaatatgtgctggtggtagtatcgatggtgcttataaattaaataatgaacaatctgacatttgtattaattggagtggtggacttcaccatgcaaaaagatctgaggccagtggattctgctacattaacgatatagttttagggattttggagttacttaaatatcatgctagagttatgtatattgatatagatgtacaccatggagacggtgtagaggaggctttctacctttcgcatagggtattaacagtttccttccataagtttggagagtttttcccaggaactggtgatatcacagatattggagttgctcaaggtaaatactatagtgttaatgtaccattaaatgatggtattgatgacgattctttcttatcattatttaaacctattattagtaaatgtattgaagtatataggccgggtgcaatagttcttcagtgtggagctgattctgtaagaggcgatagacttggtcgttttaatctatcaattaaagggcatgcggaatgcgttgaattttgcaaaaaatttaatattcccctacttatacttgggggtggaggatatacaataagaaatgttgcaagaacttgggcatatgaaactgctacaattctagatagaactgatttgatttcagataatatacctttgaatgactattatgattactttgcaccagactttaaactccatattcctccacttaatttgccaaatatgaactcaccagaacatctggaaaaaattaaagcaaaagttattgataatttgagatatttagaacatgctccaggagtagaatttgcttatgttccatcagatttctttgatagggaagcctcaaaccttcaaaaacaagaagatgaggagcgagaagaggagctttcatcttggcatggaggaggaagagctgcaggtagcactgaatcccaaggtaatcacaatgaaaaacctaaatcatctaaaaaactacaaaaagaacatgcttctgaattttattaa

SEQ ID NO: 2269 - DNA, 1335 bp, Cryptosporidium hominis
atggcaaaaagaatttcatatttctatgatggagacataggaagttattattatggcccaggccatccaatgaagcctcaaagaattagaatggctcacaacttaatactttcatacgacctatataagcatatggaaatttacaagcctcacaaatcgccacagagtgagttagtttattttcatgaggaagactatatcaatttcctttcaagtattaaccctgataactctaaagattttgggctacaacttaaaagatttaatctaggagaaacaactgattgtcctgtatttgatggtctttttgaattccagcaaatatgtgctggtggtagtatcgatggtgcttataaattaaataatgaacaatctgacatttgtattaattggagtggtggacttcaccatgcaaaaagatctgaggccagtggattctgctacattaacgatatagttttagggattttggagttacttaaatatcatgctagagttatgtatattgatatagatgtacaccatggagacggtgtagaggaggctttctacctttcgcatagggtattaacagtttccttccataagtttggagagtttttcccaggaactggtgatatcacagatattggagttgctcaaggtaaatactatagtgttaatgtaccattaaatgatggtattgatgacgattctttcttatcattatttaaacctattattagtaaatgtattgaagtatataggccgggtgcaatagttcttcagtgtggagctgattctgtaagaggcgatagacttggtcgttttaatctatcaattaaagggcatgcggaatgcgttgaattttgcaaaaaatttaatattcccctacttatacttgggggtggaggatatacaataagaaatgttgcaagaacttgggcatatgaaactgctacaattctagatagaactgatttgatttcagataatatacctttgaatgactattatgattactttgcaccagactttaaactccatattcctccacttaatttgccaaatatgaactcaccagaacatctggaaaaaattaaagcaaaagttattgataatttgagatatttagaacatgctccaggagtagaatttgcttatgttccatcagatttctttgatagggaagcctcaaaccttcaaaaacaagaagatgaggagcgagaagaggagctttcatcttggcatggaggaggaagagctgcaggtagcactgaatcccaaggtaatcacaatgaaaaacctaaatcatctaaaaaactacaaaaagaacatgcttctgaattttattaa

SEQ ID NO: 2270 - DNA, 2340 bp, Cryptosporidium hominis
atgttgagaaagactgctaataaacattcggaaagtaatggagaaagtaaaaggacctctgtatctagtaagggctcagaggagttctttaggtccccttcagttgttggacaagaaataaagaaggaagaggaggaggaggaggaagaagaagacccacgtaatatatggttgaaactatttctgccagattggtctcctttaggagggtttttgttggtaatagtttctgttggagcctcaatcacgtatttgaaaaagattggtgataaaaacccatttacttatcccttttttattctccttttggatgtatttacttacattataataatgtgcctgaggcatattatcacattatatacattatcaaggtttggtgaaggaagattttttgcagcagtgtctggttctctcgatccagaactagtatattgtatttggtcagcattatgtttagtattaacaatgggagaaatgaatgtaacaatagatcccgtatcaggtgttgaaccaactcatacatatactttaaagtggtttgacaatatactaccctctttaaagataccaaaggtaccgtgggatctaattcaatgttgtcatattgcaattttgattatgactgtaagaagactcctgcttgcaattattacattttattttaggttggattttattatgagtataaatccacaagtctcccaatttttaagacaatattcacttttgagaagaatagatacaaaactttatttaattaagcctcatattcagaagaaagattttctcttatattcaacaggaatagagttacccaacaagtccaatttccctcaaattgacaatcaaaaatcaccaaatagagtgacaacaggtaatatacccaatgtacccagtatgcttatggactataacattgattatacggcaaaaagctcatctgaaaactggttagctcttcagtttattaaacaatataatgtctctatttacattgaccatgataaatatgaaattagaaccaaacaacaggcgagagactttgcaaagattatattttatgatatcctacagcatctacatgctattatgctctatcactacattggagggacagatcatgttaaacctcaaaaagaacctccattaaggtcagatacatattcaataataggagatgatacattctgccatgcacttatagattttgaagaaagacatgatttcaaaggtacagatttgagaaatgtagattattttgaaaagaaaagttcggtcgataccctatttagtaagaatggttcaaatcatcaaaagagcaataatcaaaaaaaaattgtagaagaacaacaggctgatcataattattccaatactaataataacaactcaagtaacgaaagatctcaaactcaagctgataataaaaataaaaaccagtctcttcctactactcttccaaactcagtacttgatattctatacgacaaaccgcttggagacttgatcaaacaaattgacaccgcaaggcgtggccaaattactgaggaggagtgggttagattttgtgttggcatatatgatagtagaaagaagatcctacgtgctgcatctagtcaggaaggtattgttcaagtttttaggagaatgatctctatcttttcatggttctttacaggaattgtaattcttttaatggttggaattaacgtcaatacattggttatttctggagctgctattatttcatctctttctgttggtctctcttatatatactcaaatttcttttctgccgtaatatttgtaatattcctcaatccatataatgttggtgataggattagagtgaacaatggtggtgccatgattgtaaagaaaatcgaaacattttacacagagtttcatactgtatttgaagcaccagtacttattcctcactcttggttatcttcacaaatgatatacaatgagagtagaagtaaatgctgttcttctgaaatccaatttttaatttccgatactacgtctccattctcgatagaagcattggctacagctgtacaagaatatatttctgtcagaccttcagaatttgttgcatcaaatttctggtgtggtattaatgcaattcagccagggcattcagctactgtttatatgtggattactaatacagacccatttcataacagaagaaagcttttaataagcaaaagtaaactactactatttatattacatactttgagacaacttggaattcaatacactctgccagttagtagagtcagaatagaaaatgaattcaataatcatttttctattaacagttag

SEQ ID NO: 2271 - DNA, 933 bp, Cryptosporidium hominis
atgagtaaaaacttatcaataattgaactctcaaagtatgtccctaatggagatatattaggttctcaggaattaaaattgagggagctggagataacaggtattgatgagcttacacaagcaaagaatttgagaaaaatagatgtttcaaaaaataagttggaatctatttcatttcttaaatattgctggaacttaacagatataaatcttagtaataataacttaacttcagtagatgaaatctgtaatcttgagaatgtaaaaatcttaaatataagtaataatagtatcaagtcaatagaaaatttgtgtaggagcccaggacttcaaaaatctctcaaagttttaatcgctaatcataataaaataagatatattccagatttaagccattttaaggaactagaaacagtcattttatctcataatgaggctattgaaattgagaatcctaagaatcattgtccaaagcttaaaaagatgagtttatcaaataactgtcttaaacaatttccatttagcttaaattttaatatggtccaggagctaaggctcaataataacaaaattctttcattgccttcagacataacttatatgggtaatataaagattcttgagcttggacataactttattactgaaattgatcctttattaagtttgacaaaattaaagtcattaaatatttctaaaaatccatgcattatatcagaaggtaccgagggtgatacttcaaattcaataaagactttaaatttgattaaagaaaaattgccatctttggattcgttgaatggtagttttatttccaaatcaaatgataaaaaaagaataaataaaaaaaaaggtattaagaacgaaaataagaagaagtttagcacaggaaaacctaactctttaaataaaaagattattaaaaaactctaa

SEQ ID NO: 2272 - DNA, 870 bp, Cryptosporidium hominis
atgttcgtacagatgaaacaagtttcatttgtgttattgttttgtttgtttttttatcaactagacaaattacatgccgaagtcatttacgccgtgaattgtggggggccaaggcacttttcaaagtcagagaatattttatacgaagaagataatggatataatggaggtattagtacagattcaggaaaacaattatccccatttccttacgtagaagatgattttgtatatttatcagaaagatattctacagatagaacattgcaatatatgctcaatttaaataaattgacccctggtgtatttacaatagtattaaagtttagtgaaatccactttaaagaacccggaaaaaaagtctttagtattgctgttggtaatgttatatttaaacagtcttttgatatatataaggaagtaggatttggtgtacctatggaggaatacattgaatgcacttttgatggtgaaaatatttcattaaatggaatgaatataacccaaggatattcaaaagaggagaaactattgattttagcaatgtttaaacaggaagacaatcccaaaattaatgcaattgttgtttacaaaggcagtaaagacgaaatcccaaaaattcaaagaccaaagccaaaactttctgtggaaagtatcttacaaaagattaataaggagggccagaaacctgatataataaacaatcaaatatatcttatagatgaacctcttttcactgttaaagaattaactgttactgactctctttataatttaatttcaactattcctggaataattattttgttaatcatttcagtagcaactctaagaataggagtaatactatcaagtcatctatctgattaa

SEQ ID NO: 2273 - DNA, 1446 bp, Cryptosporidium hominis
atgatcggaattagaagcttggtttcagcagcatttttaggtttttcttgtctctccaaggtagtcttgggtggagatgaagctcacttcatttcagaacacattacttctttaacttcctccaacttcgaagacttcgttaagagcaaggaacacgtaattgttactttctttgccccatggtgcggccattgtactgctttagagccagaattcaaggcaacatgcgccgaaatctcaaagctttctcccccagtacattgtggtagtgttgatgcaactgaaaatatggagcttgcacaacaatatggtgtgagcggatacccaaccatcaaattcttcagtggtattgacagtgttcagaactattcaggagcaagaagcaaggatgcattcatcaagtatattaagaagttgaccggaccagcagtccaagttgctgagtccgaagaagctatcaagacaatcttcgcatcttcttcttcagcctttgttggaagattcacctctaaggactcagctgagtatgctgtcttcgagaaagttgctagtggtcaccgcgagcacaactatgctttcattgctttcttccaagaaggtgaacaaaagctcgaggtattacacaaggatgaggagccagtttctctcccaatgccaaagactgttgaagagttggaggccaagatatccataatgaatgtcccattgttctctgcaattagtgctgaaaactactccctctatatgtcaagagaaggttacactgcctggttctgcggtactaacgaggacttcgccaagtatgcttcgaatattagaaaagttgcagctgattacagagagaagtatgcctttgttttccttgatactgagcaatttggttcccatgccactcaacatctcttgattgagaaattcccaggtttggttatccaaagtgtcaatgttccatcgattagatacatgtatggtccagctaaattcgactctgttgagccattaaaggaatttatgaagcaagtttctgaaggcaagcacgaactcagcattaagtctgagccaatcccagctgagcaatctggtccagtcactgttgttgttggtaagaccttcgaagaaattattttcagaagtgacaaggatgttcttttggaaatctatgcccaatggtgtggacactgcaagaacctcgagccaatctacaaccaactcggtgaagagtacaaggacaacgacaaggttgtgattgcaaagatcaacggaccacaaaacgatatcccatatgaaggtttcagtccaagagccttcccaactatcttgttcgtcaaggccggaactagaacaccaattccttatgatggaaagagaactgttgaggccttcaaggaattcatcaatgaacattcatccttccctcaagaaaaggaatctcgtgacgaactctaa

SEQ ID NO: 2274 - DNA, 2616 bp, Cryptosporidium hominis
atggagaataataacattttccctcctgaaattacaggagagcaggttatgacggtggtatgcttgtttggaatatgtgcaccatcttcagcatttttggaatcattttttggtcataggacgatatttaatgggaaagttcgtctgccacttagtgttgtattatttgggtatggaattatgatggattatgtactcagaaccttcaactttggtatttttagtatggcaatcaaacatgcagagtccatgcatcccaatattatattctccgttctccttccgatatgcctttatgagtcatcttcacagcttaattaccatatttttaagcgtaacctcatctcttctgtcttattagcgcttccaggtgttatcgtatcaatgattctgactacattttttatgtattattttgttggaggaatttttgattggacatgttcacttttaatcagttctattctttcagctactgaccctgtcgctgttattgcgtctcttcaccagcttaatgctcctgataagcttgcttctttagttgatggtgaatcactattgaacgatggagctgctgttgtttttttccaactctgcaagaatatacttttgaataggtttttggagccttctttaattttgacttctggttggatatttattagatgtgctttgggaggtcccttacttggattcctttttggatggggagtacacctattcttgaaagttgcacaagctacaaatgatgttcaagtttttattgcaatctcgatagtttatactcttttcttccttagtgaattaatccactcatcaggagtgttagctgtcgttacttatggggtttttatgtcttccagaaaagctgctctatttaagcctaaagcacaagaaatacataacacaataattcactttgttggaaagcttgggaaccatatgatctttatgttggctgggattgttagtgcaagactttttagaccttacattgaagacactaacatgcttatgaatctttttttgttatttgctgccatttgtgtcattcgaggaattatggtatttatattatccccactactaactagaattggctacgggctaactattaaagaagccataattttgatttggggtggacttagaggaggagtctctcttgctcttgcaatgagcttggagtctgaagattatatagatccagaactaaaaggacaaattgcattttatgtggcaggtaccgtattattaacattattaataaatggtacaactgtagaatttatatataaaaagctccagttatatacaactccaaaattccatagaatgttctttaaaaaagtaatgaaatccattaatgaggaatatagattggtcattaatgaccagattcgtaagcattggttttttaatgctcatccaggattactcgaactttgcgatacctttataccaaatgtaatagatgctaaaatgacagagactggagaaatcatactttctagtcagctttctcaatatacatttattaaaaatattaaatcaactaatatacaattaataatgcaggatccaacagctcccattgggcatgattcaaataagtatttaaatcaaagaaccttatcatgcttaactagagatgaggagtttgaagacaggtttatcaaagaattggatattaataatactcaaaccgaaaataattctttcaaaaatagcccaaacaatttattaagtgctaagcctgaagaaaatcagacaattcttttaattaattcagtaaccgtttcaaattataaaagtaataatgataactcttctatttcaactttgaaaagagaaagtataacttctgacaactctaagattaaagttggtagacatgtttacattggccagatggttttgagtactgtctggcaatcatatgatcttctttttaagaatcacgtaatttcaggtgcagctctggttgtgctcaagaaagcaatctcaaaagttttctattcctgtgaggagcttaatttgccaattcattttgcattttcaagcgaatgggattctattagaagtcagctttggatatgtaaggaaaatctattagctgatacaaaagctctctctctttcaagtgagttgcttaatgaatacaatcaaaagaacatttcaagtactttttgtttaccttcttttattaattattatagaaataaggtaaaatcaaaaaatctctttttagatattgaagttcttttttcatttattacagctagagttgatctattagaacatgatttccaggaacttcactcttaccttggcccttctagtattcaacttttccaaaaccaaataattgaggcacaacaatatctcgaattacttttatcttactctcaagaacaatacagcattgctatttctcatatttcagttaacatactctttaatgctctcagagattcaatgaaagtacttgtaaaatctagacttttattagaagaagatgaagagaaacttctagctttgtgtgaagacaggaggtttattttcagttcctctctttctagagaagttattaatgaatatactccagaaaactag

SEQ ID NO: 2275 - DNA, 2781 bp, Cryptosporidium hominis
atgtcaggtttatcagctgtggcagatgtaataatgtctcatgagacaggaggagtgccgatacttgttggatttgtgagtacatgtttgctcggatcggcactcttagaatggatattgtcagtagtatttgttcgtcaacccccaacaacagttgctttgttttgctatgggatgtttctaagttatatatgtgaatcattttcattaggcacattggctgagggagtacgaattgttgagaggacagatccaaacgttatattttatatattactgcctatatttttatatgaatcttcagcaacattaaactttcatgtctttagtagaaatctcccttcagctctacttctagcaggccccggagcaattttaacaatggtattattggcttttgcaattaagttcattacaagtatgaattttgttctatgtttcctagtcagttcggtgctctcagctacagatcctgttgcagttatagcttctcttcaccaacttaatgcgcctgaaaagttagcttctgttgtagatggtgaatcattacttaatgatggtgcagctgtagttttctttgaagttttcagagaagttattatatccggtatgtcatcttatagccactatatctggacatttattagattagctattggaggtcctgctgttggagttgtattcggattccttatttccgtctggttaagagcagctcaggcacttggtggagtccaggtaattggtgttacagcttctgtatactttgtcttttttatagccgatgagctccgtacatctggtgtactcgctactgtagtttttggactatttatgtctgcttggggcccaacatgtttcagaccaaaggctcaggaatcccattttcatttcgttaagatttttgctcacttagcaaaccatctcatttttgttttatcaggagtcgtaagtatgagaatcttcagaccttattggtcagatggaagaatgtggtttaacttagtattggtttatatcgctatgaatattgttagaggaattatggtagcaacattattaccattattgaacaaggttggatcagacttatccttcaaggaggccgtaattcttatttatggaggtttaagaggtggagtttcaatggctttagctatggtttttgaaggagatacttcagtaccaggttctacaagatctcaagtagcattttacgttgcaggagcagtttcattatctcttttagttaatggcactactgtggagacactatataagaagctaaagatctatactgtacaaaactttagaagagcctttttacttaaggttatggaaggaatagatgatgaatatatgaaagcatttgaggagcttaaatgccattggctttttggtaatcatacaaatgctttagatgcagctaatttactagttccaaggcttaaagacggatatcttgatttttatggcgatttgcacatactattaacccctccaccacatgtatttgcaagattgaatgttaagggtattgaatcacaactagaggactactcaaaatatcgtagtatggcagtagatgttgaaaatggtgaagatgaatttaaccacttgaatagtatgggaggtagcataggaagagaaaggtccagatcagctttggttggtgtagatggtttggatattgatgaaaggtgttggaacattattgcaacatccgttaagatggcaaaaagtcagccatctgtggattctagcgcaagaggaagccttcttccttcattagatgatcataataatggactagaacctgatgaaagtgcatctattattagctttaagaataagaggaagccagaaggtaatccaattccagaacttgaaaactcaagctcaggtagcgctgaatgttcagccttgcttggaaatacttcctcgatggttaaagaggagagatcacattctgattctgctcctttggttaaaacagaacaggaagaggagattggacaaaataagagacatacatacgatgatgcaactcaagttaatatttctggaaacttattatgccatgcagaatctgatgaaaataaaggtagaagtcctacatttgctcctttacttatggctacaggatctttacatacttttgcagagcaagagcttttagtctgtaatatggttttcaacacttgctggcaaagctatgacttaatgttccgtaaacacgtaatttctggtacatcgcttttaactttaaagaaggcaataaataaggcaaatcatgcaagccctgaagaaaagactagcccattcacagttgaatgggaatcaattagaagtgatttaagatcaacaaagagacctggtttcttcttcaatatgtggcaatcagattttgaaaagatacttcatgatatggaagttttatttgcttttataaatgctaacaaagatcttatgaaagcaggtggatttgaagtagaatgccttttgggtgcttctttattagattcatacaaaagacgtatgattcaagctaaacaagagctacacagattacgtgaccaattcaccaactactatgttttaggccttgcaataattgcgacaaatatgctccttaatgttaaagagcagattgtttctgttgaagtttctagaggtgtgcttttagaagaagatgaagagaaaattactgatatacttgaacaacaaagattggctcttgatgcattcatctcacaaggtgctgagactcaatcaatttaa

SEQ ID NO: 2276 - DNA, 885 bp, Cryptosporidium hominis
atgtcagttcaatctaatgaattagatcaggaggcacaacaatataatgtctataaggatttggaagaatttgaaaagaagttggcaacagcaagaaaaaggactagggatgctgactatttggatagaaaattagtaatttctgattctacagaatttgaaaggcactttgataatttaagtgaagcaattgcaagattgcttccttatcatacattttatgttgatgagattaaatctaatagagttccagaagatcctgataaaatttcagaaagaaacaagagaattaagaatcttgaagattctattttaaatattagtacaagcagcccttcatttatatttaatacttgtaaatatgggtttgttagggttatccattcttccatctcaatggatttggaaagaaacaagaaggagcttgctcagttacaggctttggaacttacttggaagtatccaatagaaaatagttcaaattttccaaatgacaagagtatgattggtggctcatcagtattaacgggttcaacattaaataactcaaaccatttgagtacgactcattttgaccatagtaatgaactcttataccgaaatatggttcctaagaatcaagttaacaaccaggtctctaacatgattggaaattatagtatgaataagcactattttgacactaatgaaattctaggacgcgaaaaagacaaggatttacttccaaattccgttcctaatagtaaccaaatctctcacaatcctaacttagagagtatttacctaccaaaaattaatggtaacgccaacaaaaatcttgacttatattccctaccacctgatatgctaaagactgagagattttctaatattagcaataactaa

SEQ ID NO: 2277 - DNA, 2079 bp, Cryptosporidium hominis
atgtcaggtattttgtgtatattatattctggaatttatgaggtactggtagaatacttagattatgaagatgtttatgagttagcacttttaagtgtggagtggggtaattacttaggaggtgcttttataagatactggaaaagagcttcaactcatatttttggatttagatttgacttaattcgagtttttgctgataaaatgtttatggataccaaagataaagagtttgagaacatcattcattcacgaaatataaaaagttggtttgaatatttcgagtttttgactacttctgagcttagaacattattaattaatcaaaaaaaaatgaataaagttctacaggatctgctagttaagctaaaggttgagttaaatcctactaattcttatttttcaatccaaaactcatccaattttgaaggaaatattggctttaacaaattcattcaggattatactaagaatatttctgaagctttgacatatccttgcaggcctataaatgagcaaaatttcaaagatcatattaatagtaaagatacaaattctacaggcctcacaagttttaatagaattgagttagatttcggaggattaggcaaggggtatttatgggatatggaaattacttcaataacatctcaaaatatcatcttaaaatcagaatttcagatagaagatataccttactgggatataggccaattaatgatagaatatattgcagtttggggaataatcaatgaagatgatcatttattattatatcatcataaaaatccatttcataaaactgatgatagaattcaccaaaattccaataattatcagactttaatacttgcaaatggtaccaagatttcaaatctaaatggaattaattatttcctatccagtttgagtagttttgctggaattgaaatgagtattaatgaacaattgtctagaattactatttatattactttacaagtagtgttcatcctagaaaatctcaagagtcatttttcatcaaatacaaaaagtttcttatattcaaataagcaaacaagtattcaagactcgaagagatataatattaatgttaattttcaattcaaagaaaatgttcatacatgtagtaatactgttgaatatatagaacaaaattatatgcatttagaagattatcacttatcaacagaaaaatataattcaaaagaagattcagactttaatttgcttgatattgagtgtgagtatgataatgtatcaactcaagaatcattgtttctctctgaagatgaatttgatcctttcgaagggaatctcacaatattaccatcatcattatcattatcagtatcatcttacaaaaaacatcttgaatcaaatccatcaatagaggaacaaacaaaatatcgggtaccttcatttctaagttttaaaccaaaatttatgtattcgataccttttgaatgtaacgaaaataaatattctagatcatattataatattgaactacaattaatggatacaagagcaagtattcctttatatttatatggagatttggaaccatttattgaaagtaaaagcatggactttgttgaattaagagtatattttggacgaaattatccaaattctagttttatcaaaacaaattgcttatatcaagcaggaatatctgttatagacaaaactaatggcgaaatagtatttagtttagttttcccaaaatccaaatcatattatgatagaagagtagtttcttcaaaatctaagagattattgaaattatgttcatattctagagtatatagtactcaagttccagttgtggatcctccttcacaattaactaatatgccagaatcagtatttagtaagcttgagatacttatccatcctcagaagagtactgtaggtaaagtttcagaacttagtatatctttgaatgttaaagaatgtttagctttatttcctattaaaaagtttaaaaggtttctcagattacaaggatttcaatctcaggatcagtataaaagaaagattaattctccaataaaaaatattcacaagtactaa

SEQ ID NO: 2278 - DNA, 468 bp, Cryptosporidium hominis
atgttagcaaaccaaatttccacaattcaaaatgttctgattgaaaatatagatattctattggaaagaggtgaaaagttagatttactggtttctcaagcaaaaaacttgacaatagaatctaatacattcagaagacagtcttatagattacaacaaagtgctgaatggcttcctattaagagaattataatgttatttttagcaggaacgtttatattaagtatttacattatccttgcattcaattgtggaggattatttcttaataactgtattcataaattccaaaataattacattcctgaaccttttattaataataacgatgacgataaattcaacgaaaacgaagcagcttttagagaagtagaggaatttattaatgaattaaacactaaaaaaagtcaaatgaaacttgacaatatacaaaagatccatttgaaagatgatatagatataacttaa

SEQ ID NO: 2279 - DNA, 354 bp, Cryptosporidium hominis
atgcttgaacaattaaaactcaggtggatttcaaagttaaatgatttgtgtttgggtgtaacaaaagatgagaaatctgatcgtaatcaagaatgggtaccaacagaggtggaggttattgctcctaaattggacggggttttgcctgttaaaattgaatcagttccgaaaaaatccgatattagtgaaattagtaataataatattaattatggcaatattaataatcatcacaataatagtattagcgagtttaacagtaatgagatcatagtttgcgacaatcgaattaacaataaaagatttagtgagggatcacttcaaaagtattccaactccaataatatcttctaa

SEQ ID NO: 2280 - DNA, 507 bp, Cryptosporidium hominis
atgaactttgaaaaatcttcgaactcattagaaactatcaactacaatactgaagaaatcaataattccaattcatatagtcaaagttgtaatactatagcagaagaacagttggcaattttagactcaaatctctcaaaatactcggatatatttaaaatccaatcaaaaagtatttctcaatcagaaagtgaacatgaagatatcttccaaaaattgacaaatgatgaaaaaaataaaaagtttcttgaaattaaagtttgggaagaaactaggattgaaaaataccaacattttattagtgctattgatccaatttttactgaactttcaaattctatctctcaagcaatgcaaactaacaaagatttggctacaattctacaacaaaaaaccaagtattggaatagttactcaaagaatctggaactaatttctcaatatggatcaaaaaatgggcatagtaatactcatattcatagttcaagtaatccatgtccatcttga

SEQ ID NO: 2281 - DNA, 798 bp, Cryptosporidium hominis
atgaaaactagtaaaccatgtgatacttggtattttgatcaaatctatagacataatattaataagtttattcaagcccaaacaaaatttttcgaaacaatactattaactattgataatctaatggaacttgaaaattggagagcaacttctgttaaacttacatttaattatttcttggttaaacaaaatgaactttttgaattccttcaaaaacttggaaactctatgattgattatatcaatgatcaaaacaaacaaaactctttatttcaagaccactatgcaaactttgatattattacttcaattcctggtctaagaccacccccaatacctatttctaatgaaaccaatttctcaaaaatttctcaatcgctctcaaaatgtcctattttacaacaaatttcaactctaatgaattataataatcttccaaaatcttcactaattatttatcacgggcatgttgaaatttttaaaagaaaggtcttccttgggcaatggcaatctgcttatataatactcacaaaagataaattcctttatcttcttaatccaagagatgacgttgaaatggaggagcttttaaaacatgatgaaaaacctatctggtctttctttattggatcccaagatatatctatagaacttaatgaaaagagaggaaaaagatgcctcagtatcagatttaaaaaacagaaattctttaccaagaaaatgaccattagatgttcaaatgaagaagagtgtagtaaatggatgaattatcttaattcagtaatccctccttattaa

SEQ ID NO: 2282 - DNA, 2559 bp, Cryptosporidium hominis
atggatattactccatggaggaaattaatcccaaaatacgattatcagaaattgtcgaataatagtgaattttggttgaattatactgcattaaactcagattcttggaaagaaatagactttagtgggaacaatagtaaaatcaacgattataacgttaatctgaaaaataaggtaaaattttcaattgaaggattttggagcttgataactttaataccaaaaatggtattaaataatttgaatactaaggatgagaatacatataatttatgcgcaaatgaaagagatagtgcagaattgatgttaatagatgagcttattaaaaatttgaatatatctagggaagattatatgctacctacattctcattattgaatattcagccatacaattcaacctattgtagtagaccaacaggagcagaactagatattattggtatttgtccttcaaatggcctgaattcagtatatgatcatgaaataaaaagttgtgtttcaattacttatgcagattctgtcgcattttgccctttaagctattcccactcaaagttatggggttcacatagaggtggaggaggctgccatgttaaacaaagaaagtatttgccttcaataccaaaatgtgacgagccattcgtatttaatgaaccaagaaagacttgtgtaatcgaaacttttgcacctggatttccaggatgtgctgaaggaagtgtttactatgacttgcaaacatgtattatggcttatcaagtaatgaaagaatataaatgcccggaaggatatacagcacaattagaagaggatttcttccaaaaggatatttctgatgttgaacacagaaaagaaaaattaaatgaagcaagtgaaaactttaataaatattatgctccgattatccaggaagaaccaataatgacaaggaaagtaaatgattcagaatcgggaatacaaagcaaatcaattacaaaaaaattccaaaactttaaaacaaaaattgaatgctttaaaaaagaaactgatgaggttaagtacaatggtattggtgctccattctgtcaaaatagtacatttagccttaaatatgattataataattcatggatgtttgaaaaaggtccaagaccttattgtgagtacaaagatgttgttgtagtagattataaatgtccaaaagatacggtttcttatgacacttatatttcaaatggtaatgatcctcctatagtataccgacacgaattcattaatccttttgatacttgtatacaagtaatgaaagtgccattacaaccaaagtgtacaacaaaagaagagattccattcatatcattaagagaaccattaaattactttgagaaaactggaattcatattgtaacaaaggaagatatagataatatcgataaagaatctttatataatccaagtgaagtaattgataattctcttgttatcccgaatccatatcctgaatatattcaggatatggattcgggaaatattgatattagtatgttgaatgaaacagaaacaaatttagagaaaaataaaaagattccctcatttggaagtacaaaaaagaatgtaataactgaattcattactttaaatcaagttctaaatattgagccttcatatatcaaaaatgaaacaaataatgagaataattctgaagaagttataaggcgtaaactaatagaagattttgaatcagttaatttaaaaaatcgaaatgtaaagagaaaaaaaaagttaccaatttcaccaataagtttatatcatgcaataattggtaaaacagattatgttgttaaaattatttgtttgaaggttattacggcaaaaccatacctatcttgccctgaaaataccgtattagtagcaactaatacgtgtaaaatgaagggttatacagattttaccattgaatgtccaaaaggctataagttagatgaggaagctttattactcttgccaccagaacattttagaaaagctcccccacgttgtgtttcaaagcagacagtttttactcactactattgtcctccaaaatttccagaaaatgtatttagaccttttgaatataatattactaaattatattcattaatttccgaaaagatgaaaaataacactaatccagaagttcaacaaattgatgaaaaatatcaaaataattcaatattgttggaccgatctcataatgaaattttcataaatggtttgaataatacaataaatcatgaatctgccaaatataatatgaaagataggaatttagaaattaaaaacacaactgaagataacttatatcctaattttgattactttaatactagtaattttaaaattgaaaatattgataaatataacattacaaatacaagaatattttcaatgaaatcatttggaagaactgtggttccttcttattcacaaaaaatgtgtcatgaagtagatttaattaaacctttatggactatgccattgttattaagaatatttttaaataacattaatttagataataaccctcaaaataattaa

SEQ ID NO: 2283 - DNA, 981 bp, Cryptosporidium hominis
atggctttaaacaaggaaataagtttattagacaaatataaggatatatcagattcattaatttcatcagaatgttatgatgaagatcaaatggaaaattctgaggtaaattttgaaccatccagcaaagaatacttggaaattatgaatatttacaatgaattcataaagatggaacaatataaccaagaaaagacgataattaatgacgaaaatgataatgacgaaatagattgtactgagacagataaagacattgaagaaagatatggaaaatgcaggtttcaggtgattaatacaatagaaatggatgatattgttgaactcagacaaaaccaaaatctggaatcaaatttaaaacatgagttaattcaatatgaaataaagaaagaaggaatgaaaaaccatctagattttttaagaggatacctagaaaggttaaaaagatcggattttctgaacttatctttttctatacaagttatagaagggggagcatgtattaatggacttcgtcctgcactatttgaagcagattttgataattggaatgaggtgaatgcagctcttggtgtctctgctatgcttttgtatactattttagaacgtcacaaacttcctttaagtatttacccaagtgggagttactctactattaaagattcagaatcttcaatatggccacttcatggtaatactctctgtaattcagattataacgaatgtactagctttgataaggggatatcatcatttgtatttcttattgatacagtatataatataattccaggaactaatgaaattttaccttattctgttgatcaaagaaatggtacaattggaggtattagtctaaatttgctttttaatgaaagagaatcatggaatagagctatgagtatgaatctaattaacctcaaatggttattagttagatcatctgaaagtattaggaacaaattaaacaatgactcttaa

SEQ ID NO: 2284 - DNA, 1383 bp, Cryptosporidium hominis
atgctaaatttttcgattgataataataaatcaggagataattcaaatatagaagaagagagaaataataatggactaattagcggacaaactatgctacttgctttaactgaacaatatggtgaatataaacaagcaatagataatttggtaaccagtttctgtaaaagttttactataggtgatgaaagaggagatggaagattagatccaggattaggaggctatactgcttctttctatggattaagatggatagaaagtttaagaactttaagatgtgaaaaacttggaaaactttgtagtttaagaggaaccattacaagaacttctgatgtacgacctgaactaattaaagcatgttttgaatgtgaaatatgtggatgtattgtagataatgtggtacaacaatttgtatattctttaccttcagtatgtcctactaaaggatgtggaaatagaacagcttggcaacttagactcgaaaattgtgattttggggattggcaaaaacttagaattcaagaacatgcaactgaaattccaccaggatcaatgccaaggtctatgaatgtgatattaagaggtgattttgttgataaatgtaaaccaggagataaagtaatctttactggaacgttaattgttgcccctgatgttccttctttaatgaagcctggcgaaataccatcaagtgtctataaagacagaagtagaagtcagaatgaatattataattctggaattagtggacttaaatctttaggagtaagagatttagcttatcgtctctgtttccttgcatgtcatattgaagttgttaatgctattgcatcagctgatgatggacgtattattgaacaaattaatcatcaacataatcaaggtgcccaaggtatcgtaaataataatgaattaaataatagtgaaattgaagtaaatcaagaattggaagcaaatacaggtggtattattgaccatttgaaagatttaaatgtacaagaaacttcatttagaaagtttttggaaatttctcaacatccaaatggaattaatatgcttgctaaatatgttgcaccacatgtatatggttactcgcagttaaagaagggaatattgcttttattagttggtggagtagagaagagaactaaagataatattaagttgagaggagacattaatgtttgtattgttggagatccatccactgcaaagagtcaaattttaagatttgttaatgaattttctaccagaactgtatatacatcaggaaaaagctcaactgctgctggtttaacagcatctattcatagggatcctgatcagggtgattttgtaatagaagctggagctttgatgcttgctgataagggtatttga

SEQ ID NO: 2285 - DNA, 267 bp, Cryptosporidium hominis
atgaaggatttgataagaatgaattcatccagaattaaagcaataggtgaatttggattggattctgatagattacatttttcaagtatgaaaattcaagaaaaatactttgaaaaacaatttgaattgcttgaggaattttgtttaccaatgtttcttcatattagaggtgaccaagattgttattcaaaatttgttagaataattaacgaaaaaaaaagtctttggattaaaaagaggtggagtggcacattcatttactggtaa

SEQ ID NO: 2286 - DNA, 147 bp, Cryptosporidium hominis
atggttaaaaaataccattctctttatattcaaaatctcaaaagaatttatgctcaatattcaccattctaccaatctttttttaatgatcatcctttacttgaaagatatattcaaaaaaagtcaaaagaacttattatcgagtag

SEQ ID NO: 2287 - DNA, 273 bp, Cryptosporidium hominis
atgatgataacaggaacagttcgcataagaagtaggacacaaggtattgctttatctttaggtgatcacatagtttctcttcaaagaaagataccaaatgatgaagatataataagatcttgtggtaatattacaagtgataataataataatgagaacagaaagactaccagtatatcaatgaatgcaataaagaagaaaggaattgaagatgagtatggctatggaagacattctcgtttattgaatatagattttggtgatatttattga

SEQ ID NO: 2288 - DNA, 751 bp, Cryptosporidium hominis
atgttcgagtatgaaaaaaattgtacattattagtaccagcaattgttggttcaaatgcaccatcaagttcagaattacaaaaaagattggaagatccaagtgataatgaaaaatgtaaagctttaagagaattaattatatggatgactcatggtgaatcttataatcgattgttaatgactgttataagatatgtagtacaatgtacgaatcataaagtaaaaaagtacttacaactttattgggaaattgtagaaaaatgtaatagtgacggatcacttaaagaagaaatgattcttgtttgtaatgcattaagaaatgatttacaacatcctaatgaatatattagaggatcaactttacgcctattatgtaatttaagattcattaaattgattcaaccattaatagaatctatcttggagaatcttcaacatagacattcttatgtaagaagaaatgctgtcatgtgtatatattctattatcaaaacatttggagttgatattattcctaatgctgttgatgaagttgaaaaattgttattaatagaaggagatatatcaacaaaaagaaatgcttttcttgttttaacacattgtgatgttgaaagatcattaagatatatattatccattcaagaaaatgttacttatatgggagatgttattcaaatggtattattggaattattaggaaagaattataaggatcatccaaattatagaaataatcttgttcagcttatta

SEQ ID NO: 2289 - DNA, 1146 bp, Cryptosporidium hominis
atggaaataaaattgagtgaattaaatataagtcaattattattatttgatgatactaaaaagaaaattagaaatcaggtttatttaaataatataataaaatatatgaatttggagaaaatgggaacaaatttgatgaatttaagaatattatcatttcatagtaaccatttaaatgatgaaaatgcattattaattatgaagaattttcttaataatattatattaaataataaaaatggattaaatttgtccaagtataaaatttattttgatttttctaataattttattaagagcaatttcttgaataatattgagaaatttatattggaattagttaatgatagtttatttgaattggaaatcaatttgacaggaaatccaatcaatgaattttttattttaaataaatcatttccagagaatattcatattatttttgattattcacttcctttaacattttcagatgatttaataaataacttgtatggtggttttaatggtaattatgatgaagaagaagatgaagaagaagatgaagatgaagaagaagaagaagaagaagatgaaaatgataataaaaataatcataatttaataattccagtaaattcatattctaaagaaaaagatgagtctcaattagtaaatattaattctcaaatctcaaatgactctttttttgataagaatacttctctaaatagtattagtaatccattagatgatgattccttgtatgattctgatgatgatgaggattatgaagctgaggatgacgatgatgatgacgatgatgatgatgacgatgatgatgatgacgatgacgatgacgatgacgatgacgatgataatgatgatgataacgatgatgaagaagaaaaaaaagaagaagaaagagatgatgaagagttggaatttgattcaagaaaagattataatcaagatattaaagctgatgaaggaaaaaaacatgaaaattgtatcaaaaataaagaacaggaattgaaaatcagaaatcaacgtaaaaaaaaagaaaaaacattagtcgtacaagaagaaaatgtcatagaatcattaatatctgaaactaaatcaaatcatttgaattttaaaaaaaatcaagaaaaatggagttga

SEQ ID NO: 2290 - DNA, 585 bp, Cryptosporidium hominis
  misc_feature (13)..(13): n is a, c, g, or t
  misc_feature (34)..(34): n is a, c, g, or t
atgtatataacanaaccaattaattggccagtanaatcaacaatatataaatggttaagagcttattggtttgatgatgcatcattaatatctccaataagattatgtacaacattatttatggataaaacatataaagatgaaaaacattcaatgtcaacttctgcaagatttgttcaacttggtttctttggtgcattaagatttggttcaaataggattgatatatattcaccttcaaatggttatcaaatattatcattaagaaaagtaggtattaatttaccaccatatgttccatttagtttaggatcagtagtaataccagaaagtgattcttataaaatcaatacaaatatacaacaatcatattataatcagaataatcaaggtggatattacgttgatgattataataattattatggaaatcctaattatgagtatgataataataataataactattataataatgaacaaattatatttaatggaatgggtttagttcagaatattacagagaatattaataatacaagaacaaaagttaataacaattcaacaaaaattattaaaaaagaa

SEQ ID NO: 2291 - DNA, 893 bp, Cryptosporidium hominis
atgtttgaaaattcaatattaaatgatgggattaatgagagttgtaatgagataggtaaaaatgaattaaattatggtagtccttttggtgatttattagtattgaatgagttttcagattcaaaaatatattcttattcactttctaagccaatatttattaaagttccaataataatttcaaattattttcttcaagaaagttctcagattttatttattgagattttaaatattggtgaaatttcagattcaatattgatttatgatatattcagtcataatttgaaactaaatggtaatagcccacttgaacttccttttacattaggtaataatcagtcattaggatgttcattaattagagtaggtgggaaaaaagtctataaatcaaataaaaatattgatgaaaagaatgaaaatgattcatttatacccattattattccaatttttatcaaatggaaatcaaaacaatttaattcaaaattaattcttactcaatttgctcttcaaatcaattttgatcagagagttgatattataaattcaagagaagagaaccaaatcaattcaattaatgttaataaacatgaaaacagtaatgatcatgataatatcaattcttcatctttctcatcatcttcctcctcttcatcatcatcttctgcagtttcttcttatttatttagtccaagttcaccacaagcttctgttcaatcaatttgctctccattcactcaagaagtctgttactcttcaaaatctaatcttgaagaaaattcaagtaattgtaataacaacttggaagtttatagcaataatgatagtataatacaaaaaaatgagaatgatttggaaatagaatcaaactataactttaaagcaacatg

SEQ ID NO: 2292 - DNA, 252 bp, Cryptosporidium hominis
atggggaatttggatggatgggagttatgcagggaaaaggtggaaaaaagacgaaggatcgatttgggtaataagggatgcggagggatgagtgagggttggagtaagatgtggacagaaggcatgaaggagagaagaagtatttcccagaacctaactcttcatcatattcacaaaatatttatgaaaatccaactttattatatccacttaaaatttgtaatcctggtatttataaatgtccaaatataa

SEQ ID NO: 2293 - DNA, 87 bp, Cryptosporidium hominis
ctatttacgatttttccacaaaatctaattatacgattaaaaaattacctttacttgtttgcgaatctctaccaaactgtaacagtt

SEQ ID NO: 2294 - DNA, 153 bp, Cryptosporidium hominis
ttcaactattgttcaaaatcccaaactgtatcaaatatagttgttgctgctaatggtgaagtatttactggagattctggtggtaagtatttttttgttttatttttttgtaataaaaaattatatatattaaatatatttatttgtttatag

SEQ ID NO: 2295 - DNA, 429 bp, Cryptosporidium hominis
atgttaagccattggtgtgtatgcgaaccagaatatttagatccaaaatgtacaaaaaattgggagaaaacaagtattgctttagtaccaggtggaagaccatcacatgcattattaatatgtaagagaatttgccattttgattctagactttcaaaattatatagatcaatgtatatacaaaattatagagttggattaaaaatattaaaaaagagagcagcattaaataatgaagaaaaaatgaatcaattagataataaagatgataataatacaaataaaagtaataattcaaatgaaaaagataattttaatgattcaagtaataaagctcacaataatattgaaaatgatgataatagtcacttaaatgagagtaataacactaatgaaaatgataataaaattgatagaataagtgattaa

SEQ ID NO: 2296 - DNA, 741 bp, Cryptosporidium hominis
atggaattattgaaaaagaaaaatcaaaaagaaaaaatgttcctattgatcaagctgatatcaaagatatattattatgatactcaattaaaagaaaagttacaagaaaataataataataaaattgataatcaagagaatgatcaagataaacttgaagttgataataataataataataataataatagtgatagagataaaactgatagtgataatagtgaaagtgatgatagtgaaagcgatgatagtgaaagtgattatagtgaaagtgatgaaaaagaagaaaaatcagaaaatgaagcttaccttaaaaaaagggaaaatttgagagatgctttaacaaatcgtagtaataatacaaaaaaacaggaaaaaaataaaaatggaactgatagttcgtattttaatagaatgttaaatatgttactaaatgctggtgcagaaattgatgatgatgatgaaaagattattaaggaagaaagaagagaggaacaaaatttgggtagattgagaatgccaaaaacagttaacaagtttggtaatttagataataataataattatacagaaagtttagaagaatactatgaaaagaaaagaaacttgagaattaatttaagaagtaaaatattaaaagaatataaggatgaaaaagaatattcattagagttattttataataatcctgttatgttacaatcttttattacaaaaatggattatcaaattagtgaataa

SEQ ID NO: 2297 - DNA, 597 bp, Cryptosporidium hominis
atgaaaaattattatgaaataaataataaaataccaagaaggtatagcttatcaaatagtgaaaaaactacattgggaaaaagtttattacgatatatccaagtttcacattattttgagaagccgacagtaaccatacttaatgaaaatgtaagaaatgatttaattaataaacaaaaggaggagatagaaaaaacggatttagagcaatcagcaaagaacaatgaaaagaaattatggagagatattaactataagttagaagaatgtattgatgaaagggtaaatcttcgtaatattgataaacaaaagaactggttaaaaaaaatggttggtgaagatcttccagaaattaaaacaaaaattgaaagaaaaataagctttggtaaaaataatcatgaaaatgcaaatcaatatatggatggagaaaatagtgatatggaagaaaataacgagcaaattagagaaaaaaatgatattgaaatacgaaatattcatataaaatcagaaaaagggtttccttttttaaattttcaatataataatattgaagaaacagtaataaaatggaatcctccatcaattaatagtgtttaa

SEQ ID NO: 2298 - DNA, 984 bp, Cryptosporidium hominis
atgagtgggaataatttggaagataatatttcaaagaataataatggaacaaagaatgaagattatgatgagaatgataatgaagatgatgatgaagatataacttttttaatttgcggaggaaatgaagaaggaggattgaaagatttttcaaaattgaatgataagataagttcaacaggtggtgataatgaagtagacaattcaattaatccggcttcagatgttttgaagaaaggaatgacggattgcaaacctggaaatacaggagcaagtaatagtaactcttcaaatataaataatcaaaaaatgaacacaggagaccaaaatttacatgctttaaatgtttctaatacaatatatattgacaatgaagatacagccacagaagaaaatccatgtaaaaatcttcaaatggtttgggataataacccagagttaaggccttggagtagattactggatgtttcaccttggtttaattatggctttacagaaaaaacatttaaagaatatattattagacaattaggtattagatgggaacgtattaagaaacaaaacattgaaacaagtgatgatttactaaacaagagtacaataacatctggtatttctaactcaaataatgtgaatgcaaatttaaatattaataattcaagtactggtttaccaaatccaaatattaagatgatgaataatttaccaccgccaccacctataacagggttcccatcaaatatgatttatttcccacctccacccccaccacacttaaatccaccaattccaggtcatccaaatatgtatcatcaacagcacatgttcaacaactttcctcatcacatccctcatcattcgcacattccacctccaataccttctcatcaaattatgcaccaccctggattaccgccaaataatatgaatccgggcgccaacaccgcatttaatgcaaggagcaaaaaaagacctgcagagtaa

SEQ ID NO: 2299 - DNA, 792 bp, Cryptosporidium hominis
atggattcagttaaccaaattggattggatgaatcatttaacaatgaattaaaggatactaagatggcaaataatccaaatttatcaagaagtgatattatctcaggaccaacaaatacaggagctaataataataataacaataataatattggcgcctccaattcttcttcatcttcatctggactttctggaacacccagtgctattggaactaatctttttgatttaagtgataacaaatctttgaatgatgaatcaaataaaaatgttggagaaagtatgatggatactgatttaccaggatcagctgatgatgaggaaatgaaaagatcaatatatattggaaatgttgattatggtactaaattaacagaattacaagatttatttaaaagttgtggaagtattaacagaattacaataatgaatgataaaagaacaggaatgccaaaaggatttgcttacttggaattttgtgaacctgaagctgtcgaaactgctttaaaatttgatggagctatgtttagaggtagacaaattaaggtttcaacaaaaagaaagaacataccaggatataatagaggaagaggaatgggaccaggtggtggatttagaggaggtatgggaagaggtggatttagagggggttactctagaggaggaatgatgtctggaggtcatggacctaatatgcgtggttattatggtaatccttataaatcttataggggaggaggaggtggagttggaggttattcaggtaatagacatattgtgaatccttattga

SEQ ID NO: 2300 - DNA, 156 bp, Cryptosporidium hominis
atgaaaataaagatattctttttaattcaaatattgttattaattgcgtatgtaaaaggagatataagaagaaatgaattgaatcgaaagaatgaatatatattattaaataataatgcgcctcaagttcctattgtaaccgagacaaaaactcca

SEQ ID NO: 2301 - DNA, 936 bp, Cryptosporidium hominis
atgattggtgagattcctaaaggagaagaattattatatgaattgaatacacttaatagaagtagtaataataatgataataataatggtaaccaaacaaatggaataagtgaattacttggaaattatgttagttctgaaatcaatctattaaataatgatacttataaaaaaataggatatggtacattaattgataatgatttaaatattgcatctgaaaaaagtgcaaatattaatacaggattctttgaaagatttaattgtcatggagctaaaattcttgaatttacaactggtaataatgcagtatttaatagacaaagtgaaatggattttgaatattcacaagattatttacaaactaaacaacattcaagcaatgcaaatagtaatagtcaacttttggatattaatcctgttaattttttttcatcatctagaaataaattagatgtcaatatgaaaaaagaagaaggagataataataataataataataataataataataatactcgaagagttaaattcaattttaataaaacaaataaaaataagaatgaccatgattctttatttaataatccaatttccaggaatgtattattaaactgtacaaaacaaatacaacatgaacagattaatcaacttggattgtttaataaaaacaatctaatacaaaaaaaaagtaatgaaattgattctaaaaatcaaattttttttgaattacaaaataatcaatctgataataatatcgatcaaattaaagaagaaaagcctatttggttgcaacaaatacaacaagaacatatacaagctattgaattattaaagtatttttggggattatcattatctccaaaagataatgatgaaagaagaaaaactattgaatcattaaataaaattactcataatattgaattacttgta

SEQ ID NO: 2302 - DNA, 210 bp, Cryptosporidium hominis
atggaaaaattagaatattctttaaaagaagatgatattttatccaaatttttaaatgttatatttaaaaaagaatcaggtattttatatgtaacaagaaataatataatatggatttctgataaaattaaaggccaaccatttgaaagtattagtattttaaaagaaaggttattcaaaaattatttcagaaacctgataataatttaa

SEQ ID NO: 2303 - DNA, 165 bp, Cryptosporidium hominis
  misc_feature (77)..(77): n is a, c, g, or t
atggattttctggaatgcttaaatattttttatcttttaatattatatataattcaaggtcttcctatgggcattanttattccattccatttcttttacaaggtagaatatcattatcagaacagagtatgtttggaatggctgtacttccttttctcacttaa

SEQ ID NO: 2304 - DNA, 537 bp, Cryptosporidium hominis
atgaagaatgtgtttgataatgaaaaaaaagttattttatcagaatcaaataataaaaaagattctgatactagtttgaatgataatataactaatttatttaaagatgaagaaaatgaaaataaaaatagtattgatgaatttgttcaaagtgaagatggtaagtgtaaaccaacaaaaagaagaaaaacaagtaaatctaaaataagtaatgataataatgacaatgaaaacaagatagattttgatccattggaagttgaaccaattatgcatagtaaagtaaagaaagagaaaatgtataaggatgctaagacaggttatttgattgttgaagatgatgtagattttgtaatggaaaaggaaaatagaatcacaaaatcaagagaaaaagtttctcaagaaagtgaaattccatcaaagagatcaaacaaaacaaaaaaatctcaaacctccaatattaattctggtataagtaaacaacaaacattaaattccttttttaaaatagtaaaatcaacaaacaaaaatacttga

SEQ ID NO: 2305 - DNA, 993 bp, Cryptosporidium hominis
atgcatgatcattctttcccgcataatagagaccatcatcatcaccatcataaggatcctggatgtgttggtgtgagtaatagtgatgtttattccatagttaatggtgaaaagaaaagtcattatcatcatcatcatcatcatcatcatcatcgtaatgataataataataataataataataataataataataatagcaataataatagcaatagtaatagtttcagctttacttgtccttcagaagttaattcagattcaaatattattattccaattaattcacaaacatgcgaatctaataattataataatatgcattatgaagaatctgattctaaaaaccttggaatcaagtctcctttaatagaatcttcagaattatataatgaaaagtctaatatgattaataatcaacatcgtaatatttcaacttcacaagtctctttaaaacaagaatctaatattcaaaaatcaaaaactaattcaacattaaatgtatactttctcgtttctgcactttcagttcatgccatttttgaaggaatgcttgttggaatttctaagaatcatatttcagttttaacaattactttagttattattgcacataaatgggttgaaggaattgctgtttctgctggaatcaaaaaacatactgaaatttccaaaactacggttaatcaattattaatatcttttatacttatgtcaccattaggtattattattggacaattattctcatatattaatagtcctttgataaatgtagttctaacatgcatatcatctggcgccctattatatgttgctcttggagaaatgatacttgatgaatttaattgtggtgagaatagaaaacaaaagtttattcttttccttcttggaattttacttgtttccattattaatattattcaacataaacttggaggatgtacactacatcatcaccatcacagtcattcacatattcatacgcattaa

SEQ ID NO: 2306 - DNA, 507 bp, Cryptosporidium hominis
  misc_feature (466)..(466): n is a, c, g, or t
  misc_feature (481)..(481): n is a, c, g, or t
  misc_feature (501)..(502): n is a, c, g, or t
atggagcataaatgtaattctatgaatatgcatagttctcaagattcaataaaattatcaacaggagggagtagagagaaattgacagattcaataacaggattacaaaataattcatcttcatcttcatcttcatcaacaaactcatcatttgattttttaataagtaaatcaaattctattattttatcagaatctccatcattatcgtcaagtatagtacctattttaaaaaaatcagatttctgtgatttcaaaaaggtatcactattaccgttattatttggtgaaacaacttgcaatcaacagttaacaaatcataatttacatgatttatttgatgaattaaaacaaatagaaagatctggaagtaatttatcatatttaagtaatacttacaataatagtgtatcctccaggggaagtagtagttttgcacccgtacaaaatcattctctctcaagtnttgccagaaggttcncgtctctctcctcctcccgnncctaa

SEQ ID NO: 2307 - DNA, 675 bp, Cryptosporidium hominis
atgaaattactaagtgtattactttataagtgggataaagaacatccaatattattaacaagtaattataatttacaagattataatttctttcaaagaaaaacaatacaagaacatatagcttttcacagtagattattatgttcgagagtacaacaaggaaatagagttacagtaacttttccacaagatattggacattgtcatatatatatatcaaataatggtttaggtatatgttgtattacaagtccagattatcctgtaagatgtgctttttcattattaaatgaatatttaaaaacatatatagattcttctaaaaatcatgatgcattattttcttcagattttactactactaataataataataataataataataacaatagtattgctagtaatattattactaaagatcaaaacgaatcaattcctgaatgtgatgaaatttttaaaagatatcaagatccacttaataatgataaaatttttaaagtacaaaaagatttagatgaagttagagatgttatgcttaaaaatattgaagatttacttcatcgtggtgaaactttggatactttaatgcaaaaaagttctgatttgagtgctgcttcttatcaattttatagaagtgctaaaaaaaacaatcaatgttgtcaattgtattga

SEQ ID NO: 2308 - DNA, 1575 bp, Cryptosporidium hominis
atgaaagaaatacttaaaaagaatattcaaggtaatgttcaatttaccagttcaagatggaaaaatatttcatcttctgttaaagatcttataaaatggatgatgacaaaagatccagaatctagatgtacagcagctcaagcaatatatcatccttggtttgaaaagatacaactttcacctggaataatgatctcatgtaataataataataataataacattattattaataagaataataatctcttaaaaaatcaattaatggatcaatcttcatcatcatcttcctcttcctctgataataataatgataataattctctatcactttctgataataattcttcattatcttctaataataattattcttccccaaataatcttcaatcaaaattatcaaattcaccacaaataaataatgatcaaataattttaccaaatagaaatattaatattacattaaattctgcgtcagttttaccccaaaatcaacatttacatcatcaacagaatgatcataaattaatcccacaagatgaatatacaacatgtgtaacaaatttacctaaaaattcattaaataagaaatgtattaataattatattaatagtaaattttattcatcccattcaacaaataatccaaataataaatcatccatttcaatttcttcacttgaatatacagattcacaattttcttcttccattaattctatgaaaatttctccaagatctgcaattataccatcttctaatcaatcaaataaaaagaattattcaataaatccaaatggtaatggaaataataataaacttggaaataatattagtaagaattcaagccaaattccaagttattgtaatagtagtaataataatagtattagtgaaaaattgactgaagttgatgatgaagaagaacataaaataatccaaaagaataatattaagaataataataaagtaagtaaccattttgaattagaagaaagtattagtaaacttgaagaaaaagaaaccaattgttatgattcttccaatattcataataatagtgaatttgaagataatgatgatttatttaaattagtaaaagaaagaaataattgtcataattcttcaaaattaaataaagatgttagtaattattattctggtaaattaaatcatacaaaattaaatagtcatgatcccattaaacaatcagtatctttattagaaagaattggaaacaaagattatcatcataattttaattccatttattatgctactactgtgaatgaagataatttttcttcacttgaaggacaaatacctgttattggaaatatgattacaagtagtagctgtttgaatcatagtaataataattccagcagtattaataatagtcaaagcaaatcttccaataataataaaagttctcataagaccaatagaagtagctctatcaaggctgtattacagaatgtattcagtagattctcaagtaatagtaacaataataataatattaaccaatcagcaccattgaatattgcaaaaaaatatgagattaattaa

SEQ ID NO: 2309 - DNA, 1806 bp, Cryptosporidium hominis
atgaaaagttacgaatatattcgtgataaccagataataaagctatatgttcaagtattgaatgagatactgaatttactgtcagaatcaacagaattattaatatataaagaaaaaaaagtcaaattttatttggatcctattatggattttgatattaatttatataatcaaacaaatttagtatattcaataacatccgaaaaacaagggattaatatgatttatggaatgggaggttcttattcagatataattaatggtattacaagatcttattgtctaaatagtggtaataataataataataataataataataataataataataataataataataatatgaatatgaatatgaataatagcaataataataataataacaatagtaatatcagcaataatataggaggattgggtataggtagatttcagaattttttatattgtattatgggagaaatttctatagaattgattattaatcaagtttgtgagaaagcaaaaaagtatagatccgagtttgtgaatactggaggatatattaatggtatttcagtaaatgatatttcaatgatgaataatggtgtgtttaatttaggtatttcatcaagtgaaaaaaattttggtatgacaagaagaagttcatgggggggatttaatacaaataataataataataataataatgataataatagaaaggaaaaaaatgtgagtattacaaattttagtaataattatcaaaatgacccaggaaatttaggagttaatacattttcattgggaaatcttaaagtaagtgaatatgaagaaatgacagatttaacaaaggaattaattttaaaaccaatttctttattaaagtcatgttatccaaaggtgatagtaatgacacaaacagcaagattacagccaaaagttttaagtttaacaagaagattatggcagaaaggtataagaagtgaatatagattaactcctgtgcgttctttagccatttttttggaaaagttaaagaaagatactttggttgaattgctgatagttgttatgtttcaaaatagtaatattaattcagcatcaggaataactgggatagctggagcaacaggaaccggagcaatggcaacaggaacaacaggaacaggaatagaaacaggagctacagtaggaggagcagtgatttctaataattctcttcaaatggatgagaatccaaatttgatttataatagtgcaaatatcggaaatcaagagctatataccagtggtactggccatcatggaggagggatttccactgtttcatcttcattagaaggagtaaataatacaggaactgtaataggaactggaacagccatatcaaggccaggaactatttctggatcagtagcaggaacgggaaatgtatcagctttagcatcaggatcagcatcaggaccaagttcagtatcattatcaggaccagcatcaggatcagcgttagtaataggagcaggaattggatcaggaactttaacaggatcaacaacaggttcaggctcaggttcagtttcaaattcaatttcaggttcaggttcaggttcaggttcagggcaaatacttgggccaggatcgggaacttcgaatttttctgatggcatcaaaaataagaatgtgatatttagaatagagccaataagcggattttattatgaaactggtggattgcatagtgttaaagtaattttggataatgaagaaaatgtggtaaattacgtattaacaaagagaaagaggcaaataattaattaa

SEQ ID NO: 2310 - DNA, 783 bp, Cryptosporidium hominis
atgaaacaagatatcaattatggaaggttaaataatattcctgaaagtatttcaaaaagaaatacaaaagtaacaactccagtatatgattataattcaaataaatatagaaaaacagagaatattatagaagaaagtaatagagaaataaactattatcctattggatcacaattaagagcaaaagaattaggaaatattaataagatagaaaataaatacaaggaaaaaagacaaaaaagtatatataaagtcccaatttctgttgaagtgtgtattagatcagatattaacttaattcaaaatgagggtgattcaaatgaatcacagttgagcagaaaatatttaatacagagaattaaaaaatatttttcattacaagcaaatgttgaattaggaaaagccgatattgatcaaattggtgattcattattgagaaaagtatgtactgatataaatctatctttaaactacccaatccagtcatttgaagaaaaatataataataatagccaatcaaatcctcttagtcaaagagaagataatgaaaatatcccaatttaccaagccgacttcaatatatatatttatcaacttaatgaaaagtctgaagaagaatattatatggaaagtaatacatcagatgaaaaaaatacagatcctccaatttggaagtattggtcacttccaaatatagaatttcatggattatgggatgtacttcactatgaaaataatttaaagcaacaacttatagattatacatctacaagctataggtga

SEQ ID NO: 2311 - DNA, 450 bp, Cryptosporidium hominis
atgacaaccactaatattccagattcaattgatgaagcatttttagacagagctgatttaaagcttcatatacctcttccttcaatctataccagatataccattttacttgaatgcattgaagaacttatattcaaacaaatcgtttattcaaaaaatagtgattttattaaaattttaagctttaaagaaataatgaaatattcaaatcatacaggaaataatcaaattgaaaatccaaataactatgatcaaccccaaattaatatttctaaaagtctactatatatatcaaaagtttctgaaggtttttctggaagaaatttaagaaagcttccattcgtttccttactttcttcatatcatcatggtatccctctagatattcaagtttttctcgaaaaaatgaagtatattgttgatgaaaaacccgaaatggtgaaaagctaa

SEQ ID NO: 2312 - DNA, 2970 bp, Cryptosporidium hominis
atgagttcagaaacaaataaaatatggacaggagatgaggttcgaagacaattcgtgaaatactttgagggattggatcatacattctacagatcttcaccggtaattcctttgaatgatccaacaatattgtttattaatgctggaatgaatcaatttaagtccatattcttaggaactgttgaaccaaattctgaactaagcaaattggttagagttgcaaattctcaaaaatgtattagagctggtggaaaacataacgatttagatgatgtaggtaaagatgtatatcatcatacattctttgaaatgttaggatcatggtcatttggagattattttaaagaagaagcaattgaatgggcatttaaacttttgactcaagtatatggaattccaaaagatagattatatgcaacttattttggaggagatcctaaattaccatcatgcccacctgatgaagaggctaaaaaaatatggttgaaatacttgccagaagatagaattctatcttgcggtagcaaagaaaacttctgggaaatggctgataccggtccatgtggcccatgttctgaaatacattatgatcgaattggaggaagagatgcatcatcattagttaataaggatgatcccgacgttattgaaatatggaatcttgtatttatgcaatattatagagaagttgatagtacattaacacctttacctaaaaaatgtgtagatactggtatgggattagaaagattggtttcaatcctacaaaataaaacaagtaattatgatattgatttgtttaaacccatttttgatcaaatttatcaagtaatttcctcatctggagtacaaattccacgttattctggaaaagttggtgatattgatgatcctgaaatgattgatatgtcatacagagttatttctgaccatattagaactttaactattgcaattgcagacggttgtattccaagtaatgaaggaagaggatatgttttaagaagaattctaagaagagctattaggtatggatctcagtatttaaaggctggatctaatggagagccttggttttataaattagttgacagtgtttcaaatattatgggtaattattataaagagataccagaaaatattcaaattattaaagaagttattttagatgaagaaaaacagttctctaaaacattgtttaaaggaactgaaagatttaacaaggttattaataagttaaagtcttctcaaaacaatcaacaagaccagaataaaaaactattcccagctagtgaagctttccaattatattctacatatggattcccaatggacttaacagaattaatggctaatgaacaaggctttgattttgaccgtcagggatttcaattatgtatggaaaaccatcatttagcctcagaaggtaaaaataataagtcatttgacgatttaattctcaaacctgatattcaaaataacttaattgtagaatttggattaaaagaaactgatgatcaatacaaatatcaaactcaaattaaagacttttactctaatttgattgctatttttgatggaaatcaattaatagacgctactgaaatacaaggtaaagttattggattaatttttgataaaaccacattttattcagaatctggaggacaagttgctgatactggttttattgattttcaatacaataacaatgatgaaaccagtaaattccaagtaattgattgtaaaaaatttggaaattatgtattacatattggtatattattgcaaggaaaaattgaaattagtccagaattaaaatccttaatgtctgttgattattctagaagaaatcttattaaaaagaatcatactggtactcatatcttaaattttgcattaagacaaatacttggtagcacatgcgatcaaagaggttctgttgttgatcctaatagattgagatttgatttctcatctcaaaagccgttaactttggatcaaattgaggaaattgaaaaaatggttagtcaaattattcaagaaaaacaaacagtttattgtcagactgttgaattatctatagctaagcaaatacccaacattagagcaatctttggtgaaacttatccagatcctgtacgtgtattatctgtaagtaaatctgtggattctttaattaattctcaaacagataataatgatcaagaaaaagtatctattgaattttgtggaggtacccatgttgaaaatactagtgaaattatttcattttctattataagtgaagaaggtattgcaaaaggtattagaagaattgtagcagttactgataatcaatctgaaattgctattgaaaatgctaaaaggcttaaacaagaatttaaaaaacttgaagaattaaatggcaaagaacttgagactttattaaattctttcaaatccaaattagatgaaactaaattattacctttattatatagaagacaattatctcaaattattgaagaacattataagagagttattgcagatgctaaaaagaaacaaaaagaaagattaaatatggctaaagaattggcaacaaaaattggacaagaatattctcaacagttatcttcaaataatgaatttccagctttaattttgaacattaaacaaattcaaggagattctaagtctatggatgttatcggacaagatatttcaaagaaataccctgaagctcccattatgctttttacatcaggagaatttaatgataatggagtttctgttatttctattatgccaaaatctaaatctgataaattatcttcatctaactggcttaaatctacaattgagttatgtaatggtaaatgtggaggaacagacttaagatctgttggatcttcaaagacaggatctgaatcaattgaatcaatgattcaacttgctttagaccttttaaagcaaaatggtatttaa

SEQ ID NO: 2313 - DNA, 420 bp, Cryptosporidium hominis
atgaagagaggaagaggtgctgcaggtggtgctaagatgagaattaccctcggtttgaatgttggtgctcttataaattgttgtgataatagtggtggtaaaaacttatacatcatagcagttaaaggtaccggatcatgcttaaaccgtctaccatcagcatctattggtgatatggtgttggcaactgttaagaagggtaaaccagaattgagaaagaaggtatggccagctgttattgtacgtcaacgtaaagcttttagaagacctgagggtaccttcctttactttgaggataatgcaggtgtaattgttaatccaaagggagaaatgaaaggttctgctattactggtccagttggtaaggaatgcgcagaattgtggccaaaggtctctgctgctgctccttctattgtttaa

SEQ ID NO: 2314 - DNA, 1245 bp, Cryptosporidium hominis
atgaacaaacatttacaatctatcattgattcttggaaagatgcatctagtgaccttgacatttcatcatataatttgaaattaagtgacgaaattgtaaaagataataataagttgaaattagattcggttggtaatgattcatcgataatctcgagctttgataactctaataatgatgataataataataacaaaattcgtattttagccccaaaaagaagaagaaatgttgatagaatatcaaatatcaaagacgacgtattaccagaaataaaggaaggagaagtaactcttgattccaatggaaattctgatccaattttgaatagaaacacaaaacttggtggaagattgtcaagtatgctaagcattgacagtaacaatacagcttttgcaaataatattccagaatggagaattcattttagacaaattttgggtggtactgaaccttttagaattactcatgaaatgagcaagattgaagttagatcaagagtaatattaactgatggtttggagcttaagaatgaaatatcatcattattaccattattgaattgttcaaatccaaaaacaattatattagtttctgattgtaaggactctaaagaggagaatattttaaaatattataaatctatattaatgtcacttccaaattctccaaagaatattgtttcttcgaaaattgatgataacaatttgattgaatttactttagatgaaagtgttgaaattgtttcatttgataactcagtatgggatgaagtttcaacaggaggttttcagcttgtacaaaatggttcagctccttcagctgctttacaagagtcttcatcaaataacaataaaaaaaacgaaatttcaagttattacgcttttgcaagagttgacaatatttcggcaaagcttcttaaggatgaagtagtttttgttaagaataataaattggaaaataattcagaacttaattccaacgaagaaaaaacgactgataattgtgattcattaaataataatattatggatgaatgcaaagatcctcagaatgaatcattaattaacaagaatcaacaatctccatacaatgttttaaataaccttattaatataattaagaaaagaggtaataataattcttcaaagaaattccataaagaaatattactttcaaaatcacgtggtatacgccatatagtttttgaaatgagaaaacaaaaaccctcttccaattattaa

SEQ ID NO: 2315 - DNA, 1276 bp, Cryptosporidium hominis
atgggaaatgaaaatgaagaaaatattatgaataaaaaaataatcatttcaggattagttacagatgatactacattctttataagaccaaagtctgtaagaattatatttattgtgattatttcaaaagaatttttttgtttttccagtaatggttttccatggtggagaggaattatttcatttttcaaagaatatttaacatcaaataaacaatctatagagcatcattatatcacaatacttttaacatggaaagttaaagaagaaacaaaaactatggattattatcaagttttttgggagggagttctttctcaaattacattaagtcaaacaagtattaataaatttgttgagaaattaagaaatataatgatttcatttcaaaaaaatcagaatctaattaagagtttagtatcatattgtgaatcaaatattttggaatctattaatcttgcagtgacacaattacaaaatgatttaattgatggatctattgtatggacaggaagaaatattaaagtatttagttcaggtcctccaattattataagtgacttagaaaattatcaaagattactaaatttatcaaaaatcacagaagttagatttctaaagacatcaattacttgtgattttatatctttctctgagcttaattggtatcattttttaactatatatatagtaaaaataaaaaatagtctttatcaagaaacacttaaagaaattaaattaaagattccaataacaatttcatattacaagattaaaaatatattttataatgattataatggcaatttcaacttatcatctacaattaccttgttagatgaatatatagatgataagttttattttaaacaaagtaaaattcaaattgaagataatgaaaatgaagatgattgtgaaagtgatattgatttgattttaagtggtaaagatctagtggtgagaaatatatcaagctttgtaaataaaaaagaaagttttgaatatagtttgagtgactttgataatttttctagagatctttcttcaaataataagcctaaggattatcagtatattaatgaaattgaatcattaagtcattcacttggaactttattattgcctttaactacaagtaacttaagtaaaattgacattgagaaaaatatttataattcaaaggatttaatattaagtgagattcaaagaacatcaaattggacattaactcccagaaaagagttgtttctggcatatatttggaaaaattatcgaa

SEQ ID NO: 2316 - DNA, 510 bp, Cryptosporidium hominis
atggatattgaaaaaaatacttataatattattgaattaaataaagaaattaatatatatagaaatgatttaattaatcaaatttcatattgcatatatccaatttctattgaaaagaaaacttcaaatttcaaaattagaaatatgttacttccattaattaatgtaatacagaatttggataataaacaagatttggaaatatcaacaacattaggattttcattacattatttacaattaatttataatatattggaattaccttgctcaaataatattattgtaaaaggatcattttctactattaataataatccattatatttttatcctaatatgaataaaaaacaaattactaaagcattaaaattatataaatcaataatttataatatactcaattattttaatgttaatcatgctaattcaaaaaagatattattaacaaataatatattacttatgcttttaatagttacaagttatatgaaaaattaccaaaactaa

SEQ ID NO: 2317 - DNA, 78 bp, Cryptosporidium hominis
  misc_feature (34)..(34): n is a, c, g, or t
gtttctttggaatttaatgatttaatgaaatcanaattaaataaagccattaatgaattttcttatatatttaataaa

SEQ ID NO: 2318 - DNA, 1050 bp, Cryptosporidium hominis
atgattattaatagaaattcaattaatactctgaaattatttaatcattgctattgtacttctttttataatattatcccaaaatacatttatggaattaatcaatatatttcaaagaattataatcatcattttggattttttggacatcttattaataaaattataatatataatattaaaaataacaataacaataaaaattacaatatattaaataaagtatcttcaaaatattacaaaatcccaagttactcattttctataaataataacaattctttctataataatatatattcatattcaccatttttgtattccaataatactcttcttaataaacaattattattttcatcatcattatcaccatcttcatatctaaatactcaattttcctcttattattcaacaacaattcatgaagataataataaaagaattggtcaagtaatatctgttgctgatggaattgcacaagttgatggtattagatcagtaaaatatggagaattagttgaattttcatctggagaaaaaggtatggcattaaatcttgaaagtgatcatgttggtattgttatattaggtgaagatagaaatattagaaagggagatcaagttatctcaaccaatactattgttaattgtccagttggtaaagaacttcttggtagagttgttgatgctttaggaaatcctattgatggtaaaccttccattatttctttagaaaaaagagaaattgatgttaaagctccaggtattatggatagaaaacctattaatgaacaacttattactggtataaaatttattgattctcttatacctattggattaggacaaagagaagctattgttggtgatagacaaactggtaaaacttctcttgctttagatattattcttaatcaaagaaaattttatgatgatattaaaaccagaaaatattgtatatatgttgctattggtcaaaaaagatcaagtgttgctcaaattgttaaaattctggaaaaatatggtaagttagttagtttcatttaa

SEQ ID NO: 2319 - DNA, 669 bp, Cryptosporidium hominis
atgccttataatgttgattttaaaagcttatttccaacatttaatgataatgatataagattttatatatatcaaattctaaaagcattagatttttgtcattcacaaggtattatgcaccgtgatgttaaaccacataatgtaattattgatccaaaaaagaaagaattaagattaattgattggggtttagcagaattttatcatcctagacaagattataacgtaagagttgctagcagatactataaaggaccagaattacttattgattttcaatattatgattattctttggatatctggagtttaggatgcgttttagctggattaatttttaagagggacccattcttttgtggagttgataacaatgatcaacttgttaaaattgctagggttttaggcactgatggtttatttgaatatcttgctaaatataaaaaacaattggaaccttattttgatgatttacttggcagacatactagaaaaccatggagtaaatttatcaatgctgataatcaacatcttgttaatcccgttgttttagatttacttgataaaatgctggtttatgatcatgctgagagaattcttccaagagaagctttggctcatccttactttgaaaaaattcatcaggaagagcagaaaggatcatcttaa

SEQ ID NO: 2320 - DNA, 261 bp, Cryptosporidium hominis
atgggagaaaaagaaagattacctttttcatttgtttatatttcaagcctatcattaacattatatgcaacattattcttaaagagttacttattaacattattattttcattggtacaaattattgcattagtttcattcttaataacaaatttcccaggtggatatagtgcattgaattatgtaagtaacaatctattttcaggattggcaagcaagttatcattttcatctagtaaaaatactccattacctatttaa

SEQ ID NO: 2321 - DNA, 797 bp, Cryptosporidium hominis
atgaatcaacaacaaaagcctattaaacttcaacctttggaacttattttaaatgctgaaattagacaacaagatatatttctcttaaatatttatcaaaatctttattgtgttcatgttgattctagcaataaaagaatatcacttagagatttatttaatcatgaatcttctgatcttgttttagatattggagaagattttcaagaatttacattattggttattgataacgtaattgttgtgataaatcttcatggaagaaaagtatttggtctttttgatattaaacttgttaaaaataacaagaatttttcaaaaagtattaattcaaattctgaccaagataaacaacttgaaactgataataatataagtcatttttatatggtaccaacattatttaatgatgaattgaatgataatacaataatttgtttatatgataataataaaaatgatatgtatatgaaatcattaaaaaagataaaaaaccaatatttgaacaattatcatatacttcttgttaattcatcttgtaatatagtaataaagttggatattatcaagattcaatattcaagactgaatttttgtgacgaattattaattgaaaatatattaagtattgaaaagatggatatattgccatttatttccaatagaaatattttatgggatagtatacttttagaaaagttaaaatcacttgttaatcaagaaattaacaataatgataatgatagtaatgatatttcagcgaaaccttgtccaaaagtctttacaatattgatgga

SEQ ID NO: 2322 - DNA, 2208 bp, Cryptosporidium hominis
atggaatattgttatattaatagaatatgtcatcgtgatttaaagcctgaaaatatattattagatgaaaataataatataaaaattggtgattttggattatcaagttttatttatgatggcgattttttaaatacatcttgtggatcacccaattatgctgcaccagaagttgtttcaggaaaagcatatacaggaccagaaatagatgtatggtcttgtggtgtaatattatatgcattattatgtggatcattaccatttgatgatgaaaatgttggtaatctatttagaaagattagacatggagcatttagtttacctggtcatatttctgatttagcaaaaatattaataactaaaatgttaacagtggatccttctttaagaattacatataaagaaataagatataatacttggtttagatataatttaccattttatttagaaccacaatattatcatttattatcatataaattatcaccaagaaatataaagaaattggttgataataataataatggaaatgaatctaatcaagttaatattgaaaatagtactgataataaccttaagatcataagtaaaatactttctgagaatattactcaagaaggagcattatgggctcaaaaacagagaagacataataaattacattcaatattttcaagacaattgcaaaagaaaattggtgttttagctcaaatcttttcaaattcttctataagagattcatcaagaagatcaacatataattgttttaataataatacttattcttcacgctcttgtaagatgatgactaatcaagaatccacaaaaaaaactattatgaataaattattagaaaaatcaaaatatcactcagtacaacaaacatctagtaattcaaatgtttcaacttgtgcttcttcatcttcaaatttgaataataataatggtgggaacagtaatggtaatattaatagtagtaatagcaataataatgctagtaatattggatcaagacaaagtattttcaagatgttatatttgaaaattaataagaatttgattgaaaaagaaaagatgagaaatgaattgaataataaaaacaattacgagaaaaggttgttccttgataaggaggagaccaaaaatgagaaggattcatctatccgatatactattgggagtgggattaaagataaaaatgaagatgatgaagaacgatattttaatgtaaatctttcagatataatcaaacaaaccagattgaatcatagtgatcatgacaattttaaaagtgggagatctctcggagattgtactgaatatcaaagcatacctacagagtcaaaaataacagatgaaaaattacaaaaaacttcctcttactttgagaagattgaagagaatgaaaaaaagaagaaccaactagtgaataagaacaagagtaatgaaagcaatagtggaggtagtaatagaagcagggatgtggatgggaatgggaatgggaatgggaataggaatgggaatgggaatatgaatggaagtggtagcagtagtggaagtggtaatggaagtggtagtaggagcagcagtggaaataatatagcaaccagtattaagatctcatcacttccaataacttcttcttcttcctcgtcatcatcttcatcgtcatcttcatcgtcatcatcttcatcttcatcttcgtcttcatcttcatcttcttcttcagtccataacacaataaatacaagtattggaacaaatagatggttactaggatttgaagtttccggaaatttgaaaagaattataaaaattgtattattcacattaaaatcttcaaattatgaatggatatttatttcttcacataaattaagatgtagaccaaaatcatccttttctttaacaagtacaaattcaactgatgaagataaagatgatattaatattaataataattcaatagaaagtatttacccattaaaatctgaaaacatgataaataattcaattctacaagaaaaaataactcctgctgataatataaccacaatacaactatttaaaattaatccattcaaatatcttattgatatacaaatctatgatgggcctctaattacaaacgcctttcaagcatttaaactaacaactcaaatatattataacctctcaaatgatttttatattaatatcttctag

SEQ ID NO: 2323 - DNA, 906 bp, Cryptosporidium hominis
atggatggtgaagtaggtttatattgtgaaggtgttaatgatgagattatgagatatgtgcagattcaaagatttcaaaaatcacgtacaataggtacaagatggaatagagaaaatgagaatatgatatttttaagaatgggattaaagttattaggtaaatgggagatgtcagatccatatactcgtgattattataaaaataagagtgaatttttgaaatggagagaatcatttttatcaacagtgccaacaaaatatcggatgaaatatgcaatattgacttttccatgtaatgttccaaagtggatagcacaacaagtttggtttaaatgtagctttttatcaaatgagactgataaaagatcaatattttctttatcagtagatattaatagttggccaaataatattcaatcaataaggatattaatattggtagtacatcctttgaaatctaatcagcttagaaagcttcagttattacaaaagatgagtatatcaaattcagttagtaataataatatcaataacaacaataacaataacaataacaataatagtaataatattcatcaaacaatgaagattaatataaaaggttcttccaggaatgaaagaagagaaaatatttctgattcaattaaagatgataatgataaaggtaatgataaagtaataaagcaaggtttggataaattagaaactccagaatttaaaaatgaattattgataaaggaaagtgataaaaagagcctggatgaggataaggatgagaaaaagaaggaagataaagaggaaaagaagaacaaggacaacaataacgaaaaagaaagaagaagagcatcttcaattatattctcatacgaagaagatgagcctgagcttaaactgttacatccataa

SEQ ID NO: 2324 - DNA, 891 bp, Cryptosporidium hominis
atgtataaaaaagctgaagcatcattttgggttactgaagagattgatctaagtcaagatactagagattgggaaagtcttaaagaccctgaaagacattttatcaaatacgtcttagcattctttgctgcaagtgatggcattgttatggaaaacttagcagtaaatttccttagagaaatacaaataccagaagccagaatgtattatgcttttcaaatgtctattgaacaaatacatagtgaaacttattcattacttattgatagatatattactgatattaaagaacgtcaaatgctctttgaagcaatttctcatattgaagctgttaaaaagaaagcagaatgggcaactaaatggatgaattctgaacgatcttttgctgaaagaattattggattctgtgctgttgaaggaattctattttctggtagcttttgtgcaattttttggcttaaaaaacgtggacttatgcctggactcacattttctaatgaacttattagtcgtgatgaaggtctccatgctgactttgcttgtttaatatataaagcccttaaatttaaattaccagctcctagagtacaacaaatcatatcagaagctgttgaagttgaaagaaactttctttgtgactctcttcctgttgatcttattggtatgaactcaagacttatggcccaatatattgaatttgttgctgatagattactttttgccttggatattccaaaaatctacaacgtttctaatccttttgattggatggaccttatttcacttcaaggtaaaactaacttcttcgaaaagagagttggtgaatatcaaatggctggagttatggtcaatcaagatgaccaaaagtttgatttgaatgcagatttctaa

SEQ ID NO: 2325 - DNA, 1110 bp, Cryptosporidium hominis
atgaatgaagcaaagaaagaattattagaacaacaaaaaaatgaatcaatcttattagataatccttttagatgggttttatttccaataaaatatagtagattatggagtttgtataaaaaatatgaggtatcattttggacagcagaagtaatatcaccaatggaagataagacaaaattaatgaatatggatgaaagattacttgattatattgaaatggtctttgcaaaacgtatttatattgataatacatgcttagatactgtattgttaacatgtgaattattaggccaagtacaagtaccagaggcaagaggttatttttcatttacaatgtgtatggagaatatatataaagaattatttatgaattatgttgaaatgttacgtaaaaataaggaaaagaatgaaaagacagatgaagtggaaaagaaggatgagaataatttaaatagtaaaatatctaaagaagaatatgaatataatttagagaagaaattgaatgaattagaagattttacgaaaatgaaggaattagttggtaatttttacgatgaagatactttatttagtgaaaaactgatttattatgtaataattaaaaagatattctcatctagtattcatttacttagattatctttttcaatgagaaatatatcagaatctgaattacctactcaactttgtgatggtttagatagaatacgtagagatgaacaatatcaagttgaattttgtttaagtattgcagaatctatgaaaactaagccaagtaatgatcaagtagttaatttattagagcaagctattatgttagagaagaactttatattttcaattgtagatccacaagttcttcaaattgaaagagaagatattgttgcttttcttttatttaatgctgatgaaatacttgtagatttaaaatatccaagacaattcaatgtttctaatccattcacaaatattatgaatgattttcccgctccttctcaagaagaagctgttgctagacaaactcttacacaaactcttaaagctgctcattatagaacttaccaagaaatttctagcaatcaattctcaacttctcaagatttctaa

SEQ ID NO: 2326 - DNA, 1386 bp, Cryptosporidium hominis
atgatgaatattagtaataatatatttaaggtatctatattttactttgttttgggtttaattttggattttggtaaagttagttgtattccaacaggaatttcttcttcattaccacaacaaggttcttcatttcaaccaaattctggtgggaatatggattcatttagaaatagagcacaattactttcaaaaagagttgttgatccattaatgaatagaggagatagattttcacaaaatgcaaatagtttatcagattctaatgatcaaagagttgaatctaaatcatttaatattccaggtattccaatatttggaggaccaagagttgaaaatagaaattatttaactcttccttttacaagagatggacattgtgagaaaggtacaatttacaatataacaagtgttgatgatttaatacaaaatagtcgtgatttaatgtgtattttggaagttggtttacaacctgatgtaattccaactggtatgatgtatggtacaatgttggatttattaacagatacaagagatattgatatgagaggtattgaaaaattttggggaggtaaatttgctgcaaaaggtgcatgcaacagagctcaagatgaagttgtatttggatataatatggtgaagggtaaatttgttgttccttctattatgtctcttaatagtttaccacaacattgtagtttagcaactgctgaacatcaagataactctcaatcacttattttggattatatgacagataagaatgaagtatgtagagcagagacttatactaatggtccattctttggtaaatctgagcatgtgaatgtttgtgctattgtaaaagctgttggtcgtcaaccagatggtggattaattttacttggtagaggtttgagttatccatcattaagaccaaatgttaatccaacaggattaattacagttttattctttgctgtggttacttatgataatgtattaccagaatttatttctggcactcctttggaaccattaccttcttcatttgattatagacttgttggtattgataaagataacaattcatttttcccagcttttggaatctttaacaagggagatgctttggctttaaataactttacaaataagtttggtccacctattccagtacctacaacttctacatcaacaacttctacatcatcaacttctacatcaactacaactacaaccacaactaccacaactacaacaactacaactacaactaccacaactacaaccaccacaacaacaactactactactactaccactactaccactactacagaggttgctgaatcaggtagaatccaaaatcaaagctcctctagaagattaatggtaagatcttaa

SEQ ID NO: 2327 - DNA, 558 bp, Cryptosporidium hominis
atgtcaaaatacacattcactgaatataaaagattgaataattccatattccgattggatgtatttccattcattactatttatattgttttaatttcaatcttattaggagaaatcttcagtttaagtaaaacaatcacttataaagatgtttttgattcattcatttatttaataaatttcatacaaaatcttaataatttaaataataccataaatttggtaccagtacaaaatgatgaaatatttaatgatttaacattgaataatacaaattatttaaatacttctgaattggatgattcaaatttaagtgaagaattacaacttattattgataatgttccaattaaatatattgttgcaatttttatcacaattttaataaatttattaacttttcttatgactcaatggaatttaaaatttaaaagtattatttgttttagtaaaatcaaaaaaaaatcaaatggaacttgtacaagtttaaatagtaaaaccactacacatattatggtaaatagttccaaatattcaagtgatctttgtcctttataa

SEQ ID NO: 2328 - DNA, 1090 bp, Cryptosporidium hominis
atggaaatacaaccgaataatcaagataataataataataataataataccgataaatttgaatttccagatttaccttttgttatcatggaagagatttacacttacataaaccaaaataatgtcaatcaaacacaaaaagataatatctttgttttaactcagaaaatatatgatattatgacagaatatattgtaggagaagaggaagaaagaaatccaatcattagtatggttatttcagaaaataatttattaacaataattaattcattatttgaaatattcaagttattcttaacaacatattttcataatagaaaaaataaaaatatacttgcaagtcctgataatgtaaaacttatttctctatatgaaaagattatttttatcaagcctatattctattcaagattaacaaaaactttgattatttatcaatatccatcacaattattatcattatctggatatcaatgctatttacttaagaaaattatttcttcatcatctctttcaactatcatttatattttatatttatgggatgaacttaatatagaaaaagaatctaaaaagaaaattaaacaaacaaatttaatggatttcattaattctttatttaaatttggtaatacttcaaaagaagaaattatatctgaatttaataattgtattataccaaatatcaataatgaaattaaatgtattgaaactatttatttaagttcaataatattactttatactcaacttaaaggtgaaaatcatcatgaaatgcttaatataagaattttaggtgaactctttcttttaaattatacaattacaaatatgaatattaataattcaaaaaaaatgaatgaaatttcattaatatcttcaattgattcaaacaatatagaaaaattgatgccttatttggaagaattatataaaagatttaaaactatgctttttgaaaagaacaataatgggaatgaatcaatttcttatttgcaatcaaatttaagtatcttaattctagttcttggacaagcaagctattctactagtagtattgctaagagagctatataccctatatggt

SEQ ID NO: 2329 - DNA, 1344 bp, Cryptosporidium hominis
atgaataatcaaaatattactccaaaaaaacacaaatatgtgaatgaaaattccagtcaaatgttggattatgaaaatgaattgaatggaaaattaatatctcctccatatacaagcgatgaaagtagtcattcaaatcatcaaaacaatgatcgacttaatcatcaacataatttaagacatattaatagttatagggcttcaatatccacaaataatacattaagctcgccaagaagcagtgaagtcattggtgaaatgatatatgattcaggtaacaatagtgtcgatattggtaagaatatgatgggagtgaataaagaaaactacattttaatgaatcatgaaaatgagaaaaatattccaagtaatagcaaatcatcaattagtcaaaatatcgatgaccttgtcatacaaagaattagtagtaacaaaagaaagagaatgagaagaattccatcatcttctagaaatatatcatctaaaatggaaatggaaatcaatcatcaaaagagtttaattaatattaacaatgatgaaccaaacacaagaaattacaacccaagctcatttaaattcacttccttgattgatacaaattctgaagaatttaattctatgcctcactcaatgcagaagaaaatattacaaatgattagaaatagacaatcagctcaaaaacatagagataaacaaaaaattgaaagacaaaatttaatacaagaaaatatatctctaagagcaaaaattgttgaattgactaatgaattacaagaacttagagccaaacaatttgctatacttgaacaagagggaatgctttcacatattaaaaatggatatagatttaccaattataatatgaatactcaactaagtaatattaatggaaatattatcgcaagtaaaagaattgataacattaataattgtgttaacaatagaaatagtcttggaaatgaagatacagaaatcaatcatcacaatattatttgtaatgataatttactcaatgaaaaaagtaagactaagatagataatattggagttaaaaatcaagaaattgattgtggatttgattttgctcctgttgatgagtattcaaatattggaatatggaattccatatgtgatactggccatggtaatactactaccaatggtaatcatcatttaactgctaataatagtaatattataagaagtaacaacttatgcaatcaattaacaatacatcctaatattgatgtattaccttggataggtagtgttggtgttggaggagttgttacatggaataaacaaaataattttgtcgaagacatgcttataagcagtaaatga

SEQ ID NO: 2330 - DNA, 1020 bp, Cryptosporidium hominis
atgaattctgagaaagaaatcaaacaagataattcacaaaatgtggctaaagatagtgaaagtgaagaagaaccagtaaaaagtttgagaattggaatagaccatccagtatatgatgatgatgaagaaattaatatacaatgtggaagaattggtgaaatcgaaaatttatcaaaatgcaagaaactaagatccctgatgttaatttcaaatcatataagaaaaatcaagaatctggatgaattaataaaattgaaaactttagagctttaccaaaacaaaattaaaaaaattgaaaatttagagaaattggttaatttggaggttttagatttgtcgtttaatcgaataaaaaagctagagaatcttgaaaatcaaaataagcttaaaaagctttttctaacaaataataagattaaaaccatacaaggattaaataataataaagaattaaaattactagaagttggaagtaatgatatcagaattattgagaatattgatcatttaactgagctggaggaactttggcttggaaaaaataaaatcactactttagatgatatcccattatttcaaaatatcaaaataataagtttacagagtaaccgtattgtaaattggtcaattaacttctcaaaaaatgtgaataatgtccaagaattatatttaagtgataatcagttaattagtccagataaagtctactttgattcttttcagaatttaaaagtcttagatttgggtggaaataaaattcagaatttggaagctatatccaagattgaatctttagaagagctttggattaatgacaacgatatatgtgatattaatcagcttgaacttttaaaaaacttaagaaatctccaaactttatatttggaaagaaatcctattcaaaaccagttagggcctgcatatagactaactgttattaaaattgtaccttggattactcaactggatgcaataccaattaatcgaagtggggaaattcattttattcaatcttcttaa

SEQ ID NO: 2331 - DNA, 2958 bp, Cryptosporidium hominis
atggatatgtcggattttgttttcaaagatggaggaaaaagacccatagtaaaaacaatcccaggtggtggtacatcaggatctccaacatcaccaggatcacctatatttggcgctggtactagtggaggaggatcacgtgctccaatgccaaaatttagtggtggatcaggttcttctccaaggtcaagtataactcccttatcaccacaaagatcttcatcatttaaaagaaattcatcattaagtggaagtaatttaggtgttgattcaaaggccaataatttatttggagtgaataaaccaatgaaagtttctccaaaaaatcaaaatggatcaaaatattcaactaagaattcctttccaataataactaaggcaaaacaaacaccaggaggatcaacagaaaataaatataataccagtaatgctactcctgctccacttttagtgaaaaaaatttcaacagataaagaagttaattcagctcaaccttctccaagaaaatctttaagattacaaccagactacaataaagatgaagatttaaatgaaagaagacatccaaccaatgatgaattaagattatttagtgttcctccagccggttctgatgagagaaagaatgttgttccaaagaaattccaatcaagaggtagagatttaacagaaagtgaatttccgcattcaaataaaccaggagaaaaaaggacttcaacttctctttatagtaaagcaggaggggctgtattaggaggtaccgaagtaattaatggaatggaggtaattatgccttctgatgaggttcaagagagaaaaattggaaatgatcaatttagtaatcaacataataatagcttgaatagaggtgattccttttctgggaataaagttgttgttgatattccaaatccgaatgatacaagaccgagaaactcaattttaaatactaagattgttccaaaacataataaaaattcagctccagttatagtaccggtaccagttcctgttccagcttcagctcaaactcctgttccaactcctgctcctgctccaaattctattcaaacaagatcatcatccaatggaaatattaataaatccagtggaatgaataatctaagacgatccatttcaaaaaagaagggctttgcaacaattgttgaagctatggtaaatattgaaccagaagaaaatgatgaaaataatggaaatcaaggagccatttctggattaggcgtaccaatagttttaggtaataataataatttattaggaccagatggattaacaataccaacaacaaatcatagagtatcggaatctcaagttgttaattatgatgaagaacttgcaaatgaaggcaaagttgtaggtagaactagtgtacaaatggtaaagatgggtgaaatccaaaaccaacagcaaaagcttagaagttctaccagtcttgagcatggtaatacattcaaacttgatgaacatggacttactggacatcttaaatggctttatggagaagaaactcaaattgatattgctgttggaccttatgcaaaagaacttccattagatgctattaaagttgataaatcatatcatgttagtgaattagacccaatttctcaaacaaaaattgcttccaaatttagaaaatgggttaatccaatacatggaagaatatttgttgtattaacaacatcatttgctctagttggtgttttcttccaatctctcatttacaatcgtcttaataaatgggataatggtaattgtggtggtgtatatgttgaatctttcagtatgaactctatgcttggaccttgttcaaaaactttaagtgctcttggaggtttagttgttaatgagttaagacaaggtgaaatgattcgtatgttttgggcaatgtggatgcatactggatttatacatattggatttaatgtaatatctcaagctcaattaggatatatgattgaaccagattggggtattttacgtttcttcttattattcttcttatcaggtgttggtggtaatctagcagtagcagtaatatctccttgttcactaactgttggaagttctggtggtttatttggaattacagcagcctcaattccatatacttttgagaattggaataatcttcctgctccaatgtttatgttcatttttagtttattttcacttattattggtatgattttatcatttacaggtgtaacaaatccatgggcgcatattggtggttttgtagttggtatactttatacattcgctacaatgaaagcttgtaagggttgttctcctgaggatagattagatagatacaatagaatggcagctcttccattatttcgactttttatgaaacaagataaagaatggattaatcgtcaacttgaggagaagaaaataagaaagattgaaaaaagaaatgccaaaatcgctgaacaatggagaaaaaaccaacgtataaagaaaaatgctttaattaaacaaatgaagattgaacagatccaaggagaaattactgatagtcttggtttaattgtagatgaaaatggaataaaaaggcgtacagatttaaccattttgattgatcgtattccaactgaaaagataccaataaagaacaaaattaaaatatatttcaagaatcgtattaaaagtcttcgtgaaaagaaattattgtggacttttagaatcttatcaggaattttactcttattttactttattattggctggcttggaactttctatcctccactatattggccaaatccaattggtgtaatatctttttctgatggagcaacatcatgtggatgctgttatgttgatgatgtatatacatgtggtagtaatccagactttattaaatggtgtgaaagtaaaggatcatcagctcaaccaaagagaactgtatttggatatgatttttcttga

SEQ ID NO: 2332 - DNA, 216 bp, Cryptosporidium hominis
atgcttactcgaccaggaactctgattgaactaaaaattcaagatattaatgatttaaaagagagaattaaaaataaagcaaaacaactacaagaaaacgaagatttaaattccatccaaactaatctcaatataaactcccaggaaaataactccagaatcttaacttctcaacaatctaatagtatctcatcaaataataatgtttataattaa

SEQ ID NO: 2333 - DNA, 777 bp, Cryptosporidium hominis
atgtcatattcaaataatgcaaatcaaattacatgtcaatgcggaaaacaagatagattattaccagcattacctcaaagttcaaatagtagaatgatgaggatgatacaacagcaaggatgcggttgtatgacaccatcatcattaaataataatcagaattactactttgacaaccagtcaaacatttcaggatgtttgttctgccaaagacttcaacattgttgtatttgtgatttctcaagaagaacaggaacaggaatgatgaatcaaggtaatatgttttgttcttgctgtacatgtccaatgcaacaacaatttccgtcatgtcaatgtggaacaaactattttaatactcaacattcaaatcctgtaactcctcaacaagcacagattacagaaattacaaattctaataatggtaccatgaatggaaacgtagttggtaatggattagataatacaataccaaacaattcaactccaggaaatgtgttggtatccacaaatttgaattcaatacaaaaccaagggcaacaaattacgactcaatccgaattattgaatcttaagaatacctcaatcaaccctgaaatgattaatattgctttgtcaggccaaacaccagagagtctctctatttctattgactctaaaggtgttattacactcggagttaataatcatccagctcctgtttctaacatacctactacaacaaactctaacgaggagagcagaaataggattagaaatgctttaggtgatagacattaa

SEQ ID NO: 2334 - DNA, 615 bp, Cryptosporidium hominis
atggcaggaggattagaatgtactataacttctcagatttctgcttgtaattcggatgtggagtgtttgccatgcggattcactgattggggaagttggtctccttgctcagcttcttgtgacggagggtttacaatcaggacaagagaattgacccattctgctcctggttgtgattctttacttaaagaaaaatcttcatgtaattcttctccatgcccagtcgattgtgttctctctttttggtctccttggactgattgctcaaagtttttatgcgagggaaccaaatcaagatatagagtagttgtgagggaggcaatgaatggaggtactgcatgtccgtcatctaatcagttaagacaggttgtggaatgttcaggatgcgagggaatttgtgatactcagatagaaccaatatgccagaatagtggtgaatgttttaatataggcaacgatggatattattgtaaatgtgcagaaggattttatggtagaaattgtacaatctcatctgacaacaagtttaatatcattttaggtacatcttctggactggctgttggattactagtagtactatttatattgttgttaagtagatcacgtaattga

SEQ ID NO: 2335 - DNA, 414 bp, Cryptosporidium hominis
atgagatatagaattattttagctcaatcagatcttggtggagtacagtgtccgacagaaaaggaaattactgagcgtgcttcatgtcaacttcaagaatgcgaaaaatcttgttcaactggagaaatttgcaaaaatggtgggacttgtattgatatccctaatagcggtttttcttgtgaatgtgctgaagattattttggtaaattttgtgaacacaagaaatacagctggtgggtttattttgttgtttgcattgctacacaaattattattggagcaattgtaaagagtacattcctttcaagacctgcaccaattactgaaacaccagttacttataaccaagaatatgctttcaatgattatccgacagcatttgatcaaaatactgacatttctggtgttttttaa

SEQ ID NO: 2336 - DNA, 1260 bp, Cryptosporidium hominis
atgtatattagaagtgaatcagaagaagaattaaagcatggggaagaaattgatgaagttggttgtttattaatatttgatgaaacatataaatctgttattgattcctttccattgaatgaaggaaagaattatgtatgtggatcaacaagatcagtttttgaaccaattaatgaaaaatctaaaaagagagcaaagaatacaaaattcaagggtaatagtaaaattaacaatgaagattatcatgcaataatatatgttgaacatggtgaatttttcgttgaagataataacagcgatattggtacattccgaaaaaatttgaaatataaaattaaaccaaattgtaaatatgaattaattccaggggaggatttatattttggtaatttaaaaactaaattaataaggtatgattctatggattcaattgagacaccaagatggaaaaggcataatattgaaaataatgataataataatcatcaaatacagttagagaatattgaagaaagtccaaaaactaatcatatagaagatatcgattttaataaaagtaaaaagaaatctttaggaaatgaatcaacatcaacattaaatgatgatattgaaaatgattctttactttcaaataggccaaaaaggaaatctcctaaatgtattaaagatgaaaagatgaataacttaccattgttaaaaagtaacaatacagataaagtaatattattatggactggatgtaccccaacaagtaaagatatagagttaattaagagagcaaatataacttcaatagattctgaagatcttgaatttatgtctgatcaagttacacatgtagtatcatcttcaataaagagaacattgaaatttttgtgggcaatatcaaaaggtcttcccataatatctccatctacattaagaaatatattaaactcgaatagaaataaagatttgagttataatgaatttaatcatttatgtatgaatcaattactttctgatttggaaggtgaaaagaagtttggtttttctcttaagaattctatttgtaaagcacaaaataatattccaatattcaataattataagtttgttatttccccaaatataaaagttccttccattagtgaaatctcatggttattaaagtcaagtaatgctgaaattattcaattagaaaaagctaataaaattcaagacaaatctaatttaatatttattggtactttattggattctaataaattatttaagtaa

SEQ ID NO: 2337 - DNA, 915 bp, Cryptosporidium hominis
atgaataagaaaataatcatttcaataattattggattattgtccataacttttgttcaagcatctacagttcagagtcaattctttaatccattatcaatattttcaggaattggaaatttatttaatggtattactaaaggaattcaaaatatatttgaaacatttattaaagagattattccacctccacaattaatagatcctaaatatgatattaggtcaattacatcagtacaacaagatatattaaaaaatatgccaattctggaaaatgatttaaattctgttggagaagttgttaatgaaatggctgttggtgcaagtataaatgcagcaaaaggattacaaattacacaatctgttttgaaacctgatatgactggagcaagtgaagcattaagaaatttaaagtctgttgattctgttgataaaaagaaaagtttaaaatctgcagcaaaagcaaaatctcgtgaatttcttgaatcgctttcaaaaccatcagaaattgtttctgattatactgcaccaattattgtaatacaagcaccagaatctgatcctacgcaattgatgacaattaatgagattattaaatgtagaggtggtaagaattggataactgctcaagaacatatgattaaaatgaaagaatatagaaaacttaaaggaaaaaagaagaagcttttggatgaagaaattgaacaaatcaataaattacttgatgaaaaggatacaattatgactgatttaagaaataaacttagagcaaatgaggtcaagatggttgaaagtccatcagatgttactacacttgaaaataaattacttaatcaacaaatgggttatttggctgaggaaattgttgttttagataaacagttggaaaaattacatagaaagaaaaaggattaa

SEQ ID NO: 2338 - DNA, 3048 bp, Cryptosporidium hominis
atgattttaattttgaggtttgaagttaaattaatattattttgtaataataagggtggagttgataataatggtcaagatagcatatcttcatcatcatcaatccctggttttgaggtaaatcaatcattagatctggataataagattattatggtaccaataacatcattaaatggtttatcatcaatatcagtacctatgaatgaaataagagatgaagttagccaaataatgttggaaggtattaatgaattaaacccaacaggttatattgattattataatagtaataataataataataataataataataataataataataataataataataataataataataacaatatcaataataataattatatggaaagtttgggtggaatttcttcaggattagttatatcttggaataaagataatttatatcattggaataaacaaatgaatgtaatcaagaatgtttcatcttcaatagttcaaggttatggctataatattaataatattggtaatagtattaataataataataataataataataataataataatatcaataatactacaaatacttcatctattaatggtttaaatgattcattattaagaaaaattagtaatttgaactttgatgaaatgagtcttattgtaggaaatagtcaatcagttgtaggctatgaaagtggaagttctggtaatattattatttctggtattagtaatgaaaataatttaacaattccagtttctggtagtggtggtagtactattagtagtagttcaacaaataatttagttttaccatcaaattctacttcaatggttggcgccaattcgactggaattttgccatcatctacaataatgacagctttagctggaacaggaaatacttcaattgcagcagtttcatcctctaattcttccaatattaataatgtaaattcagtttcatcaatttctaattatggttgtagtacaagttctatgactaatagtacttcaattcaaaatcaagcagtaaattcaacaaatacaggatcagggttattaacaataacaacaggtggtgttggtgttggcggtaataatagtaccagtggtaatattagtagtagtggaggaggaattggaggagttggagtcggcaatactaatattaatacaaacaattgtaatatacaacaatcattatcacaacaatctttgagtattactactaatactaatactacaagtactggtgtaagtggaggtagtaatagtagtattataggaagtacgaataataattatccaaatcagccaacaattaccacagcagcaacaacagcaacagcaacaacagcagtaacaacaacaacaacaacaacaacatcatcatcatcatcatcatcaaatatgaagagatcattttcattagaatttctttctcaagctttaggagatgatactcctgaaaaagaagcaatttcatcatttctacttggtagaaattcattatattctccaacttctgtattatcgttattaaatttgaatggagcaacaggatgtacaattttacaagattttatggaaagagaagaaaaatggtgggaaagtatttataattattattctcaaatatatattcctggatatttatttggaatgatttctactcgtttaacggtagatgattgtcaattacaactaatagaaaaaggaataagagaaagctcaacatattcacttggtatgaattctactttagattctggaaatattcgatccaatttgaatggatctcaaaataatacattaaatgtatcagaaatatgtaatttagatcaaagagaaaataatagagaattattattgtttgatttggcaataaacatgtatcagaaatatacacatttatcaagaattctaacaaatacattttatggtagatatatttctgatcttggttgttatttacaaccagcaacaacagagaatactgctttaaattatttattaggttcaggacaaaatgtatctgtacatattccatcatcaaatggaagatttattgaaagcaatatgatttttaatagtactaatagtaatagtagtatgattggtagtggatggcattattatcatcagatcttgaatcaatataaaccttgccaaagtatgatacaatttaagtattattgtaatagtggattaatagataataataaggattggcaattgggttatatggtaatagaagatttttctatttacatatatgatagtggttttaaacaaaagttactagatatactttcaatacgtccaaatcaatatggagaaagaattaccagtatttgcattgatccacaagatttaactagaacaggatttattattttttggggaggaagagaattggatagttttaatattggaaacaatataactaataataatagtactagtaatgttgttggtaatattaataataatattagtaatagtattggcagtagtggtggtggtagcggtaatattggtataactaataataatggccttacaggagtagtaggaatagggacaggaactggtagtttatcaagaacaactagcaatttatctcctgcacaacaaaatattgtaaattccaatatgagtagtaattcgaactctaatttactacaagctaatataggaggagtgggggggaaccccatactaattaatggaccaaactccaactctatgactaattttaataacttaaactctcaagattcccataatattagtaataataataataataataataataataatttccaataccaaaatcagaatttcaacatgaataattattttattgatgttaagaattgctctttgcatgcaaaggcgccaaccccgcatttggcggcaatgtgggtgtcagaaattgacatgttgattcaaaaatcaaaaaataactggggagttggttttttagaaagttttgaaagaaagaaagtttgtcaatatattagagttgattag

SEQ ID NO: 2339 - DNA, 4374 bp, Cryptosporidium hominis
atgataatgaagaataaagagatcgttaatactagcaaaagtaatacagaagtaatgagaagtgatgctgaaacaaataagggagagagggtttctccatgccctgaagattttgacgtagtattagacaacgattccagagctcaggaatgtgtaaaatcggaaatcagtccttcagatgttgaaggccgtcatggtttatcaacggaagagggtttgggaaatgaacatatgagtgagaaggacataaatagtgataatgaaaatggaagtagtaataacaatttagaatgtaacaattcaaatgaagagacaaatgcagaaactggctttaagatttctaataagatttttgagactttgaaattaccaacttcagcaagattgacccctacagtgggttcttatttagagaaactgagcccaacagcatttaaaggatttcaaaaaaggttttttaaactaaatttgacagacaatgctttgttatattggcgagaagagcctacatttcctgatcaacaaccatccgggtgtattaacttatcaagcgtgattgctatacatatagaagatgctttaaactttgtgataaggacttttgggagagattactgtttaagagctttatcaccgggagataaggatatttggttggagtccatttgtatggttgtaaatgctgtaacacgtgtggaaacattgaaggatgcttctaatcattacaattttagcaaagttttactggacacttcagggaatattcagacatatttgacagaagctttaaaaactcagagaaaagttaagtgggccaaagaagataaagttcctttaacattttctctaaggggtaagaagatgtttttgagagctaaaggtattcaaaggtctttagccaggttgtggttcgattatgttttcagtgtaaaatgtttatccccttctgcttctccatatttgtctctatatccagatattccaggaaattctacaggaaatcaatttttaggaaatattcatggacaaacacaaggacaatcatatttacagaattcatcttcatctcatcattctccttcatctttttcattgaagacgtctaggggtatgattgatagttcaggaggaggtacaataggatctagaaggcgttactacagaacaagaagttcatcgtattgtacaagtacttgctcatcatcccctccaactactggatattgtttaaagaatgatgaaggagttacttcagctacagggttaacaataagtaataatagaaagccaattcctgggcatttctatggaacttatagaggccagaatctgaaaataagtaaaagtatgatgggagcagagttaagtagcttaaaaaggactaagactttgagagatttaagcggttttgggaacattaaccaaaatccagaaggctctaaacactcagagccgaatatacaaagttttactaggatgagatctcatcttgataacgttttgtttgggactatttatgcggaaattggacctttacccacattagaacatctagttcaaaatatttcactcaattccagtacttctggaggaatgccaggaagtgattcttcatcatcctcttcatcatcttcttctaatagcccaaatcctcccttatcatcacttcagaaattctttgcattattaatatcttcaaggcctatagccaataatgaagcatttttccctcttcctaataacttttcattaaagccttgcgataccaagacattgggatctaaattaggttattcaccaaatgtaaattcagtctcggcttcttcaaattcatctttgggtttaagttcttcagttacgggtgactatagggagattgagagtcttccttttaatattcaattggactgtttatacttattttctccagattatgatggttctcctcctttatatgttatagaattggataatattcagctttcaagtaaaattagagaagttcaaactggtttccagtttagattacaagttcctatgggtagcatcttggctagtttaagaagtcaagattgcaatgaaggatatcaagaagaagttcatattacaactgatgacgaagttgaaggtcagaaagatgatcaaaaagaaacaaatcaatcaactctggagggaggattggaaaatgttggtagtggtggtggtggtggtgttggtgactcagaggagtttatgagccaggatgatgaaaaagaagaagaatctcacgaaggccataaaaaagtgattagtactgatttatcaggatcagataaagagttagatacaaattctcagataccacctcattcggagataggacaaaatatgggagatttgaatggtttagcctcaaatattgaatctgaaacaaatactgttgcaatgacttcaccagtttgtggtgctaataatactaccaatactaccagtactactaataatactactaattctactaatgctgctctaggacagaattctcaattcaaagataccaaatatacttcaataacaaatttattccaaaattcatcactaatactctacggtttgggcggcaacaatagtaaatgccataatgagttatttcagtccatttctaccatgtctgcagatcttgcaaaaaatggtatagttttcggaggtgaaaataatattggaattaataatatcctttcatcagaaaaagtatcaatgagaattatttctatatttggtcctgatgcagaaatttggcgggaagcgttaattgctagttgtagagctaggcatgcagcaaaagaaaatcgattaagaactttacatgatgagttaagagcatttgatagtattccaaaggagcttttagatgagaatattactcatttattttacaaaactttggtttatatttctgcaatttctggtattaattcaaatgggaccacaggaattggttctagtggaataatgagtggtaatttcggaggtttaatgtgcagtaataatgactttagaaggatatctccattagtaggagttttgagtgattcttatcataatattaactttcattcaggatgtaggaatggacttgaaagtgctatagtaggaagaaattggattagaagaatggtataccaaatttctagtagttttgttactattccaataccaagaattcttcaaggtttagaagtctttaatttaacaggaagagatttattacaagcatctatacgtatgatttcaaatccaagagtggatatattaagatttgttcatgataaatatgtgataccaatattaatggtcatacaagaatgttttacaagaagaaatgaattaatgagagaattggatattttattgattttagaatttttggttgatttaagattaagttatgaatcttgtggtatttatgattctaaattcaaatatttgattttgaacttttcttctttatatatgaaaaaactggttcagccttattatagtaagatctttaaatctatacataatacatgttttttgggtaaaacatttagagataaagaatcaggtacattacgtatatcattgttttcagaagcattttcatcattaaattcaatggtcaatttatttacttctttaaggttttatcactattctgttgaagtgagaaatgttttatttatgacagttcaaaatgctttaatgcaatatcaattggcaatcagggatgttgtattacataatttatgtagtcttacagaattgggtcatgaaaaacagaatttcttcttttatgatgattctaaaaagtatgagggaggattattaaaaaaagaaggttatgatggttgcacggtagttggtagtgattgtttatgttggagatgttatttcaatcaaagaccattttttgaggagatggattattctaggattccaatttcttctgaggttatttgtggattattgaatggtatagaatattgtatttgtaaatgtgatgaattggatatattattagaaagatggaatccatttctactttataaatttgagcaggaatattttaagaatggagcagttttaatggataataatattggaatacttgtaaataatacaatggtaggtattggtaaaaggatgaatactactcaatcaatggaagttactgatactaatattggtaatatgagtggtattattacatctagtggtgattctataactgttactaataatcttaatggtaataataatagtaatagtactattggatctgttatagatatgaaaaggtggtatttggatcaacaaattttatatccaggtgggactcggttcctctactaa

SEQ ID NO: 2340 - DNA, 1227 bp, Cryptosporidium hominis
atgggtcaagcctgttgtaataagagtttaatggcatattgcctgagctacttagttttagctcttgcaattcttatcacaaactttaagcctcttccaattatagttcagatgttaatgtacacgtcatcgattatttatatcggatcttatttatctctttctcaaacaattattgatcctaaaacgggagagaaggatcgaagcacagaatcactttccaggaaagatgcaatgatgttcccagtcattagttcgattgccttgttttcactatatttggcatataaatttctccctgtttactgggtaaatttgctcttgacttcatacttattcataattggtgcagttgcgctgatggagactattttacagttcatatcaattgtaatttataaatgtgatgatatttgtaaagataccaaattgataattgttgacactcattttaatttctttggatactttgagaatccagatgatccaagaggccacgaaattaagataactattcatcatttgtggtcacttgcacttagtttggcccttgggatcattttgataataacagattcgtggattattcacaatctctttgcaattgctttctgtatccaagcaatctctctcatttccattggcagtttcaaaattggagctattttactgtgtggattatttgtttatgatatattttgggtatttggaacagacgttatggtaacagttgcaaaatctttccaaggaccagctaaactcatctttcctgtttcatttgatccatggaaacaaagtatattgggtctcggagatattgtaattcctggacttttcatatctctatgtttgagatttgatctcaaagattacacaaagaaacataatcagagtctttaccatttgatttccagctccctacaaacccccacattctgcacagttttagtctcatatctacttggactcattacaactgcctgtgttatgttatactttaaagcagctcaacctgcattactttacttggttccattctgtcttattagtatggtcttgtctgtagtgtatagaaacaagtcttctgatgcttggaattattctgaggaagctgactctgatgaaaaaattaacgactccaaagagagctccgaggaggataactcacagagtaaaacttcaactagaaaaaattcaaatgaattaaaacaaaaaaaggatgactga

SEQ ID NO: 2341 - DNA, 1560 bp, Cryptosporidium hominis
atgaagctttactctgtattggcatcattaagtttattattgcttaatttcacaattcaagctgaaagccaagactacccaaaaaatgaaaatcttatcaacttgaaagaacatgaattcaaagaaaaagtattagacgatacgacagatcaaatatggtttgttaaattctatgccccttggtgtgggcattgtaggcatttatatccagaaatattaaaagtttctgaacattataaagggaacgaaaaagtgaaaatagctaaagttgattgcagtgtggaaacaaaaatatgtaaagaacaaaacgttgttagttatccaacaatgagaattttttcaaaaggaaatttaatcaaacaatataaacgtccaaaaagaactcacacagatattattaaattcattgagaaaggaattcagcctgacataatcaagattcaatcatatgatcaaattaatgaacttagctcagacttatcagcatatccaattctactgataatgtttaattcagagactgaaattaaccaaaatttagaatttcttgaagaaattgttaaaaagaatgattttgaaataacaatagcagtaactcatgctaagagtgttaaacaccgtgttctagaaaatacaaaagatcagaaatttagtaacactgacttgtgcttaacatccccatgtattactatgattggaaaagataacttctcaccatcaatactattagttaaagaaactgaatttactctcaactttatccaacaatacagatttccattcttaaatgcaccatctagaatggaattcattgaataccttaatagtggaaatcttgtagttattatgggaatcaaagaaaatgttcaaattaatcatgaaattagtggtgattttattactgatttcggtaaagttgctgaaaaggttagaagagaaatgttcttacctataaagttttcagaatcagaaactcctagaggaattttatttgcaatcgttgattttgtatcttactcatcactttttagagaatttggaatcaccaacttcaactttatacaaggatatgaaattgtggtttctgatggactgaagtattactacaaccgtccagatatgatgaaaatccctgttttatttgaaacgataaaattaatttccaatcaagattcaaaagttcctaagctaaaagcatactctatatttaatccaaatactattaggaggtttttttatgaccttaatgtaattatcagcgatatcttttataaatcatggattcatgcaattgctgtcacagtcattgcattcctaattgtggctgggctcacagtattctgttgccttattttctttggtgacctcgcagattcatatttattacatgatgatatggctactattgaaatgcagaatatggcgccaagttcagaaaagaaagtaattaataataaagacgaaaaatctgataatgaactggaaaatagttctttaagtgatacagtacgtttttctgacgaagagcctgaattggaggaacccagaaaggaaaggtag

SEQ ID NO: 2342 - DNA, 345 bp, Cryptosporidium hominis
atgggcaaaagaagacagaaacaatcattaaatgacttagatatagcccaaaagttggctttgcctgtggatgaagttactgaagaccctgaatgtcaagaagctatggattatttaaaaagtgtacgggaggaagcaaagttaataacagcatgtaaggtctatacaaatgaattagagagtgataaagaagaaactttgattacaaaagtcaaagatacaaagaataatattacagacaatcagaattctcagggcaactgtaattatggtgactttgaatcatttaacaaactaccatatttcagagaatctatcaataatcagaaaagaccctgcttatga

SEQ ID NO: 2343 - DNA, 708 bp, Cryptosporidium hominis
atgatcaagaaagctagagaagaaaaactaaagattacaaatagccaatttaactctataatgtatatattaagctcaggtagcttttgtaatgagaagggaaaattgcttaatgatactcttctatggtgtaaagatcatgaaaatgataatactgattatatatataaattacatgtatgggcttccaattattattttattcatcaaaatttttccaaagctcaactttatgtgattttaactgaaaatcctgaactttttgccaacattcttattgaatggagcaagaagggttatcaatcagaaaaagatatatttctacttagagctgtgcttgtattactttccttaaataaaacacaatttgcccacgatctacttgataaatactgtcaattattaaacgaaagcaatgatacttctttatctctctcctcatcctttaattctaatattgactctaacataccatctgctccaatacaaatggcattcttcatcatttcagcttgcgagctttcagataaaaaaaccgccatgcatttttttgacataataaaaaataaatatgctcttttaattaggcgggattccagtttttcacgaattattgacaaaattgaccaaatatattttaataggcaaaaaaacgcttcatttaatatgttatcaaaccttctttcaatgttcaatactgatgaataa

SEQ ID NO: 2344 - DNA, 1863 bp, Cryptosporidium hominis
atgctcagagtatgtagggagaccagaccaaatatatgggtatatgctgaacttttcactggtgactacgaagtagatttggaatttgaaagaactctcggatttaatgctttaattagagaagctatgagagctgaaacaccaggatctttaggaaattacgtaagtaactatagtacagctccaattggaggcttatccactgttccaagtttattccaagcagttaattccgagaatctaaataaaaagagtaaccaagaaactcttatatcacttcctatactgcaaggagctaaacctctcaagagactctcatgtccggcaatcttctttgattgtactcatgataatgaaactccttgcgaaatccgtactcctattgacactttaccaacagcagctttggttgcttcaactaattgtgctcttggctctaccagaggttttgatgagattgtacctcataatattagtgtagtatctgaaagacgactttatcaaaactatattgtcaatgttaatggaaacgaaaaaagtcaacctaaaggcaaagaatcaatagaattaagcttaagatcaagatctaatagttttggtccatttcagaaacttgctagtaattatctcacagagccttctacaattaactggaactttggagaaatcaaaagtaataattctaatatctccacagaaattactgttgaatggagacatcctgccaatactgttgaaatacgtggagattgggatgattggaaagaaggtattcaacttgagaaacatccaaacgggaactttatcgcaaaactctttattaggtttggaatgaagccagaacaaactcaaattcatgatcaagaaagtaagaatcataactcatccaaaattatttatccaattaactatcgtctacaatatgaatataagtacattgtagatgggaattggatgcatgatccaaatctaccctatacttcagatgataaaggaaataccaataatattattacactattaaagaggcaaagatctattgctatggtatcaaaatggaagcatggtgatcagcttcctggcattatgagtgccagaaagattcttaataagttacaccaacaaatggctttgtttgggttcaatgaatctcatgtacactatctcacttcagatattttgatggttcagagatataatcccaagatccaagaaaatatttatttcattactcattcttcttttactagaaacaagattgatcaactcccagaaaccattatattggatggttgtattaaagatatagtctttgccggttctttgtttgttccaaactacacttcagtatataaaaatgatacaaatagaatacatggattagattcagaacttcataaatacaagaaacttgaagaaatctcaacctactcttacgatcctgtaaagaatattaccattataaactttaataaattccctcctggatcactagtaatacttcatacaatcagacatcaaggattttctgttactcaaaatgcattatggaattctatagaaatacacaacaaagcttaccaaaaattcttacaaattgtctggaatctgatcattgtcatccttctgatgctatcaattatattctatttagctgtaacaacgaagaacttgacagaagctcaggaagtagaggagtatacaatgttccaaatcttggagattttgtctattgtgggatttatagctgtatacatgcttttgatactgcaagaaaaatggaagataatggtactaatcatccatttgttttacatcttaaacaaggaccttggtatattaattatgcaattcaaagattaa

SEQ ID NO: 2345 - DNA, 516 bp, Cryptosporidium hominis
atgctttcaactcctccacagctaagccaaataagaagagtaaaatttcaaccaacgctatcaccaattgcacagtctccattatcggaaaatctaagtaaatcatctccaaagattgaaaaagaaatgaagaatattgggactcagacagatttagtggaattaaaggcaatatctaaagtttgtgaaaataggatagaaattaaaacaaaagaagattcgatcgatgaaacagaaaaccaatatgaattggacgaaattaagagtattaatactggagaaattatgataaattataataagattaaagagaatcagaaacaaaggataaaccaatttgaaggaaatccagaaaaagatatacaaacaaaaaaatattcactaagagagaattcaagatcaatcacttatactgttccttctttaagggtaaaattaagaagagatacggaaaaaccagaatataatccttttaaaacacataattactttaaaccaaaaaagattttgaattaa

SEQ ID NO: 2346 - DNA, 534 bp, Cryptosporidium hominis
atggtatttagttggtaccttattaataattatactaataaacatattttgacaataccagaaattcaagatttcttaagaaaaaatgatccaacacatagcaaccttgaaattggatcaaaaatttggattggaactgttgaagcttcatatcttttaatgatgtatcttggaatttcttgtaaattgaaatacttttataatattgaagaatttcttaaagattataatgcaatttctgatcattttcaaaatgtctcaacaccaataattcttagtattggagattattcgtatttattagtagcaattcaaatttcaaaagatccttcttctccttttaaccctaataatgtccaatatttgttggtagatccccattatactggaaaagatgaccctgaatctatttataaaaaaaatggagtttcttggaagaatgcaagctttttcaaatctatatctaaagataaatatgtcaatattttattacctcttaatatttccgaaaaagattctcagattatttattaa

SEQ ID NO: 2347 - DNA, 515 bp, Cryptosporidium hominis
atgaaggttgaaaaagttccagacagtacatatgatatggttggtggacttgatgaacaaattaaagaaattaaggaggtaatagaacttccaataaaacatcctgagatatttgaaagtttgggaattgctcaaccgaaaggagttctattatatggtccaccaggtaccggcaagactttattagcaagagctgttgctcatcatacagattgtacttttattagagtatctggttctgagcttgttcaaaaatatattggagaaggaagtagaatggttagagaactattcgttatggctagagaacatgctccatctttaatttttatggatgaaattgactcaataggatcacaaagaacagaaggggaaagtggtgatagcgaagtacagaggacaatgcttgaacttttaaaccaattggatggttttgagtcaacacaaaatattaagattattatggcaaccaatagaattgatatattagatgatgctcttcttagacctggtcg

SEQ ID NO: 2348 - DNA, 1647 bp, Cryptosporidium hominis
atgggtggacaaaaaattaaaaaaggaactagaggagatagtgcaatgtttattacaagagcacaagctataaagcgtcttcaagtatctttagcagattttagaagactatgtattttgaagggagtttatccaagagaaccaaaaaaaaagttgagtggattggataagacttattatcatttaaaggatattatacatttaaaacatgatccaatattatccagaataagagaattaaaaattcatttgagaaaatacagaaaagcaatgggacgtaatgacaaaactaaagctcgttcaattagagaaaataaaccaataattactttacaacatattgttaaagaaagatatccatgttttgttgatgcattaagagatctggacgatgctctttcaacttgttcattatttgcatcattaggagctgatgataattatagtattcattctaatatgatcaaaaagtcaacttatttgatagatgaatttatgtacttagtatcagaacttggattcttaacaaaatcttttatttctataaaaggtttttatttccaagcaaaaattcttggtgagacaattacatggcttgttccacatcaatttgcacaaagtattccagatgaagtagattttaaagttttgtcaacattcttggagttttaccattcattattaaagtttgttaattttaagttataccaacttaataatttaacttaccctccaacaattaatactccaatatttgataatggaggaagattcctttcacttcatgcatataatctttccaaattgaattctaacattccttcgaatattgaacaaaaagtggaaaaaaaacgtatttttgaaggactcactttctttatttctagagaagttccacttcttcctttagcttttgtaattaaaagctttggtggtaaagttggatgggaaaaccaattttcaagtattaaacaagatgatgagggaattacacactatgttattgatagacccattaatttccttaaaagttttatagataaacacccaaattgtgagttcattcaacctcaatgggtatttgactctatgaatgaatcaattagattacctacacgtccttatggccctggtgaaaagttacccccacatctatctccatttgtggatgatagtacccaaggttatattccaactcagagacaagttcttgatgaaattaaggaatccaatactcataaatctcaatcttacttatctgaagatgaatcaacagaaattgatgaactttcagaacatgattctgacattgaagttcaacaagctagagaagatgcttactttgattctattgagagagaacaatcattatccacctcaaatgaaattgattcaattgatactgagcataaagattcatccaattttacaacagaatctgaattaactaatacaaaagataaagtaaatattgctagaaagctcgcaaagaaacgtagagaagaagaacaaagagaacaacaaaagactctactcaaaaagaagcataagaaacttttacaaagaattgaatattcgaataaaattgcttcagagaaggcagaaaggttggaatctcgaagaaaattactaagtaaaaataactaa

SEQ ID NO: 2349 - DNA, 1323 bp, Cryptosporidium hominis
atggtaaattacaagattagtccagtactgtcagagtggaaaaaaactccacaaggtccaggagctaaaactgaaaaagaagaaaaagccttatcaagtttaagacaattgttagaggttcagaataaggcagcagaaaacaagcaaaacttagagaaacaaaaggcagcaaatggtccggtaaaaaaacagtcaacttcagaggctgtatttgataaaattaaacactttgcttcttcagcttttaagaataaagaatcatgtgttatctcttctgtttcatcaccaaacaagccaggaaaaattattaagactcgtcttcttcttaaagctcctttaagcccatatgaattggattggtgtactgatgcatgcttattacgttatttaagaggatataacctcaaagttattaaatcatttgaagcattagcaaaaactatccactttagacgtaagtatgcacctcaatttattagtccaagaaatattagttctggaaataatgttgaaggattgattagatatggtcttgataaggaaggccgtccatgtatatttatgagagctaaatacagcgactctaatattgatgtttctcttgtattgaattctcttttatattcaatggagagagcatgcttgtatatagatcaagtaagtactagtgataacaaaattaacttgattgttgattttactggttataaaagcactcaacaaccaccagtttctttatctctcaaatttgccaaggcaatggttgaccattatccagagagattacatagagcattcatcatacaacctggttggttcttcaaggctgtatggggattaattagtccatgtattccaggtaatactgcagaaaagtttgttttaattgatccagaatctgatggttcagaaagctttaatgcattaaagtcatacattgaagataagtatttggataaggaatggggaggatcttgtgaggatgtttttgatccaaatgaatattggcaaaaagaaaatactgaatttgataagttttgtgaattttgtcaaaataacttttatacacctgaacatcctattccagtcattgatccaaattcaaaatctgcagtaaaagtaccaacaggtgttgatcctactgaagttccacaacttgctgttgcattgctagatgatgaggatattgatccaaatgagccagttgaggatggcggtcatcaacctggagaacctttcaaaccattaagccaacagcaatccgaggagattgaggagaacaatgattttgatgtgttggatgatacaaatacttcacagtaa

SEQ ID NO: 2350 - DNA, 1278 bp, Cryptosporidium hominis
atgggtttaaatacagcagaaggaatggcagattggatcccaccaacaagatgcttttctaatgcagaatcaggtgattcgagttctgcatcaaagagatgttcttattcgacaggattaatgcttaataatagtatgacaggagggaagacagaatttataccagtaaatggtagaagagtgaactggtatgcatgtggccctacagtatatgactcagctcatttaggccatgctagaaattatgtaacttttgacataattaggagagtattagaggattactttgggtacgatgtttatttggttatgaacattacagatattgatgataaaatcattaagagatccaatgagcaaaaaagagaaaattttttagatttggctagagaattcgaacttgaattctttgatgatatgaaggctttaaatgttaagatgccagatgttattacaagggtatctgaatttattcctgaaattattgattttatctctacaattatttctagaggttttgcttatgaatcagaaggaagtgtttactttgatgtagaatcattcagagctgatgaaaagcatgtatatggaagaatggaaccaaagagtgttgctgatgttaatagattattagaaggtgaaggtgaacttggagaacatcttaaggataagaagagtcctttggattttgctctttggaagaaggcaaagcctgaggagccttgttgggatagtccttgggggaaaggtagaccaggatggcatattgaatgttctgtcatggcttcaaatactcttggattcccaattgacattcacagtggaggtattgacttgagattcccccatcatgataatgagctcgctcaaagtgaggctcattatgatcaagcccaatgggttaactacttccttcattctggtcatcttcatattcacggatccaagatgtctaaaagtcttaaaaactttactactattcaggaaatccttaaggaaaattcacctagacacattaggatgcttttccttctccataaatgggatgcacctatgaattactcaccagaaacttctttacaagaagctattgctgttgacaaaacctttgtcaacttttttgctaatgttaaagcgcgccttaggacgtcctacttgaacaactcacagaaacatgatatcgaagaagagaaactcaggcttgcaattgaatcttctagtgaaaaggtaagtttacaatataatctactcttatcgtatttttcccccccatcttga

SEQ ID NO: 2351 - DNA, 213 bp, Cryptosporidium hominis
atgggtgattttactctaagtagaaaaaatcgggaagaaacagaagatttaatcatgcaacttttaaataaagatgaatctatcagattaggctcaaatggcgattttaagcaagtaatagagcatccttggtttaaaaactaccatttgatgaattttcacgaagatagttatttctttgaaaatatagatctaatcaatgatgaaatatga

SEQ ID NO: 2352 - DNA, 1404 bp, Cryptosporidium hominis
atgcgtaaagttttagatgatgatgattggttatcatctgaattacaaatattattcgatgatacatataaatccagtagaagagataaaattaataaatctttgcatgattttgaaaaccgtctttccaggaaacgtgctaacaattatatttctccaaaaattgctttgaatagtagtcaagaatccaatacttgggttgcatttgagaatatttcaaaaggagagcttatattagcggaaaaaccattatgttggatcacaaccaaaattggaaatcatttcaaagattattcattagtactttggaaaaagttgattaaaaaatgtaaaaatgataataaattattgagaaatttgaaattgtttttcccacgtacacaagctgatattaaaaaaattagacaagaatctgagaactacaaaatacctattaaaaaaatcagtcgtttctatgaagctaacccagatttggcaaataaaataagattcaatgaagcacttagaatatatttagttgtaaaatacaatcaaatgtcagttagcaccatgcctgaactttggaaaaatccattttactggactgaaattttctcaatcaattctttatacttcaaatcttcatttttagatcattcatgtagtccaaatgttgctagattctatattggaacagttgctgtatttagagctttaagaccaatcaaaagaaaagagactttatctatatgttatatagaaagtgaatacattcaagatccgctttgggtgagaagtagtgagctcaatttcttttgtagatgcgaattatgtcagaaagagggaagattctcacctgatgaaagcacatccaggatattcgaaattaacaaaatctcaagaaaacttaataaaagatgctcactgatatctaaaaaatatatatatatgcttcagggtttatctttagaagaaagaatctctgttattgaagatattctagtagaaagttttctaccaaatgaacaagttaacttatcaaaggctcaaaaacttgttgggttagatgcttcaaagttaattgggttcttggtatatgattatatatcttataagaatcttgataaagctcaatattggttagatattatgtataaaatgattcatatcaaagatgaacataatattcccgttttaattataattggactaatatcaaaagatccagaaattcaagaaaaatattttagaaaagctgccagaatctcagaaactgtgtttggatcaagtataaaattctttatgaaaagatattggttggatattaaactttttggcaaaatgctatatgaaaataaaagagaaagaactagttttctacgtcatatttcatcattgattagatctatattttcaaagaaataa

SEQ ID NO: 2353 - DNA, 846 bp, Cryptosporidium hominis
atgtcggcaattggtatgtctaatgacttgctaaagttttttcaggcaaggccaccattaccatatgttccatatccaaatagaagaccgcataagccttaccaaggactggctgacctaataaatgagaatccagatttatttgataaggttaatacgccaccagaaccatatataagtaaaaaaatgcgtagagaaacggagaaattgcaaaggattcagaattatatgaaagatatgcgaaaaaaaattgaatcatataatccaatggaagataatgtagataataagacttttgatccatacaatacattgtttattgcaaggttaaattatgatactacagagagaactttaaaaagagagttagaagtttatggcaaaatattaaatttacgaattgttaaagatttccaaggcgaatcaagaggatatgcatttgtggaatttgataatgaagattctctgaaagaagcatataagtcgtttaacaagaagagtattgatggatggaaggtattagttgatgttgagagaggtagaacagttgagaactggctaccaaaaagacttggtggtggattggggaaagtaagaggacaagaaaagccagaatcaaaaagattctttggtggtaacaatagtatttataattatggctcaaaacaaggtaatagtaattatggaaattctgggtttgggcaaacatatagacaaagagaacataaaagctttagaagttatggctataagggtcaaaatgacagaaatagcagtggaggggattataattcttctaggaattatggaaactttggaaataagaagtttaaatactcaaggtaa

SEQ ID NO: 2354 - DNA, 939 bp, Cryptosporidium hominis
atgaattattgtaaactaagatggagcgtaattgtgctcatattagcaattgtaatttcttcaaattattgttttggtaaggatgatactaataataataaaggtaactcaattgctaaagatacagataatagtgaggtttctgaaaaagaagatcatatagtgacacctgatcaagactctaattcggcaaatagtgaaaatttggatgaaggggaaaagaaggaagatggtgataaaaaggaagaaggagataataaagaagagggagagaaaaaagaaggagataagaatgaagatgatgagaagaaagaaggagataagaacgaagagggtgagaagaaagaagaggtagaaaagaaagaagaaggagataataaagaagagggagagaagaaagaagagggggataaaaaagaagatggcgagaagaaagaagaggacaaaaaggaagatggagagaaaaaagaagaggacaaaaaggaagatggagagaaaaaagatggaattgaaaagtttggagagaactctgatattgaaaatgggattattgacaataaagaagattcagtggaagaccaagaaaataccgaaagccagaaagaggaagaaaaaaaagataatggagatggagaacaacaggattcaattcatacaagtattatggagggtttgtataagttggattataaattaaagtttttgagaaggatgctaaggaaagacaaaaaaatgattattcagatacatgctttaggctatttggttaatactataaaagaacagattgtgagagacgtagcagcattgaatgcaatagtaaaattggaggcagaaaatgctagtgaattaaataagttacagtcagtgcatgataaccatgtaaacaatagattagattttattaaacatgaaaatatagttcaagtaaataattaa

SEQ ID NO: 2355 - DNA, 2148 bp, Cryptosporidium hominis
atgaattggttggttgattggggtgtatcttgttcccagggtggatgcaaggaaaaccaagacggctggtttgtgtcaataccagctcagaagaagtccaataataagaaagaaaatcaaagtaagagacagaatggcaatttaaaagatgaaaggttggagaagcttgggttttcacaaggagtgtggaattttgacccaatccaaccaaatttagcaaatgctggcaccttttgccctcaaggaataccatactccaaaaaagatgtacattgtttagatgaaataataaacgaggcatttcctccagttttccctttgtttacattaccaccattaccaccaaaaagaaatggccctggatggaattctcactcgacaggtaataagttagaagattcaaataactcttgtttctttggtcttctagatgggcatggacattatggaaagactgcctctcatgtggcaggttattgtatatctaaaattttaagtaaggaagttccagatattccaagaaatattgctatcgccgattatgttgaacaaattctttttgtcttgaacagggggtttacttatgctcatgatagcgttattaatgcaaatatttcaagcaaaaaagattttggtactacttgtgttgtagttggaatttttgatcaatatctagtgacagctaattgtggtgattcatccgcaatttgtataattccaaatctggacagaaatggtggattccaacaaaaaccaggagagaattctggactcactaactctggtcattataattttggaaatattggaaataatcgagattttagtacaatctataatgataatattagtagcaaaaatatgagctccactagtagtagtagtagttatgatgaaagccacaatagtgttaatgaccaacatattgaaggaggagataatgggaattcaaaagttttacttccagatcttccagttcctttatcttataacaagtcatctggtcaaactacctctaacttccatggaatatattatctttcaaatccccattgtctaaatagaaagagtgagagacagagaatagaccaaagcggagtagggaaagttgtattgggggactacggtatgcttagactaattccttcttatctttcatactcacaggctagggacttgggattgagtatttcaatgagtagatctcttggtcatatgcatctttctagatgcgctttattaccaaccccagattaccgaattttaaacttaggaggtattcctccaaggaaggagtgtattaactccattcggaagcaaactgttgatagccaaagggccaagatagaggatgagaatatggcatgtttttccgaagcgctaattgaacagagcgttattgctattggttggggaaacagaccgagcatttataaaagtaataatcatgttgaaaatattgagttaaactggggcactgatgatgaaagcttttcaaaccatttagctataaatggagggtgcgatggtaaaccgtggcaagattcttatattgtgattatgtctgatggagtcagtgatatattagatggttttactattgctgatattattgttgattctcaagataagagtatgcaagaaatcgctactttgcttacaactgaagctgagagaaaacgaagaatgagtaatattcgggctgataactgcactgtaatcgttgtacacttgagaaataagttttatgaccaaactccaagtgactgcaatggcattttggaatcgcctactaaacctcttgttaatgtaaacttgaataataatatttccattgaaaaaattactctcaaaagtcataatgataaagcaaatacaaatactggcagtaccattaacacttgcgcaaattctgacacttcaaatttcagtaatcatactaatagtatactgagcagtcctacaaaattgaatacttggaaatcatctgaaacccccattcgaagctttaagcccaatccaatgtgcttccatagaacggtaactcctatccaaaggagaaggaagattaccactccttcacctgcaagagcaaaaacttgtaaaatgagagagataccaaatattttccttaaaaatcaaaattaa

SEQ ID NO: 2356 - DNA, 723 bp, Cryptosporidium hominis
atgacagagaaagaagtagtttcaaagtatttgtcctttaatgagtctatagagccaaacttgacacttccaacggcctgtagtgaagttgatttaccagaggatttaatatctaggccattaccgttatctcatgaatggattgtatgggaacaattaaatgtggagacaagaaaagatttagactactcaaatgcaacaaagccagttgccaggttttcatcggttcaacagttttggtggctttggcataatattcctcagccttctgagttattaaagggaaaaagaatgattagagaatcatcagatggttcaaagagtgtagtagatgcagtgattttatttaaagaaggtatccaaccaatgtgggaagatccaatgaatgcaactggtggtcatattcactttagagcttggcaatcatcagtagttcctggagaattagatacaatgtggaataatttggttttggctgtgataggaggaagtttggagaactcttctatagttaatggaattagattggttgataaacttggaggtaataagggtaatattagagttgagatatggttttcagatttttcaaatcaatcagcccatcaagcacttcttaaggaaattgagactttaatgagtagtttgttagatggtacatcttgtgagcctcctcattttgaagttaaatctcattcaaagtcgaaacccgatacaaattaa

SEQ ID NO: 2357 - DNA, 1695 bp, Cryptosporidium hominis
atggagcttttaagattacacagatttaaaaagatttctgttatattcttgtttattatagtaattttactgtttttaaaccttgaattactttatgcatcagatacaaaagagaatgaaggcgatattacagaagctaaaaacacacaagataatgaggagtcaagcaaaaagccagaaagcttagatgatggtgcttcttcagaagctatagggcttttacacagtagcgattttgattcttatattcaagaaaaagaattgaataaggataatcttgaaaaatctccagaaaagcattccacaattaaacttatggaggaagcaccaccagcattagatttagaagaaattccaagattagataacgatatcaatacggaagaaaagaaggaggaacaaaagtctgaatctgggcataaagattcagatttacatttaaaaactatttccactccaattaatcaggaacaggtctcaacttcaacctctagttcaggttcaagttcaaattctagctctaattcatctgcagcagtatcatcttcagcatcaactttggaatctactccagattcattctcaagttcagttcaaacctcgacatttaatcatgattccgcttcaaaccaagcagatgaagaaattaagttagatcatgaggaaagtgaacttaaaactttaagccaagattctcaagagccatactcttcaaaatctcaaagaggtctcagaggctataaagaggaagcccatcctgaactctcttctgtaggaccagattcagattctggatcaaaacctcctgcaggttcagcctcagcctcaaacttagcctcaacatcaaattcaggttcgggattattgttaccaggaacttctggagcttcatcggatgaagttgaacttcaattactactaaaatcttccacagataatcttctaacagtggattctgcatctgaggaagaaaaaaacaccactgatacaggagctaaaactaatacaaattcagaatctagttatagctcacaaacagatgatgagagtgaattgaaacctcagaattcttctcagagtgaggaagaggatggtgaaagcaagaaattgaaatctgaaatgcaagcagaagagtcagagttctcttcagatttcgaaaataatgttgagttcccagatgataatagtaaggcctcctcttctagtgctaaatcaggctcaaccacaagttctactggtagcaatacaaaagatgaagagattacaatcacttttgagaaaccagaagtccaagaagtttccactcaagtagagaatttgacaaaacctcaggaaactaatacttcgtataagtatgtttctgttgcaacacagacagatcccattaaaacaagtaaaagaactggttcaagtaaaagaagagctagaaaaataatgacaaagaaaggtctatcgctgttaattaaagagtttaatacttcaaaaacgaaaaagaagacaactttcttgaaaaaactttttagtcggataagtaatgatgatgttaacctgatttccactcttattagtagagaaattgcaaacagagaaaagaatcatgtactaagaaaggccctgtcaagtaatatcccagaaaaaccacttttggggaaagaatggattcagagagagaggtcaaagaagcaaacaagttaa

SEQ ID NO: 2358 - DNA, 420 bp, Cryptosporidium hominis
atggagcagaattctcagccagattctgagaaaaagaaagaaggcatgtccatagcacctgcttatcatagaatgaattttcttcttcaagttagccaacaatatgcattagtttcaaatgagctttctaggtattgctatagtctagcaagagaaatttctaggaaaaaactagctagaattgatccagattctaggagattgtggtgtaaaagatgtaatactcactttattccgggtattacctgcgaattcatccttgaagataaaattatttccggtgacaataacaataataataaaaagttcgttcaaaccaatatctttaacaggtgcaactattgtaattggaaaaagagacattcttataaagtttttgatgaatttgaggatgaagagaaaaacatgataattgattaa

SEQ ID NO: 2359 - DNA, 453 bp, Cryptosporidium hominis
atgttgcaattaagacagcttatcgataaaagaatactaataaagaaatgtgttccgatttgtcaaagacttttctatagtgatactgtacatgatcattttagaaatccaagaaatgtggggagtctccccagtgatgacaaaaacgtcggaacagcagttgttggcaaggcttcatgtggagatgtcgtcaaattacaagtagatattagggatggaattattaaagatgcaaagtttaaaacctttggatgtggctctgctatagccagtacatcttatgctaccgaattaattattggcaaaactacggaagaagctttgaagatcaacaacaaaacaattgcagatcacttaaacttacctccaattaaattgcattgctctttgttagctgaagatgctattaaacatgcaattaagaattatcaagacaaacagctcaaatcatga

SEQ ID NO: 2360 - DNA, 1677 bp, Cryptosporidium hominis
atgtccaggccaaaaagtttaagatatgaaagggcgattgagacgggagttgaaatattaaggcgtacactaaataagagagaaaatgagataagagcctcattattggaacttaaggagaatgagttaaatttgaagaagagagagtcaaatttagcagagtctttgagggtgttggaacaagagaaaaaaaataatgagtatttaagagtggtgaatgcaaagactgagaagatatttaattctgctatggaaagcttaaaacttaaagaaaaaaaaatgactgaaagtttagactcaataataagtgagtttgaattggagtcatcagaccctgatcaaagtatggatatttttagcaaattagaattacttaggaactatttgctaaaggtcaaaaaaaatgaatcagactttttagagtattcaaagaagattcaagctgaaaaatttggcaagtcaactggaagatgtaattgcggatatcctatatttattataaatggagaagttgtcgcaggaagttcaggatttggttgtaactttgatggagacccagaaattattgagttagagtttaaatcaatggaacttgattgggaaagaagggctttagaacatactaaagaggctttaagacaagaaaagttgagacaggaagagattctacaaagtagggaagagaaaatcaaatataagaacgaagaattggatactagactacgtgaaataaagagaatggaacatattttgaatatgagaattctagaaggggagaaaaacacatcttttggtcgtaacgcaaattcgaacccaagttctgtgtcatctaaaagaaaggcaaggaatggatctcaggcaggtagaaacagttgcccagtacgtgggccgagagaaaatttaagctatttagggaagcaatgtgaatctagtagttttggtttaagttcggataagattaaaaagaaacagaaagaagaggaatacggccttactccgatcaatagtagttcaacttctattaataaagcaaaccatattattatggaaaataaagactttagcaatgtttacaagccagattcagtttcatactccatgagagaagctttaccaacagaactagaaaaagaaaaaaatttggggactcctccttcagaagaatatgaactttattctctaagccagagcgatggagagatactctttacatcaccaagctatagaatgagcccgaacaatactatcagaagaaaatttattgttggaattacagaaacagctgaatcaagttcaaagaaagaagtagatcctccagatagtagtgtaatagttacaagcaataccaatctttcacaaaagacaactctcataaataatttttccgattcaaatactggaaatgtttcttctcaagaaattactccaaattatttgcgtggcaaaacttttagtgatagttcggagaggctgatacctcccagaatgtctcctttactaagaagccagaggcaaagacttaagcagattcttcaggaggaggagaacgaaaataatgaaaactattcagaaaatttacttggaggtgaacataaaaattcgaattcaacagatgtagactatgaaatatttgaagtaaatagttcacgcaaatttctttgttcaacgcccaagtaa

SEQ ID NO: 2361 - DNA, 690 bp, Cryptosporidium hominis
atgactgcaagccaaagaacgaagaaaaacgagcaagaagagacactcgaaagcgacacaagatcgaatcttgggagcagatacgacgcatgggtaatacatccaaaaactatcgaaaaaaaaattaataaaagtcctgataaacgagtacttctaggatcaagtccttgcgatcgtacaaagcaagaccgcaactcaagtagtagcaatactaacaatcactgcgcaagcaactcgacgctaaaccccaaactaaaacaccaaggcccaacagtatgtgcgattgaaaacgcagaaatacaaacaaaccaaaacgcctccgaagcttgcaattttgataaaaaggcatggagcatcgctcatctgccacttaaaaccatgggtatgacgtttttcatgctatatatgagcggtaataacgccggaattttcagcatacttgttgtcagctatgctctcgttaatgcagtaaagatattaatccaagcaaacaagaactttcttgaaatcgagcgcgcagcaagaaagtcgttcaacgtccaaaaagtgctatattgtctatactcactccttggaatagccttcatcctcttcaagctgggcactatgggactcattcctgtcaaccgcggagacttcttttcggatacaccacctcacgcatttccattgtacgccattggtacatga

SEQ ID NO: 2362 - DNA, 1035 bp, Cryptosporidium hominis
atgagattgtcgctcattatcgtattactctccgtcatagtctccgctgtattctcagccccggccgttccactcagaggcaccttgaaggatgtttctgttgagggatcatcatcatcatcatcatcatcatcatcatcatcatcatcatcatcatcatcatcatcatcatcatcatcatcaacatcgaccgtcgcaccagctccaaagaaagaaagaactgtagagggcggcacggaaggaaagaacgaagaaagcagtccaggttctgaagaacaagacggtggtaaggaggacggtggtaaggaaaacggtgaaggagacacagtagacggggaacaaaccgggagtggttctcaagttactccatctggaagtgccggcacagctaccgagtccacagcaactactactccaaaggaagaatgtggtacttcatttgtcatgtggttcgagaaaggcaccccggttgcgaccttgaagtgtggtgattacactatcgtctatgcacctataaaagatcaaacagatcccgcaccaagatatatctctggtgaagttacatctgtatcctttgaaaagagtgaaagtacagttacaatcaaggttaatggtaaagagttcagcactctctctgctaactcaagtagtccaactaaagataacggtgaatctagtgacagtcaggttcaatcaagatcaagaagatcactcgcagaggagaatggtgaaacagttgcaacagttgatttgtttgcctttactcttgatggtggtagaagaattgaagtggctgtgccaaaggacgaaaatgcagacaaaagaagcgagtacagtttggttgcagacgataagcctttctataccggcgcaaacagtggcatcaccaatggtgtctacaaattggatgagaatggaaacttggttgacaaggacaacaaagttctcttgaaagatgctggttcctctgcctttggattcagatacatcgttccttccgtttttgcaatctttgcagccttattcgtgttgtaa

SEQ ID NO: 2363 - DNA, 258 bp, Cryptosporidium hominis
atgtcaaatgcattgagagtagtttgggaaagactcaagaagttttctacaccaacagcttcaccccatgataaaggcaaatacgtattatttggagtattgaacataattatttttggtttggggatgattattattggaatactaaataatgacgcttcagacattatcactggggttctccaattattattgccatttgttggatggatctgggctattgtttggggtattgcaataatttgtagaaacatctag

SEQ ID NO: 2364 - DNA, 1110 bp, Cryptosporidium hominis
atgatgaatgctcccaaaaagtcaataaaagaatgctgtgaaattttgaatcttaagatatccaatttaaataatgatggggaaattaagaaggcttatcataaattagcgataaaatggcacccagataaaaacatgggaaatgatagacaaatgtgtgaggcgaaatttaaagatatagttgaagcttatgatatattaacagatcctctaaaacgtagccaagcagagtatgagtcgagaaaaaaggatattttttcaagaggagttgtcagtggagcaagaacaactaaattcgatgggtcattatttggaggtggggccaagtttgcaagacaaggaactaatccgggattgatacatatatctcataaagagagacaaagttctcaaggctcagttttaggctcaagaaagtcaaaagaaagtgaattaagaaaaaaagaggattatgttcaactatctgagaggctaataaatggactaaattctatctacgaagtagtttctaatgccgttaacggaagtgaagtaagtgtcagcgctgctgcctcaaagattcttgacttgaaaaacacaatcctaaaaaacaaagtaaatataaaaatgtccagctcctttgatgaattgagtggtatgaatcataatgaagataccacccctaaacccgtttttgaaaaaaaacaggtgcttaccggtttaaacaagacaacttcacttgatgatgactttgcttctacaagtacaccttctgatagtacaaatagtgatcctgaaaaaactccttaccttctttcaaaaaatcaaaaaacacctgattacagaatgaatatgttaaacgctccagattatagaactcctaattatattcaacaacaaactctttgtagcggatcagatgggccacatatgttcggaacttcaataaaaaataattcggataaatttaaaccaatttcagaccattttagagaggatatgttggagaaagtctctgtaagacatgcgcacaagaaaataatagaaaaggttaagattaatccagaaggcagccataatacaaaaaaaccatcagaatgcaggttgaccagaggcaaattcataaactaa

SEQ ID NO: 2365 - DNA, 1620 bp, Cryptosporidium hominis
atgtcgaaaattctttgcaatgtgttgttattgttatttatcttcttttcatattgtatgtgtggggatatgatttcagcaataattgaaagtgctagttcagatttacaaaatgctccaactgtaagaaaagatgttgagcttgatatcaaaaacagcaaaccaaagaactttaaacaaggtaacaagagatggtttaaagcaaagaaagatttaatgaaattcactccacagaaaggaattgaactcgggaaaaagatcgctcgtaatgcttctattggagttatttggatttacgagccaggacttttattagcagaggaattagtatccccttgttttggtataataagttattacccaaatatgcaaattactgtaatgaaaggagaaagattcttaggtattatttgtgatgctagagattataagccaattaatactgatagatttaaatggtatgtagctataggaaatgatctcagttttactgcaaggtattatgttaaagagggggtgtatataaaggagggtcaggaacttggtcatctttccaggccagctagatcagttggaagagttgcaataaaatctagagcaagatgttctggaataattgtattgtgcaaaactggtccattggaaactggagaagagttcctaagaatatcatgtgatgctgctacaggcactgctgatgttaacaatagtctagttgataaatctcatacatctcttcttgatcaatcagatatgggaaaaagtattccaaagcttagaggtcttgctcagatttctccagaagaagctaattatgatggtaaacagtttaaacttcctcaaataatgaactctgcagaagaatcaaatattataggagacgatgacggaaaatctgagtctgaagacgaagaagagtttggtgataataaaaatactagaaatatccaaagtactaagaaagaagaaaaaataaaaattcctttagatagctcagacactcttgatgaaagtactccctcatctaactccgagttgaatatcattaacaaagcaattcaaccaccgcctgaagccaagaaaggtaagaacttttttgatttcgaatttgaggaagaagatgatggagtcaatgacgaaactgaatataagaaagtgattcaagaattaggaaataatgaagaagatgaaaagaattctgaaaaggagaaattggaaaaggaaaaattagaaaaagaaaaattagaaaaggaaagattagaaagagaaagaatagaaaaagaaagattagaaaaagaaagattagaaaaagaaaaaatcgaaaaagaaatacttgaaaaggaaagattagaaaaagaaaggttagaaaaagaaaggttggtgaaagcagatgcaaagaagaaagaagtggatgtatcttcatcaatcccaggatctactgattatcatgtcatcttacagactcacaggaatgcaaacgaaaactttaaaaaacagccagaaaagaaagtagaaaaaaaacataacaaaattgattctgtcaaaactggaaacgtaatagatttagatggcttgagttctagtatagtaagcgaagctgaaatcagtactttggactag

SEQ ID NO: 2366 - DNA, 1377 bp, Cryptosporidium hominis
atggaaattaaaatattttggttacttctgttttgtgtgaaatttgcgagggaagtaatacttacaacaggtaatgaaaatatatatagtggtttggtaaaagaactaggagatgaacaagatcttgatcaaacaaagataattgacagtatacgtaagattggttctgatacacaacatacggaaccatttcagccacttttagatgcttctgaggaaaaacaagatgaaaaagattcaattatagatgcagctaaagtagcatctactagaaaaagtgagagtttaccaacttcagctgaaaaaatagatttgataggagctggtgtttcagactccaggaaagatacgggagctagagcttcaggtccagatttcaaatttggggaacctggaccttcaattagagaagaggaactagaaatgtacgtacatccttcagaagagctcatattttcaattcctattcctacaatgaaaccagaacatcagtttaatacaattaggcgactttctggatcaaaatatagaggattgccaaaagctcatcaaaatgagagaggaaatgttaattggtgtaaagttattgccacaagagaacctgaaattatgacaaaagttaataatatatatagaatgatacaatcggacttagttagtgtacttggaggaattggattagatggatcttctagtagtcagggatattctggaagcagagcaggtagtggatggacccaacaacatatttgcgaggggatttatctattaaatacttatcgtggagaaggagattgcgagaggatttttgttgatctaatggcaagattccatggccaatggagtcttttttataagatgtttagacaaaaatttcgtcaaatttgtaaggaagcgggatatagtactggacgctgggatgtttacaatgacagagcctattctcaatatgctgtattaaggtcagcaaaaaagcctatcaaaactgagccaactaaagaaagaagggagtttgttagattacttagaaccagaagtggcatatgtagcttattaccacaaaatcttagggaaaaagctattcaattaaaaacttctgttgacagtattcctcaaatcaaacatattacacagaggattagtttatcagactattgtgatataatactcgggaaacaatcaattatagaatgtgcagaagctcttataacatttttcaagcttaaagcagaaacttattatgacagtactgaaaggtatcgtccaataagaagtttgttaataaaggcttgcgatgacgctctctttcacgaaaaggattcaaatacaaggccagaaaaagttagccagtacgatcgaatggagaataaggaataa

SEQ ID NO: 2367 - DNA, 2244 bp, Cryptosporidium hominis
atgtctcaaaaagaaggtttgaaatatactcttcaaaaatataagccaaagattaagaatgttgcagaagctttgtctattgagataaaagactctttagattcccacttagatttattagataatttgaataataaatttcaagaaattaatattgaaattgttaaaaaagactttatatcaaaacaagacaatatttaccaacagaatctattaaactatttgaacaatcaatctttcaataaaagtatccaattccttgaaaaatctgatataaatgataaggaggagttgatcaatcaattaaaaaatttactatattcaagacatgagagtcaaaatggtattttggataaaataatcattttacataaacttgctattgaaattgaactcactaaaattgtttatttatactctaagaatcaaacagaatcgcgtgaatttgaaagcaaactacagaaatttgtgaaaatgttgcatttattggcaaatttcgagctatttctaaatggatgttttaactctccttatgaaatctctattaccaaaattattaatttaagccaaaattatgaaacaagttctacagatactcgatttgttatttatccgaatttactatttgaaaaagagctatgtgatctttccgtaatcaatcaaaatgaaaaggacattttaagtaaaagtgaaaaaactattacacctgttactaatcaacaagagttttgtacaaattcttatgaatctgatgaaaatatatcattcaaccaaccagagactttgaatcaagtaaaagtcagtaatgaaagttctttattactgaatgataaaagtgattcattgcttgaatttaattccctcaaaagtgttaaacaaaacgaagtatttaatcaaatttacaatgataatcaatttaaagtagaaatcgatataatttctcctattcttagtgttgaatcaaataaatcacctagaattggaaattatataattaataatgattttaatcaacattctgcaaataaatctcacaattctattgggaatactcgtgagacatttaaaattaatgatgaggaagtaaagtcacatattaataatatacgtattaaacaaatgcataaaaatacgattatagataaaagaaaaagttacaaagattcaaaattgaacttagcatcattaagaaaatgttttgaatatcaatacgtttgtttactagcaagacatttggaagatgacgaaattttggaactagacagttacttattttcttatggagttaaattacctctagaaaaggattctaatttaatttggtcaatttcagaaagcttagttgataattttggtgcaagaaaacggctaattgaacacgtctcacagaaaattattgattttactttgtctataggccgtttaaatactgaccctttaatgaatactggaaatcaaaggaatgatcaaatagggttttatagggaaaaacacatcgatattctttcaattttaattgctttaaaagaattcttaaattctaaaaactcacaagaaatttctacagccagaataaattttattgataaatttgtacctttaattaaacgtcattcaaacaaaaaattcaaattttctaaaaattcagaaacaaagaaaaagaaaactgaatatgacttattaagttatcatgccagcagtagatttataaaactaagagactcattcgataatgatggtgaatcaaagtgtaattcagaaaataaattactacctacaaatattagtgagacaataaatgaaccaagtctttatgaactatgtactagatttatcacaactctatcaattaccaagtcagttaaaagtttcaatgataattcctataagtttgctcagaaagtttgctcaatgatttttgaacaacctattcataatatcttaagtagtcaagattatgcatggcttactggatttactttggttagaacagtaaattatttaattaaaaaacaaaatcttcctgaagaaatttttattgatcatgaaaatgcgcttagggctctaaactattcattctcacagaaaatttacaattttcatcaagcatgtacacaatctcttatttctcaaaaaagtaccgctatttatcgaaataatatttcactacatttaattaaacctttgatgaaaatatcatgcgcagaatattttggaattagcgtatttttatatgaaaattag

SEQ ID NO: 2368 - DNA, 2226 bp, Cryptosporidium hominis
atgggattccagagaatgcaacatttttacaacggctatttaccaagtatcaattgtggaacaagcagctcatcaagttcagcatcatcattcgctgcatcaaatagaatagctaatacaggtagctctccaaacatatccctcagtaacgatctcaatccgtatttacagcagaccttgaataaacttccggtagctttgaacccaaatcttccgtatttacaacattcgatgatagctttcgcaaaccgaattccttatcaaactacacccgaagttcaaactaacaatccaaatttaacagaactgcttgaatctataggctctgattttaggttagatcagaataaatctaatgaggaagagcttatcagttctggatataatggtagtttgtcagaagaacaactgaacccaacggattttacggaattatccagttcgggctcatccaccatttcttcttcctctatgactgacgcattccctacttctcagtctagttcatcattaattcaaactattgatgaggaacatctaactggtatcattaaaacgactatatccgatagttccgtacagaaacctcttcaaaccaaaagagaaagggctgtaaggactagtaagaacaaacttagtggtagcagttcccatggtggagtaggggcgagtagtagtagtaatagtggaggaattagcgcacaggatcttgacaaggcaattagccttacaaacaaaggctttcgtagcctatctctcaaaggaatatactatgaccggaggaatcatggttggcaggtacgtattcgcaaaagacaaaccgaaatttcaaggtatttctccgcaaaaagatatggagttgaaaagtcgtatgaaatggctcttaggttctatcaagttaacattattggaaactttggaaatgaatcaaaatcagtcaggaattctgagaactctcgtagattagatggaaaatccgataatcaggtatctccaatcctttcaaaggacggccagaatgagttgtttgaacgacaaatttctggacaaaagagcctcgaaagtcagattaccgatagcgcttctgtaaatggaaccaatatttttaagaatattagttcgaatagtaggatatgcaacaattctatcgatggatcattcaaaccacttaacactgactccgttcctttaaatggaaatttaaataatctactatcgtttccccttcagggagacttagatgtcaacagtcaattactttctcattacataactaacaatatccttaataacattcttgtgaatcaaattattgcgaataatttattcgcaaataccatgatgaatgttaggaacgcagttaatttacagggaacaacaggacttccaatccattgtttctctaaggtagctacccctcaaccaccagctcaacaatatggaacgaattttacgacttgtgtaaattctccaaatattgttccttctactccaattattaatccgagtatgggaattgtttcttataacaatgactcccagctgatgctcaaagatatcataagcaatgccctatctgactctgagggcttgtggaagggaatttactatgataatcgcaacaaaggctggaaattatgcctcgacggatatgcagagaaattttttggttcgatggaatttggtgaggttgaatcactaacattagttctcgcatgcaaactgaacgtatttaaattcaattgtgacgtgtcccaaatacgtccaacaatctcgaacagcatagctgttcttcaaaaggttatggcaataaacagtgaagcttctcatgaatcgccattaagcgatggcaaatcttttatcgaggatgagggtaaaaagacagtaaaaaatcttcttgattcaacgctgcgtgaaaagatggacagttttagtttaactgaactgactgaatttatttcagtttcccagcaaatcaagcagatcatcaataatggtcttctaaggtctggctatcaaactttatctagcattaactataatgaagggatccctttcgtacagccaatgactacagataacttaaaacatagccttaattttagacagccgaacttgaataacttttttgatagctcagcctttttgcaaagcgttaacaataatcaatctctactttatggtcaatttctattgaacaatcaaaatcagtttggaatgttgtaa

SEQ ID NO: 2369 - DNA, 690 bp, Cryptosporidium hominis
atggcaaaaagcaaacataataagtctctaaaaggcgaaagagtgggagcagtcgatataggagggagttttttaacaaaagaaatcttaagactagaaaattcgatcaatacactttcccatatttcttcagaaataactgagtcactttacaattttatttctgcatttcacttcaatcaggcagacttccctgactcaaatgagttctctaatttaagatcagaagctgttgtaaataaactacaaggaagtctaaatgctatgcaaaataacaacgcaaatcatgactacaattaccaagtacaatcttcgaacctatactctaatgctttttcggttcaaagcacacacaatcccgcctcttgcgcaaatgcgcaattttccacgcattttaaaaacgggaaatcaattgagagccagatacatggtaacggttatttggatgaacagagacaccaggaacagtttaactcggaagttccaaaagtacagtcttccggaaatgaatacagcgttccaacacaaatccccaacaacattgaagccaacaatgcaataagtaaccctgaattatatatagatgatacacctttacaaggtaaagacacgaacttcgatgatgcaagccgcatcgaatataatggggggaaccccgaatgcgagcacaacatacgaattcaattctaa

SEQ ID NO: 2370 - DNA, 2127 bp, Cryptosporidium hominis
atgagaaatgaatcaatgaatagaatagaattggactcgaaacagaaagcttcaaatacaaaaaatagattagaaattaatggaaacaaaatattggaagagaacactacagacaattcaggggagaagcaggaagcatcaaagccgaatttgcaaattgggatgagggaagagatcccagaaactgaatctaaaaaggagaatgagagtaatgacattggttttgtggatgagatgattgctaaggctctttcaactagaaagaagaaacaaaactcagattctggaattaaattgcgtaaagttgaaaattccttgaaaattgatgagaatgcttcaactcgtagccagatctttactgaaagaccgttttttcagagattaacagactccatctataggagattaattattgggtcatctaaccaaataaagcttgtgggccttatttcggctgcaagacttttagtgcatctttatgaaagtaatactcttgaaattccacaaaatgaggaggttcagtatcgtattccactcctaaattgccatgtaggcgattggcaacctgtagattctgatagagtagttttttctaaatcgagcatatctaaagatctactgggttgctctaaagctccccatgctccaccactagtaaatagaacacgaaacatttatatagtcactcctttaaactatgacggaaacaaggtcggaggcggatatagagggggagggagtgaccctctttcgcgactggtcatgaagtggcggaatttgagtgtttccgatatccaggattttacctatattactgaaaacggttttgaccttaagtacaatggcttctatatcttatatgccaaatcaaataagcctgactcacaatggaaacagttctactccgcaagaatgagaaccaatgcattcaatagccgccatcaaattctgataaattccacccacttgtctaagctcattaaactccacacagtgcatctacaaaaagatggatctgacctaccaataggaatggccctatttgaagaccatactgagtccctcgcaacagaagacatcagaaaagattattctttcaattcaattgctgagatgaatattgcaacaaactcccctaatgaacgtaagcatcctaaagggattgataaacacctaaaaactagccaaaacatgaaggatgatgttggccatttattagaatcaagcaaagatatggagcttaagaatcttgctcaaacctatcctggcctaatttcttttgggaaccaaattttgaaacaagttaacaaagatacacaaattgcaacaggctcagagaatggaaaaacagttggaaatatcgcaagcccagcgacagctaatggtagtagtgtaataaacccagggcaaacatttgaccaaaattccattttttctcagaatcatgtcccttgctcgaatattaactcaaacttcgctaaagattctctcgagctttcactactacttaactttagatcccttagtaccaaactccaaactgaaattttacatgcaatatcttgcattaagttccttaatcaagatatgttttcagctgctctaagatctgcattagacgctgcatgcattaataatggaagtttgtcagaaaatggattggtatcttctaaagggctagggctcatgcagcctatttccaatgtccaaaatacatttgataaaacaaaaaatgatcttcctttatttatccgactccttcaggacggtagtacagaagctgttctaagttcaggctgtggtaatgtccatccagaatctttcatgccctctaatgagcctagtaagtccaacctcaccggatatgccggaatagatagttcgaattttggattcgcttcaaatatagggaatgccttatttccaatgttctggtcgtctttcttagcttctcaacagtttaataatacccacagttttatatcagataagaatacaagtaaaattgactcattcaacttaaacaattcagttgctcctgaaacaaacactaataacgtggataatcaaaatgatgtccagacctcagcaattagtactccagtatgcaagccaaaagaaaagtaa

SEQ ID NO: 2371 - DNA, 738 bp, Cryptosporidium hominis
atgggctcaggctcggaagttggatttatcgctccaactgctgaacaaaactacaataatttactagaaatagcgaatggagccaagtctgttaaagttcttgaaatacacaaaaatgaagttttatctccagtaaaagaacctaatattgaaaactatcaaaacgtagttcatgggacgtctgaagaaaaagagtcaaagataatgagtccagagataattgagaagcaggagactaataagccaaaagaaaaagaatcagagaaattaaaagaaaagaaacctgaaaaagatgttcttataaaaccagaggaaagcgttctagaaaaaaaagaaggaaggttcctatttaagccttttgcagagattgcaagggctgtaggaatacctgcgcattcatcatataaggagaaatctgaattgtatatttcgttcaatggaatattagattctacaaccttgttggaattgtactactttgactacgatagatttgtaataagcagaccaattttagatggaaaagaggatgcatggatatcaaaatctcttctgtcattgctttataaatcagagcaagaagaacctttgtcatttctaatgttgagctatggaattacatcaacccactggcaaaactttataccagaagaagatctagaagcaccagaaacggtggttgaggaggcaatacaagagcatgaccccagccgtggagatattattttcgataaataa

SEQ ID NO: 2372 - DNA, 933 bp, Cryptosporidium hominis
atgaaaaagcttaagaaaaaaactataaacaaaaattttttatctcggattaatttaaaatattatggtaaacacagatcttctaatgccaatatggatttatttttttctgatgtactggcacttaagaaaattattaatgcacacaggatcccaaaaggagctaagattgaagattggaaagaatttgttattgatgaagaaagcatctcttcttttattttggatcatttcaagaaaccttcagaacttaaatctttttgtagaactttgttagaaagaaggcttagagatggagaaatccaaatctttccaatatcaacagattcaaataaatatacagattttttgttaaatcagaagaaacaaacaaaattattcttcaaaaagcttgtaaaggacgataattctgatgcaaatctcaaagaaataagcaaattattaatgtttaaagatgaatcacttttggagttcccagaaactattgcaagtaatttcagagattcaattctaaatgagagattagaccttcaatttaaaaactttatccaatcagacatcaacgattcttgtgataaagtttcgtcactcttttataatacacttaaaactaaaaataaaaagaattctcattgctgtgattactctaattgttttaattttttgaacaaagcagaagatccagaatattgtgtggttaaaagcacaaaagatgatagtgaattggtagaagaggcaattgagtatggacttaagattattatgaataacccaaatataaagttaaattctagatcttatttacacaatgaaaatttgcaagcattggaacagaatggagttacattaaccactaatttacttgataaaaactttatcattaataatgcaagctttatatatatttatttatcgagcatttctcttccataa

SEQ ID NO: 2373 - DNA, 354 bp, Cryptosporidium hominis
  misc_feature (350)..(350): n is a, c, g, or t
atgaagaatattttattaagatttttctgtcaagcttttaatagggaaataatgcgcgatgcagatcatggtagaaatccatttttcgagtgttattatttcagggttgaaaatgattctctatatagagaaaagagacatatagaaggtaaaactgtaaggtattgtgaattcacagggttatcaactaatgcaagcaactttaaagaagaatatttattacataaaaagtatttaaagttcttgattaatggtgaggaacatttttatccattcattagtgatagatatatgttgagtccagaagtgatagtgagaggtattggaagaatttatggtttattgtatgnttaa

SEQ ID NO: 2374 - DNA, 549 bp, Cryptosporidium hominis
atggtgaaagatattcgtctttatgaaataattggcgtatctccagatgctggtgctgcagaaataaagaaagagtataggcttagggcacttgctttacatccagataaaaatcagaatgacgaaaagagcaaggaaaggttccaagaattacaaaaagcatatgaaatattgagaaatgaagaatctcgcaagctatatgatgagactggcataattgagggtgaggaagggaaaagttttgatgacattattaattattttaaacagtttaccaaaaaaatatcagagaaagatattcaagaatataaagaacgataccgtgggtctgatgatgaatgggaagatttatcaaatttctacctacgatttaatggaaattgcaaactactgcttgaatatattccattttctgagccagaggatatcaactattatgtgagtatgattgaagatgcaataaaagatgggaggcttcctcaaaaaaaagagtttaaaggatcaattaaggagttgcatgcccagggaaagggcaggaaggcaaagatc

SEQ ID NO: 2375 - DNA, 816 bp, Cryptosporidium hominis
atggttttgtatctaattggaacagggctaaatgatgagagggacatgactttgggtggtatagaacttatgaaggcagccgataagatatatttagaatcttatacttctattttatctcagagggcagatttgatgaaatatacaaatgggaaacctcttatagaagcagaccgtaaaatggtagaggaaaattgcgatgaaattattgaagaagctaaagacaaatccatagtgctactagtagtaggggaccctttttgtgcaacaactcattctgatttggttttaagagctcatgaaaaagatgtcaaggttgaagttagacataatgcaagcattatatctgctattggctgtactggattacaagtttaccgttttggagaaacagtttcgattccatttttcgatggaagttggcagccttcaagcttttatgataaaatcaaagctaacattgagagaggactacataccctatgcctacttgatataaaagttaaagagcagaccattgaaaatatgatgaggaatagaccaatttttgagcctcctaggttcatgacggttaatcaagcaatttcccaattatttattctagaggacaaacttaaacaaaatgttatatcacccaattcattagcaataggggttgctagaattggctcaagcgaccaaaaaattgtgtcaggtacattaagtgagctttctgacactgattttggaaatccattgcattcattagtaatttgtcatcctgatttgcatttgattgaacagcgtttctttgaaatatataggaaaaaaaagtaa

SEQ ID NO: 2376 - DNA, 690 bp, Cryptosporidium hominis
atgatggaaacagataatggaagaattctctgtcgttctgaggagatttgggagaagcaaccttcaactaacgaaggcatgctagatggatttatacacatccatgaaatagatatcgacaatagcacatattttatcgaaacgttaaaaaaaaagctttgcatgaaaaaggatgaactttttgaatacggagtagatgcagggtgtggaattggtcgtgtaacaccgaatctaatgaaacactgtaagaagatggatttgaatgaaccgatacttaaacatttaactgttgcaaaaaaaaataacccagattgtattgaactaattcattcaaaactccaagactttaatccagccaatggaagatatgattttatttggatccaatgggcactacagtacttatctgatgatgagtttgtagatctccttataagaattagaaattcatttgataattgcaatgaaactagtgcaaacagaactaaacgagttgtatgcattaaggacaatgcagattcttatgaagatgaagtagatccaattgatggaagtattattaggacagaagaaagctttctagaaatttttaaaagagcaaattataaatgtatattaaagatggaacaaacatttctgccaacttcatttaagccaataatttcatttgcgattgtaccttgtgaatag

SEQ ID NO: 2377 - DNA, 387 bp, Cryptosporidium hominis
atgaaacaatccaactgtgagaaagagaaaaacttaattgagagcatatcacttaattattcttgtaaaattttagcttttattaatttgaatggctgtatattagtgaaaaaagaaattttaccaattaatgagaaaacaacaataattcagcaaatgaataaatatagactaatgctgaaaagtgttacactcaagacgaaaataattattggaataatacttcatatcgtattattcattattgcattggtatttactagaaataggaagtatcataaaatgactttaaaaatatatacaaatacgaaaacagaaagcttggaaataaattcggcatctgaactcacaacaaaggtaatgttaaatacttcaaattcaatatag

SEQ ID NO: 2378 - DNA, 948 bp, Cryptosporidium hominis
atggacaaagattttgattaccctttagattggagggaatttttaaatcggatactccaggaaagtagtaaatgccagagcaagataactagtgtattattaattggaccaaaaaatagtggtaaaacgacattttgccttaaaattgcaaaagaatttttaaatgataaaaggtacccaaataataatatttatattttagactgcgatttgggtcagcctttagtgtctccaatgagctgtgtcaaattagtaaaatgggatataaaggatatttgcattaaaaactcaaaaaacattaatatttcacctgaagtaatgttttatatagggggaaatagccctattactcatcctttaaggtatataaaaggattaaagcagtgttttgaatacgtcaaaagtattgaagaggaaaatataatacttattctaaacatgcctggatggattacaggcgtaggattagaaatctcttcgattgttactgcgttttccattgatatttcaaataatgtttatattgggtttacaagagaatttgaacctaatactaataattctgaagataatttttcttgtatgacgagcttctattctttcccagtttttgacctgaattcagtgaaaaatattaaaaacgaggaattttcaattaataaccaactaaaaacaagaatatttgtaaatacattaagtaatttatattcaaatatagagataaaggaaataaagaaaaatgttaatcccctcattttttttaatgaatatatgggatattatttatcaaaaaaacacattccccaatatttctgtaaaacagtacatttcccattcagcaccgtatgcataatcccttgcccaagtacaaccttagcgagtgaagaattgaaattacacataccggctagattaaccaattcaatagtagctttgtgcatttttaat

SEQ ID NO: 2379 - DNA, 513 bp, Cryptosporidium hominis
atggatagcaaatctcaattgaaagcaattaaaagaaaggtaatagatttaataataaagcttggagaagatgagttgatacttaagcaaacagccatcacaaatattggtatacttttgaaagaattaaaaactaagccaatagaaaatgttaaacaaattttggtggaagtgctaatgagcataatagcatactcatcagtagattccggaattcaaaatttagatcaattagtctcagatatcccaaaaattgcaaatcttccaaatattattcgttttcaatcaatgacagttcttttagattcttgttgttataatgagctcgatattattaggaggttatcatctatagttgttagtggaggtggaggtggggctgaaaactctgaatattcgattccagcaaatgtaattagaccgcttttggagaatatagtaaaaaaacataatgatgattcacaggtcattaatgaaacagtcaactttttgttttataataaagaatgtata

SEQ ID NO: 2380 - DNA, 1224 bp, Cryptosporidium hominis
atgctttctttcacaagaattgttggagttgttttatttacaagtgattcaaatttttctcttttgtatgagtttattattaatatttttgagacattggaaaatttagacagttatgaaatgcaaattacctcgttttttgttaatttgaattcagtctttaattctgtagttgtttcaaaaaaacctcgaatttatgttaaaatagaagttttgataaattcattgggagaaatatcttataaattacacaaattttataataaaccaattctaaactcttttaaaatgttaatcaatacaatctatgattttttaaattctaataatcagaaaaatatcatttcaaatctatttaaaaacattcatccactccttcttgatggacttgtacttgaaaataaactttctatcaacattattcatgaattttatctaaatctcgaaattgacgaaatcaattatgaaataatatctttggcaaatttttattatttatattcgttgaaagataaatcagccgagacagaaattttaaacttcttatataaagactttattgagtctggaagtacgtctataaagcgtattatggtaataactagtttactttcattcatactgatgcctgattctacttcttttccatttaactattgttcgaataaagatccaaaacattactatattgctaattctgaaaaaaatttattgaataattggatagacctatgttacttatatttacttgatttagaagataatccaaaattaagagcttggaatgaactttttattaataatgaaggaatcattttcatgtcaaaattttactatttaattaaacaacaactattttcgagcattgatacaagcttatttaatgaaaaagatattatttccttctctttatatgaatttccggaaatattcttatttgaattggattcacaagtaaattttgatacttggaggaagtcaattccaagtttaatttctcattcaaaatataaaaaagttaacattgaactgcctctaaaccaatatagtaatagatttttacttgaaatttcccacaaaatacttttcaagtttagtatggagaatttaaaaacttcacttggacaattcaaagatgtattaaatgtcattataaaaaaacttatagaaactaatgatattaacaaattaaataatgaaatgagtttgaataggccttattag

SEQ ID NO: 2381 - DNA, 1761 bp, Cryptosporidium hominis
atgtattttttagtaaagttgttggcacaaataattacgagaacattttttaaaaatgttacagttttgggtaaagagaggatacctctatatggcccagttttgtttgttgggaatcatatgaaccaatttgtggatgcagcaatgcttattgcgatttttccacgtcaaatacggttcttaatagcagaagcatcgtttaaaaggccaataattggtagattagctcaatctgcaggttgcattcctgttcaaaggccacaagacttaagatatagaggaataggtggtttaatttggagtagctcaagcgacgtaagaattagaggtattaaaacaagatttaaaatagacgtaaaattccaggatacgttaataatagacgatctgggggtctctagaaaagtattagaggttgtttcagatgatgaaatcatcatcgataagggaataggtatagagtattctgcgacatatacagatggctttcctttttttataatgccaaaaattgaccagagcacggtatatgaagaggttagtgatgcaatgagaaatgggcattcaattggtattttcccagaagggggatcccatgatagaacaacgcttcttccacttaaaccaggcgttgcagtcatggctctttcttcggtattagagggggctgaggatctactaattgtccctgtaggattgaattactatgaaccacacaaaacactctcaagcgcagttgtagaaattggccaacctattcctgttacattggaactggcccaaaaatatgaggaatctccgtcagacgcagtaaaagaattattatctatggttgaaaaaggaatgaactctgtattactttctgcaagggactatacaactttaacatgcattcggctttgtgtccaattatatccaccagacagaacagctctttctcaagataattactatttactccaccaattattttcacagtttttttgggcactccatgatgatccagaacttgaacatttaagaaaagatttatgcgaatacgaggatactattaatcactatggagttccagatagagaagtttggcagcttaaacaaccagtttacgaatgtattaaattaattatcaccaaatttcttcttttaattctggttagtatagttggaggatctttctttcctttgtgggcaccaattaggtatattcctgcatttatggcagaaagacacagaaagaaagcgttggcaaattcaaaggtaaagatcagggggacagatgttttagcatcgtatagaattcttgtaattattgcgttgctaccaattctcacagttttttatggtatattcttttcattagcatttatgcatggccagaacttgaattctaaaattgcaacagttattggcgtctttataatgttgcctccactattttatatttctagagtttcttttgaaatgataatgccattaacgagaaatattcgcactctgttctatgttgtagtttctaatattaactatttgagaggtaccgaaagaacactgttacatatgagaattaaattacagcaaaaaataagagatctagtatacacaaaaggaccccaagtctctcctaattttattcaaagttttactactgttgttccagatgctgtaattcaggctgataataaaagaataaactattctcttggagagtatgttcctgttgtaacacgcgcaaagtatgatgcaagagaagagatcttataa

SEQ ID NO: 2382 - DNA, 1827 bp, Cryptosporidium hominis
atgaaggagtcaggagatccccagagaattatttttagaagtttactaatatatttgttaataattgtactgaataatgaattagggcaaactatattatcaaatattgattttcaatacttacttgtgagactttgccacttattttctttcagaattgaatgcctagctacaaatgtttacaataatattgaaactgatgggacaaatgagttaattaacgcatttgatggatttagtactccaaatattagaagaactccaaactcaagtaatggtgatattaacgatcaaaatataacgcccatttctgtgtcatctaaaaaatcatgtaatactatcacaccgattaataaaaaaagaataaccccaataattatttcaagaaatagttcttctaataagaggtcgatttctatattagacgagcaaactaataatggtgcaagcaaagcaacttacttagctttgaaggaagatacaaaatcatactcatgtatttttcaccttaaaattatacttaatgctataaatataattcgggaatttattccccaagatttaaacattattaataatgattctgttggaggaaaaactattgggtttcaagattcgaatacagaatttgttctaaatataatggagaacagtttgttttttttgttaccatcaaatacaatttctaaaaagtcaatatttaattttaataacataaatggaactagtaatgaaattaattatcatgggttgagcacaattcatgaaggttctgaaagtagtgaggcagaagaaattgagaatttgagcgaaatagacaaacatggttctaaacttagaaattcaaagtgcaaaatcattgttcaaacaaatattccgtatttactaaatgatgacgatttctcaaaagattggtacatggaaataataatttacttaattaagtttattgtcaacaatactcagtcggttaaagacatttcaagtattattactgatatcgcttcaagaatagcactttggagtcgtaaagaaaacaaggtacttatctttaatgtctgtgttgaagttttaaaattttcccatgattatttttatgacgaaattccagaaatttctctttgtatcctcaggaattctggttttcaattattacaatccattaaatttgtttttgttgcaattcttgatcaaaattcactcctaatcaataatactttaagtgatttaccttcaataaatgcaatggctgaacttgagtctcttaacaaagcaatatttgtttttaatagattagttaggatttttgaaatgtgttttcaagttatttttttcaatggaaataatttaactgagaaagataacctttggattagaaatgctatcaatttaattgaaatgggtattgaaactcttagtacagaactatcgaagatggaaagaattaaattacctccaaaaatggatgatgaagaagaattttttgatgaagatgaaaatattaacggttcaggaaatttagaattaaaatgcacatcatcaaatgaagtatggagcatgacaattttagattgtaatgatatgttaagagaatgcgattacatacataatataataagttctaattgggttgaccccaatagcttagatcagtcagggtctaatagaagaaacaatcgttgtaatattaaggaaatagacgatgaccttgataattttattacgttcgaacaatgtgacgaaggaattcttcaagagaatgattcatattctgatattaaactaactccacattggaacacatttattaaatcgctatttctatag

SEQ ID NO: 2383 - DNA, 627 bp, Cryptosporidium hominis
atgttaatcgcattttccgtatgccttttagcaacgatcattttctgtaattttgcactgattttttgtagaagaataccgtgcgaatttgaaaggaatcgagatgttgttcgtcatagaaatagcttttcaattcgtatctccgatagaaattcaatagtttcgcaaacaatcagcaatgaagaactctcaaaaattgccccagtaaaaaagtatagttcgctttcaaataaacattatagaagagagtacaatatttataataagagcagctcgttctctggatatttatcctctggttcaacgcataagtcaaaaaacaactattcctgtgtaatatgtttaaataatatttgtgatgaagacctagtgagaaaacttccttgtagacacatttaccattttaattgcattgatgagtgggtaaaaataaagtcaaattgccctctatgtaatatcaatcttacttcaatttataatcaaaatattcgggatagagaattgatgcattcgcctaatcgaattcaaaactatgaagaagtcgaattttctgagatatataattcaagcaacttgctgaatgataagcttttagtttcaaaattcgatgttttaattaaaaattaa

SEQ ID NO: 2384 - DNA, 1065 bp, Cryptosporidium hominis
atggtgatatttccaattaggtacataaggaatacattggtattatttattattttttttattcataatataaactgcaaagcgcaagaaaaacccgaaatggcaaattgtccaaattatggatcagtttcacatgggttcctgtgtcttggcctaaataaattgaaaacatttaagactgaatcatggataagctgtgcaaatgaatgtacaaaacattctgcttcatttaaatataggaagtgcaagtattggtcatggagggcaacggatttttcgtgtagcttaaagtctaagtcatctcgctgctcggcaagagacgattcatatgtatcaggaacaatacctacatcaatggccggatactgctctacaacatgtgtggtgggggaatggtcaggatggtcaggatgtactcattcaaggccatgcggaggttattctgagcgtatgcgaaatgttattttttcaccgatgttcccaggtgaaatttgtccgaataagagcgaattgaggtcttgtaagcttgataaactacgttgcccagcgaattgtccagattatggaatcgttactttgggatggggctgtagtgcctatgaaattccaggaggtggttcaaaattaattcaaaatatagatattaaaaaatgcagggatgaatgcattaataataagagttgtgtgtattggtcttatggtatatgggaccaaacaattggtgaaagaagcacttttcccaaaatagaaatggtttcaattgaagatgggactcctgtttgcattaatgtttataaccatataggctgtatgtttaaacttgaaggttgggtttctgggaattctgagaccatcatctctgaaaaagcttgctcgatagattgcgccacatccatgtggtctaattggtcaaactgtatttttaattcaaatgatggacaaagttacaagaaaagatataggtctataattaccaaaaacaatgacagtggattagagtgtccagacctccaggaaacatcattgtgcgaaaccacgtcaaacaatgagcgttttaattcgtaa

SEQ ID NO: 2385 - DNA, 1296 bp, Cryptosporidium hominis
atggaaattagtgaaaataccttccaagatgttaagctagataaatttcctgatttggatggcaatccatttaaaagaaatgacactgctgttagcgaactttgtgactccaaatattcaattgggaagaagatttccccggaaaatagtgatcactataggccagaagataacaaagcaaagcaatttaaaagtgatgaacaatctgaaaaagctactaataatgaagatatggaaaatcttaataatgccagtaatctagttgatgtaaaggggtctcaaaaaccaaagaatttaagtgatattagtttagatcacgattcaaatatggagaatagccaggtttcagctaggataataatgcttgatttagataatacattgattcctacaaattggataatgcaaacatggagaaacattcaatgcgaaatgggcaatgaaggtgatagtatagactatggagaaaatgaaagcagcctttatgagctaactgaacaaattagaaatgaattagttcaagtaggattatttgatttacttgatcagttcttttccgatctctggagtactggaatggcatataaaattgtaataattacaaatgccggactgagaactgtagaattattttatctaaaatactgccttccaaagctaggtgatattttaaagaaatataacgttgaaattaattcaacagaagagtatattagaaaaaaaggccctcctccatctcctttcagtgaggaggaatatcgagaattttatacaaatgcaaaattacatgaatttcaaaaggtattattagattgctgggggaataacttagaatgtaatgatgactttccttccatgtttgatgttatatctgcaggtgatcaagcttgcgaaatgacagcagcttgcagaataagtaaattttatgaaaacaaaatacgtcgcacaaaactaatttatattcatgatccggaagattttcgattctggaaacaaaagcctgagagctttatgaaacaactttcagaaacccacagagaactattaaatctacttagtgatgattcagaaactttgattggttgtagtgacatgaattcaacaggattcacaaatttggaggaagaaaatgatgaggaatttgaagaggttgcattaggatggtattgtaaaggtaaatatattaatattgcaataagcaagcctgaaagatttgtgttaccgcaaggtagtagtgaaacttatcttgaaactgaaagagattattttgaaaaagaagtaggtatggctctttag

SEQ ID NO: 2386 - DNA, 759 bp, Cryptosporidium hominis
atggcattaaaaactaatatttcgatcgtaatttctgattttatatggaatacatattatgatttaataagtagtatattttatggtaaaaaataccatccaaagtcaccaagaccaaaatttacagtgaataaagttgttaagttagtcctctggttattgggttggctttcagttacttttattataccactttgcgggattatcttggcttatagtatctcgccaagtagagtcgatattgttcctgcagttttcgaaaaaaactatttggtaatatctcaacctcttttaagaacaaatagtcaatcatcagttgtaaatttcacaacatcaatatcatttctattcgatatcaaatatgttaatcgattatttgtagataaaattatgatagaaggcgtagaaattgcatatattggaaggattcctgtcgattcaaacaataaaagcagttgtaattcagacaatctcgactatcttttccccgattttacaaaatttaaatacaagaaaataccagatgaaatgattgacttcacttgtacaaatgattataggaattgtactgtgagtattaatatccaatcatttttcatcgattcatatgatgaatattcatataatcatgattcagggtttggatattcaaacttcgtaattagaacttcttttacaagttctcaatttatttcaactcttgtttcggggcgattaggttatagatataatcctctatcaataccaattaaaaaatga

SEQ ID NO: 2387 - DNA, 417 bp, Cryptosporidium hominis
atggctcaattttataaaacaaaaaagtgcccttggtttgcagttggacgatgcagaatggataaagaatgtaattgggcacattctattgatgaattgagaccaagcgtggatttaacacgaactaaactttgtgaagtacaattaaaagaaggcatatgtagaaacccacaatgtagatatgcacattcgaggaaagaacttcgagcaacttcagatcttttcaagacctcactttgcgtttattggattaaaggaagctgcgtagttggtgattcgtgcagatatgcacatgggatagaagacctcaggtttgaaccccccaaaagggagaattcctttccgttggagggtgacagcgcttcccggggccatttcaggaaaatagcaacccaaaggccaggattgatccaatga

SEQ ID NO: 2388 - DNA, 2838 bp, Cryptosporidium hominis
atgattcctataatcactagtattggtttgattttcttgaaaagtatactggatgattttcctttgccaaaacataatcaagaatatttgatttacttttctaataacacgtggagaaatcccgtcaagaagaaaccgaaagaatatttgaatctcttttatcatatggctattccaattttgattatttcaatttacgtgccatttagtaacaaaattgaaatattaaaaaatgaatttttcaaatttatggtacatttcattttttcatcaattatttttcagattgttaataatataaatatgaatatagatgtatctcgtgaaacaaaagaatccttctggtcttttaagttaccactaataataaaaaatataattttttttatttattggaaaataattaaacaaatatcaatttacttcagtactcattccattgattattttccttttgcaattgcattaactattttagcaaaaaatttattttcagtaataaattcaataccttattccaaaaattgtataggttttaaattgggacccaaagaagaaatgaagagacttcctctaggtgattatgttacatataacaacgatctagctattggacaatcatcttcagtttcgaataatttctggaataacttattttttataaaaaataaatatactttatatgaagatatgtggcactataatttgataaatatgatattgctatcaatttgtacagaatatccgattattacatcttttatattaatgttaaatagtggtcttacaataattttactcttttcaaagattttaactgattcaacaagaccatggctattaattattactctatctcaccaactttggaagtttattattgattctagtatattgttttcaatttcttgtttctcttcaacaccaactagttcaaatttcaaaacctccctctttattgttatatttatattaaattatgtaaatataaatacaagcaaatcaggaaaaatgatttatttaagcgaaaacttagttttttatatatttaaactagttcctctatttaaatacactaggcaagcaattgaaaaaaataaaatgtctttaaacaaggcaataaacaaagttttaagaatgagaaatcctcaaataataaacaataatgacgatggaaatttaaatctcatatttaacaaacaaaaagaaaatggatattcaaatataagaacaattgaaattacatctccactaaaagaattattggaaaagttccagggttattgggttctattgagatcaaattctgactcactccaggaaatcaatgcagcattgggtgtttcatggtttattagaagagcagtcgataaactcaatccaattgtgcattatgatgttgatacagtaagaggaatagtttcaatatcaacaacattaataatgggattaaacaatagaacaacattaataataaacagaacaaaaaatctagggaagaataatcttgaggaaatagaaaaccataggattgaaaaatttaagatggaggaagagaatgataatttatcattatctcatgatgaaggcggattgtatagacaatattcaaataaaagaaaaaaatcacttgaaaagtacatggtttttgaacaaccaaatacaaaaatagaatggagtgaagatagaacaaatattattttggaaacgagacaaaatagagagggtttcaaaatgattgaaacaagaagcattgttccctcttataaactcccatttaaagtaaaagggaatgatggaaaaattattgaaaatagacgacaagatatcttatgttataaaattattcttaagggtgggaaaagaaatttcaataataaaaataacttacttgtttgctgtagatactttataaagaccgaaattattaaatcaaaggattctgattccaattctaaagaaagtagtggatcaaagacaaaatctgaccaatcaaaaagtttgatttcagttaattcattgaatgaaattcaatccaaagagagtgttaagccaatatttattggagaattaaatgagtttccgcttacagtacaacaattaatagaagatgaagatagtatatttaagattgttacggataaaagagcagaacttcttgaatatactagaaagctagtatctgaaattgataatggaactcagaagtggtcacttgaaagaaattcaaatggtatgagagtatataaaaaagaagttgatgggcaaccatttatgagttgtggaattacttcaatatcactgaattgcaatatagaaccttttaaaatttcttcagataataatgaaattgaaaatacaaacaaaatatgttcaattaaagatattgtagattatatttgggattcaaacaacaagatgtattatgatcccatggttgagaaatctgacccgatgcattatttcagaaatgatgaaaatatttgtatattttaccaggcatttaaaggacagtggggtgtctcaggaagagattttgttgtaatatgttacagatacaagccagatgcaaatgaatcaactaattcagatgaatcacaatatgaatatattcttacacaatctattgagtggcccataataaactcatcatacgtaagagctaaaaattacttcgcaacatacgtttttcgtccagaaggcgaaaataaagtgcaagccatatatttcaaccaagttgatttacatactgatatatctgcatggataataaaaagagtaattttagatcaaatgaattctttaactatgcttagggatatattacaaaaaaaataa

SEQ ID NO: 2389 - DNA, 1329 bp, Cryptosporidium hominis
atgtctaaatataatgggattggagaaaaactatcgaggccagtaatagagtgtctgaaatctctaaagaattacatcagggactacgatcctttagagaacgattgcagatatgatatttttcaggaacttttaacatttagaaaaagttggcgtaaattatctacttcattggaagaaattgataataacataaatcaagatcttgtaagagagttttatgaaaacaacatttgtattgatgaatgtagagcaagagaagacttcatcgatataatctcaaaaaattttgaaaataacacacatccagcatttgagatgtactatcacaataatgttgatgaaaatgaggatttaaattattcagtagtatctagcaatgaatcttttgaaacatttattaagattttagaatttgactttgaagaaagacaaaaaaaaatatctgaacttgagtctatcaaacaagaacatcttgaattgattgctgaatccaagtctatggatctagaacaagaggagttaaacaaatatatagaaccatttaaaaaaagcctagaattaattactagctatttagatgattcaaattgtgaagaaaatgaaggtttttgtccaaacacattgctagaattacataaagatttaagaccaatttatatatatttcaattcttttaaggatagaatcaacagtaataatgatagtgatcaagttgttcatgtaaatgttgatgaatatggccaggttgttattagtattaatagaccattgtctaaaatagaatttgatgcagtttcaacaaattttcaagattttctaatcaatatttttcccattaaattagagttttccacaatgaatactctatcatctcgtgaggttgttttgctttctgtatttatgaatagaaataaacagttaaaatgccatattttttcggatattttatttgataaagatacaggcgaaaatattccattaattgatgaagagactttggaggttttacaagaagaagtttctggaaaaccttattattggctacaatacttcgttaataacgtttctgtaatccctataaaattaaatgaaatgaatttagaccctggcgatctattcaaaatgattgaatacaggattcaaaatttcatatttttcaattttttactatatctggcatcaattgggcctcaatcgttcattagttttatattattttattcggaaattgaatcacttgacactcaaataattgaaataaattttgatagttttagttttaatacagttaatgaaattagcaagcattcaatattaattaaaact

SEQ ID NO: 2390 - DNA, 222 bp, Cryptosporidium hominis
atgccagaaccaataatctttgatttgccttcaaccttttttgctgttttttttgtattcaaactctttacgtccgaacttattttgtcagttttcttattacccatttttgttgaacgcttagacttgcaaaccatcttgatagtattatgttggactcccgtaaaaattgataaaattgtgtattattatacaaattgcttgttacaacttcgactataa

SEQ ID NO: 2391 - DNA, 1011 bp, Cryptosporidium hominis
atgagattcaaggctactctattgcaaagaaagtctagtatactcttggagtgtatacaaggatttgtaaagatgatgaagggactaccgaataaacaaaacagcagattttatatcaagttcgaaaaaaattcactaattttgctgctaacaagctactgcaattgggatgaacaaattgcggatgtgtcttgtagattaaaatatgaagatgtttttttctcagaaccagtattagaaagtaaaaatgagaatattattggaattagtttgaaccccgaggctttgattcttcccttgagatcttcaatattagcaaaagaaaccacattgagactgagcaaaagagactcacaaaatgtgttatctttctcaatgataattgaaacaaaaaaaatgagtacatttcaactaacgcatgattgcaaagttgatattttgaaatcgaaaataacaaatgaattaattcctttaggtgaggatgggaaaagatttggtagtgaaattcccaatactcacttttctttacctccgccaaaatccctattgagactatttgaaaaaatgaagctagttgattctaaatatgtggaaattgaaatagttcaagattacaataataaagcacaaaacaatcatgatgaaggatctaaatcccaaacctgtcattttatttgtacttctgataaatcattgaactctacagtttcaataaagacattttttaataattgcattgttttccacactgaaaataatgatgagtccaggatgattatttctcaagaacaaaatcgcccaactgatgagaaagaattatttagagtttttgcaacttttgatattaatcacttaatgtctgtaatacagttttctactactatttcagactcttactgtgttgctacaataacgcagaacaaatttctatcaatgttgatattttttcctaatattgaatcacaaatatctatatttttggcatcagtaaacactaaaactaccgaataa

SEQ ID NO: 2392 - DNA, 1299 bp, Cryptosporidium hominis
atgggagccaagaagaaaatagcatatttctatgacgaggaagttggcaatttccactatggcttgggccatccaatgaaaccgcatagagttagaatgacccatgaccttgtttctcaatatgggttattagaaaaagttgatgttatggtaccgacccctgggacagtcgagtctttgacaaggtttcattcgaatgactatgtagactttttacgtagcgttaatactgataatatgcatgactattctgatcacttagctagattcaatgtaggtgaagactgccctgtatttgatggcctgtgggaattttgtcagttgtctgccggaggatcacttggaggggctcaatctgttaatgagttgggatatcaatatgcaataaactgggcaggaggactccaccatggaaaaaaacacgaagctagtggtttttgttatgttaatgattgcgtattgggcgctttagagtttttgaaatatcaacatagagtttgttatgttgatattgatatccatcatggagatggggttgaagaagctttttatacttctcctagatgtatgtgcgtttcatttcacaagtatggtgactactttccaggaactggagcactgaatgatgtaggagtggaagaaggtcttggatattccgtgaatgttcctttgaaagacggggttgatgacgcaacttttattgacttgtttactaaagttatgacactggtaatggaaaattatagaccgggggcaattgttttacagtgcggagctgactcactatcaggagatagactaggttgttttaacctatcacttaagggacatgggcatgccgtttcttttttaaagaaattcaacgtcccattgcttattttgggaggtggtggttacacactcagaaatgttccaaaatgctggacttatgaaacaagtttaatagttgacacatatattgacgaacagcttcctaattcatcaaatttctatgggtactatggacctgatttttccttagcagttagaacttcaaatatggaaaatctaaactcaagacaagattgtgaagaaatttataggaaaataagtgaaaacttcagggattatgtgtttccaatcggatctcaaatatcagcatacgacatacctgagaagctccctctcttatataatccaaacaagactccagatgactataaagatggcaacaacattaagcacgaacagcatcaggatttcgatgatgagatgaaagaatggcctacagttgattacaacaacagggctattggatag

SEQ ID NO: 2393 - DNA, 447 bp, Cryptosporidium hominis
atgatttacattcaggatgctttgtatttactgccggatcttgcgcctaaggtaacatctagcttgcagttagaggaaggcgaggatttgaatgctgtaaaacatgatatactctacagagcaaactacatctcaacgggttttgagtgtgcaaatgacttgatctccaaaatgtaccaactaagaccactaaatggtgaagatgcagagaggtacttaaacaaaatcgaggagttaaggtctaaaaacgataattgtgttagagaattaaaatgtgtgtcagaagaatgcacgattgtattagataaattaaatatgagcattagtaaatacgtcgaagattctataaacaaaaacattatttcaaatgatacagagaataaaatgaatatgactttaggagaaatgtacgagataaattatcatgcgcgctctaatgatatttga

SEQ ID NO: 2394 - DNA, 1473 bp, Cryptosporidium hominis
atggaggaattaaagcatctcagaatactcagtaaggttcaagcaaggatgtttgaagaatggaatactaatgatagagatcttgctgaatatttatgctatatcggcaaagaaagtaaatcactcaaagagtttaatgggaaagtaacaagtattagtggtgataaaatatctcacgaagttttgggcgatatttattcaataataaatgatactgaatctaaattgaacaaagtaaatggtgattctttaaagcttcaaaaaccggactcgaatagcaacaatttaaattttgctattccaaatgagaaagcaccattaagcaaacatgctctggaacttattaggaaggaggatcctcattatgtggatattaacagaaaaaacaagggccaaagcgagacaatttcctcaggatttggaatgaaggacaccaatttaaaaaaaggattcggtgcaatttcaggaattaaactggtagatagttgcagtgtaaaatcccaatactcaggtaataagcaagaaagggtatctaatgactatgaaaagtgggaaattatgcagctccttaattcaggagttatttcaagggatgaaattccttatgacatttgcgatacaaccggtgatactaacgattttcaaaatgtagaaatatccactgagattgagcttagaaattatgagccattgtttctcaaagggcaatcaattaaaaagttcaattttgactcttcaatacaagtcgtagtaaatccagaagggagtttgaataaagcagctgagttagcatctaacattgcgagagaacgaagagagattcgagattttcaggaaaagaccttaatagatagtattccaagagatatgaaccggccttgggaagaccccaatccagaggctggggagagaacgattgcaagcgcgctacgaggaattgggatgaattctcaaaccacaccggaatggaaacggcagtatttaggaaagagtttgagttttggcaaaaagaatgttactgcctctatattggaacaaagaaaaaatttacccatttacccaatgagagactcactaatcgacgcaataagaaataaccaggtaatagttgttataggagaaacaggtagtggtaaaactactcagattacccaatatctatatgaagaaggattttgcaaagatggtggaatgattggttgtactcaaccaagaagagttgctgcaacttcgatagctagacgcgttgcgcaggaaatgggatgtacattgggctccactgttggatttgcaattcgatttgaagatatcacaacgccagagacaaaaattaaatatatgacagatggaatgcttcttagagaagctttatcggataactgtttatcacaatacagcgttattatgctggatgaggctcatgagagaacaatcacaacagacgtgttgtttggactgttaaaggtaagttaa

SEQ ID NO: 2395 - DNA, 1995 bp, Cryptosporidium hominis
atggtactcggaaactatttaagttcttatgtgaagattatgcgcataggccaaggtgcatttggagacgtttggctcgctgaagacttaaagaagaaaaggcatgttgctttaaaaaagctcatttcaaaggagagtagagacggattttcaaagacagcaattagggaaatagttttactaacgaacttgaagcatgaaaacattgtcgagttgtatggagtcgttttttcgaggcctcataacgacttgaacgaacataatattcatggaaatccaattaatgctgtgtcttctcacttacaatcaagtgcaccaaacaggggttctatttggatggtatttgagtacttaccatatgatctttctggctatatagaaggtcttaagttagaaggtagagtaattaaggtgatagatattaaggtaatcattcgacagcttctatcgagtttagagtattgccaccttaataatacaattcacagagatattaaatgtgcaaatttattaatttcaggagatggggttgtgaagctagcggattttggtcttgcaagggttttcaatactcgtaataggatgctcactaatagagttgtcacactttggtatagaccacccgaacttttattgggcgcacaattttacgatactcccgttgatatgtggtcagttggatgtatacttggcgaactagttttgcagcagccgctattttgcagtgaaacggaagctggagtattgaaatcaattggcgatactcttggctctcctccctcagatatgctgtttgaacttaagaagcttcctttatggaatgatcacgataataacccactattacaaattttgggttcaggaacgggatctaaatttagacaatttacttcacgcattgaagagaaggttggccaacaaggattagatttactattacaattgctgcaatattcaccggaaagcagattaactgcgcgtcaggccttagagcatccatggttaaattctaataacccagatgaagtaattcctgataaattagatatgtccatcttcactcaaaaaaaacaatttcattccttaaatgcaagaaaattgcgtgataaacttcagggtagacttaaggccccttcatcctcagaagcaggtggtgcattaaacgcagtaattgggaaggcatacaatgtaggaagcataaaaaagaatattgaagaagacatcaaagcaaagaatgcttcaaaaaatgaagaaatgaagggacagcaaactagtgatacaagttctgtcaataacgctgattcatcttcagccgttgatgaaagaaaatttaagagatctagaagcagagaatcagacgataatttaaatgggtccaggtggaagttgagaaattctagtgaaagaaagcactccaaagagcatgacaaaaggtgtacattgaataatcacgacagaaaggaaagagagcgcgaaagggaacgtgaaaaagagtgcgaaagggagcgtgaaagggagcgtgtaagagagcgtgaaagagagcgtgaaagagagcgtgaaagggagcgtgaaagggagcgtgaaagagaacgtgaaagagagcgtgaaagagagcgtgaaagggagcgtgtaagggagtttgaaagagatgaatacgaaagaaggagatatgaatactcatgggatgatagctactcacgtagtagagacagagagccagcgtactacgactataggtacccgagcagctcacgatataatagagactatccaaatggaagccgctctagtctctcgcagcacctatctccgcattcgccacaaaacaacgcatatctatcatctaactattctgagaaccaatatagaagaaagaattcacctccaaggagttcacgcgagcactcaagtaaatatagcgcatcaagaggcgcgagttcaagtatgtaccctgaaggcaggagcaagaatgaatatcgagaccacaggaggtga

SEQ ID NO: 2396 - DNA, 1995 bp, Cryptosporidium hominis
atgactaacgaggttccttacaatctccaaatgatgggaacttcatcaacatctactaattccgggaatagtggagacattgtatctggaataggttctgaaataattcatgatggtaccggtggatgtaataataacgcaagttcaaatactcaggacgttctttctttgttaagctatcttgttccaaattctggcggtgatgtaaattgctcctcagtcaatcctcctccacaaatagcggacccggtaacgattaatgagcttcttggtctaataaacggcgcagtttcatccaattctaatggaattaaagggggcgcctctaatgcgtcaaactcacatgatcccaataatttgatagatacaactaataatagtaataacaataacaatagtaataataataataataatatggctagctctattccctaccttctgcccttactaatgggttcaggttccaataatgaccagaatataacgcttcttaatagcttagtttcttcttcaggaaattcgaatggtactcagggaaatataaatcaattcgtttcccaattgcaaaacttgttaccacccatagttccgggccataactctggaaatatacaaaataaccaaaatctgagccactctaatagcggatctaatcattctgcggaacatctacaaatgatctatggtggtggaaataatatgagcgctgataacaaatcagagcttcttgcagcggcagcggctttcgctgcatcaaacactatgaatatttctaatgccgggccggtaactaactctagaggtagagcaaggaaaagaacttcaaccactccattgggtggaatgagagggaggagggattctacagatgccaacaaaagaagaggaggaagccctggccgtcatcataccatggatggaacggggatgcctgcttctggagcattgttacctcatattccgtctcttggcaacgatggaattgagactctagaacatagtggtggtgttagcatgctaggcacaccggctgcgcatcataacggatcgcaatataatgaatttagtaccgaagatgcacgacactctgtcaggttcgagaatggtctcgtattaatgactaagcgatttattcagtatctttatgagcaaggtgaaagcagaattattgatttggctgcagcagaggctcatatggatgtacaaagaagaagactttatgatattaccaatgtcttggaaggaattggaatccttaaaaaaatgggtcgtaacgcatttatgtgctctgcgtctgtacctgaggttctagttgagcgcgatgctgtactttcttcatttggtacagttgatatgagtgttaaattggcgccgaatattgatgacgagactcttgacactattccttggttctgtagttataacaaattgcaagttctttcgaactctgagtacgaggttatggagaagacccttattcaaagaaaagagcaacttttacaggcatgccaacaacttggatttaatgatatagttgaccagtatacaattgcaactagtacagcaggtgcccatgtaactggtggagcggtagcaaattatacagcagcagttcacgcaaatagacctcaaagtcatactggtggtgcatcaaattctagaacgacaacaacaagccaacattctggcctttcattatcacatacaggtcatgccataagagaagacagcatttctgtgccaaatactattgaacaacagccaaatgaggcgagctccgcatctaacagcaatgcgggagctttatgggggagtataatgggtgggacaaatagaaccagtaccgttccttcaattcatcatcccgatgctcgttggatggagactgctgaaactaaccatggtacagccaaacataggatagatggagatcaaaactcagggtctggagttgttggtcagaatgaaaatatcagtggtttctctgaatga

SEQ ID NO: 2397 - DNA, 216 bp, Cryptosporidium hominis
atgaccgaagaagaacttcaaagcgagtatgaatatgaactcgcaaccaatcctgttctcgaaaacctcgatgaagaaggaattaaacaagctattcaagaggggaggatcgaggaagcagttcaggaggcggaagaaatagaggaaatcctcgaagagctggaggaaataagaagagaaaaacagcaaaaagctttcagaggtcgaaaaaattaa

SEQ ID NO: 2398 - DNA, 225 bp, Cryptosporidium hominis
atgatgcaaagatcttcttcattaataaggccattgaaatctggttcgttcattaaggaaagaattgaccataaaaaaacggatgatttaccaacatttagtcctataaatattaaagcatctccccctgcaaaatccagttcaaaatcacaaacttcgaattctaaaaaatatttcattatttttattatatttgcactatttatttttggtaagtattattaa

SEQ ID NO: 2399 - DNA, 2115 bp, Cryptosporidium hominis
atgcaatcaattataaaaaatgcgtttgataaagtatcagttattaaggatgtagtcgggaactctattgaagaagcagtcaaaagcaattcaagagatgcttcatatgtatttaactcgggatcttcaatttccactagtattgttaattgggctgaaaaaaacaatgtttctgaaagggccaacaatatcaaagtaagtgcgagcatgtttgtcggagatttagcgactggcttaaagggtatgaccaataacattacagttcagagcaatttaaccttggaaaaatcaaatcaacataaattattccaggaaaaaagcgaatacgattatttttctggagaatttgactctattgataatattgataggttctatgatgacaataaatcctctgttaaatctgtttacaaatcagaaaatacatttagagagatacgccaaacagaatacgagcttccaagtgaaatagaaaatcctcaaataataccaatttgtaactcaaataaaagttctaattccgacaaaatatgttttacatctggagatttagatattgaatctaatggctcgagttcaaatgaattaattggtgagccgataaaagataaacttattcaagactgccctaaatcagataatgaatgtaacttactagatcttgataaatctagctttcaaaattcaaaaaatgagttaatgttttcaattaatcagagaaaaaatgatcatgataagaaaatcgtcttttcaaataatcaatcaacaatacccgaaaattgtactcaaatttctaatactgaatatgaatattttgaaaatactaaaaaccaaagacacgataatcattttaaaactcgatctaagatatatagccccaattcatcaactattgagcctcaagaaacatctcaagaagtgaatttggacataaaaaatcatcaaataagtaaatttgaagaaaactcgaaaaatgataataaccctcgactgaatccacttacttttttccaagaaacttccaaacttaaagaacaaaataaatcccttgaaaatcaattggaacaagtaaaaaatgaatccgttgaacttaaagaaaaggttaatatgaaaacaaaaatcataaattcgattaattctagactttctaaattggaaattgaaaagaaatctttgaataactacataactgaacttgaaacttcaaaggcagaatataaattgaaaattgatgagttggagcatctcaatattaacttaaaacgaaatgaagatgttaataaggaacaaacaaatactattagatctctacaagagaaaatagccgaattagaaaatgcacttgctataggtgaagcaaataagattgaatctctaaaaacttatcagaatgagatttcagaacttagattaaagttatctaattcaaaggaaaaagaaagcagtaattacaagccttatattaatagaataagtgcattagaacatcagcttagtgaattaagaagaaggcactcgaatgaactacaaagatttgaaacaataatagatgacttaaaaaaaaaatcagtcaaagataggactgaaaaagaagtattggaaaacaaactaaaagaagcaaataagcttcatcaagaaactgtcgaaaattatgatgttcaaatttctcagtaccaatttattctagatcaaattgaaaataataaagtatcaaattcctacgatacaaagaaattaattgattcaaataaaagttttaagctttcaatatgtaatgccaatgagttaataattgaatgcaaacatgctgatagtggagaaatgagttttaatcaaaatacattcccttatttaaaccacacgattttatccaagccaaatgctacaacgcagctttcaatgttaaatcctctacaagaagaaattaaacaagctttacacgataagcaactattggaagatgaatattttattgtttacgaaaaaaacaaacaaatcggtcaagaactggaagaagaaaaacaacgaaatagacttctccaacaacaattggaggctatgtttaaattggttaatgatttaagcatcaaactcgatgaatctaaaaaatcataa

SEQ ID NO: 2400 - DNA, 2484 bp, Cryptosporidium hominis
atgaaaattttgcgttttaagtcacttttcttttttcttgaattttcactgataataactaattcgagtacgtatattccaaatgacaataaaatattttctggagtatttcttcaattatcaagtagagaatttggaatcaaacaaaataatgacaaaattcaggtaggctataaaaatcaaactgtaataagaaccgaatataaagatcatgacatttcgctttgtgacattggattcgcaattttgacggctcccaaatatttcaataccagagtgaaagatttaaaaaatagttggttgagacatttatgtagaactggtggtgaacagcaattttctagcaactatgtgttaatttcatccgaagaacatactgatataccaacaatgatacccaattgcgaagaaaattatctaaatctttgttgtaaaactcttgcatcttacaagtggatggtcaaaaattggccaaaaaaaaagtggtatatgaaacttgatgacgatacttttgtgattttatcaaacttaattgatgaattgagctcgtttaattcgaatgataatatattaatcggtgggcagatctatttaacattagaagattcattggctaattctgttactggtaggtcaaatactttgcattggaaatatcatggtgaagttataaaagggatcagaggtggtgcagggtatttgatgagcaactctttagcaaacttatttataaaaaatggacaaagatatttagatatctgcaacgatggtggttcaaaatttaagacattcgaagatgtatctttgtcactattgattacagaactagtaggacaaaaatcaataaaacacatcccagggttccactttcataatcctgaaatctcttatcgtaatggacttgataaaaggggatttagacccattacatttcacatgatgcatgatactagtagaatggaattttttgattatttattgaatggctcaatgaggcctccaacttattcatgtaaccacggctctacaaatatgtgtatctctgaatttgatctttcaatatcatcaaaatactgggatcctgtttattttggcccattgagttctaatagttcaaaaatactcgggaaaaatgcggtttataaaagtaattctaaatctgaacatatatatatatacaactcaaataaaagcaacgttgaatctttaaataatttaaatgtatcaaaggtgaaacctgtacaaaaaagtacaatagaaatgtcttatccagaatataatcaattatcaaatatgcaagttacaaatgtattcaaatttgacgaacatttaaataacacaaatattccattacaatttaaatataactcgttagaaatagaacatccatgcaaaaatttaatagaggaatattctaacaaattaaaaagttactataaacaagttttcactggaattaaagaggtattgtttgttggtttcccagatcatccaaacagaggagattctgcaatttttacgggtgcattaatattattggaatacttgaagataaaaattattaaggtagttcatttattgaatgaatataatgtgaatgagattcttaattcatttagctataaaactgaggagagagctattattttccatggtggagggaactttggagatttatattctcatcatcatgaattaagacatattgtacttaatgattttattgattacaaaattattatgtttcctcagacagtatttttcaaaaatgaaataaacaaagttgctaccaaaaaaaattttgttaatcacaaaggagaaatattccttgcagctagagacggtcactcgttgaaaattatgactgaaatgttcaatgatgtaaaaaacatcaaacttgagttgttgcctgacatggcatttttaattggggaccaaagaaagagaaggggcattccttctctcgatatactggtacacgcaagggtagacaacgaagctccagatttaatgttcaacaatacattggtaaagatgagcaaaattaaaatagagagtgtaaaaaaagtgataaaagatagtattaaaattgagaataattctggaaaaggtaaacatttaagcaaaggcaagattttgataaaaaatgaagaatggatcgactatttgacaatattaattgacgattggttagatagtgatgcaaactacaataatttaattagttcagattatattgaaaagtcgatttcaagaacattagatggaatggcatttttgtctagagccaactttgtaataactaacagattacatggtcatatattattaacacttttgggagtttcgcatattgtcatgggtgactcatttgggaaattaacaaatttcagagaaacatggactgctagctgtccactgtcaagctggcatgacgaattttccgatgcattagttagcgcatcagaagaattgtatcagtaa

SEQ ID NO: 2401 - DNA, 1026 bp, Cryptosporidium hominis
  misc_feature (511)..(511): n is a, c, g, or t
atgaaaatccgttggccaaaaggttttgggcacttatctagtaagcatagctcatgcgaaatagactataaagaacaacaacttaagttaagtaacttactcgagaattttaatttgaatttggaaagtattagtgaatcagattataaactgttttttagatttttgaaagcaagacaattcaatgttgaaaaatcaaccgaaatgctaaataagtattttgaatggagaggaaaaaaaaaagtagcagagttaattaatactactcaaataccaataaaaatagacttatatcaaagagcgtatcatggtattgataggttgggaaggccaatatatattgattgtattgggagcagtaatattaaacaaatgttggaaatccatcctgaaaaaaatttctttaatcagtggatatatgaatacgagttcctcgtaaatgtaatttcaatatcttgtcaaatatacaatgcattgaaggagcatctccccaaagattcagatatcacanatattaacaaggatgagattatgaatttgctaagcttgggagaaattcaattccagaatttttctactttaaacataattgatatgagtggctttaatatgggcaaatttgatggaaattgcaggaaagttatcaaagagctcgtaagcattagccaaaattattatcctgaacttctcggaaaaatgatcgtaataaacgctccaagtatatttggaattatttggaactttcttaaacctttaattgatgaaagaactgcaaaaaaaatatcagtttacacccatagtgacgactggaagtcagttctatttgatttagttgatcctgatcaattgcctaagtttttaggtggatctcctaattatgaaggtgaatggttcaatgcaaatatagggccatggtctaatcaaatcatcctcgagtgcattgcagaaaaatacccaaatattccaaaacctctcattttctcgcatacaatatcaaaaaataacgaaaatattccagaaaactaa

SEQ ID NO: 2402 - DNA, 312 bp, Cryptosporidium hominis
atgattagtaatttattcatttggagacaaagaaatagtatgtttagaatgtctaaggatttgaaaatttttagtgaattatctagaaattttgaaccaaaaaagactatggatgcaagatgggattcattgaaccattttcctaatttctcccacattaactataaaattgctaataatgatcaatcgaatgcaaattttcctctgaaagattggaatctatcaagtaaactatcaatttcggtgcaggacagttgtcaaatcattaattctatctcagttgaggaatttataaattcattaaaagattag

SEQ ID NO: 2403 - DNA, 1620 bp, Cryptosporidium hominis
atgcatggtcctgaaatagtttctgcaacagttttgcaaagtaaaactaagattgagattaaagataaaaaaattagctcagtgattatttttgattcaagtgttaaaagcgaatactatgatgaatactctacacaaaatattagggatgatgaaaaattaatttattattatccatctaatgactcgataataatcaaacgccagcaaatgagtctagtagaaggattgatttctatgtcttcccttttaataggacgcaaagagctaataaattatgtaaaaacacgtcagtacgaaatcgtttttaaaaaaataaaggattcggaaatagttgtttgttttattatgcagctgccatattacatcaaagtacaagcaggggagactgttgatgtcgagtttactgaagacgatatatatgacaaaagaaataatcaatattcaaatgacttttcttatgatttatcctctaagtctagacatagcctcaaaaacgtaaatcaaactcaagaagagaataatagagaaccacttttatctatattggacaaatttattgaaacatttacgttgctacatggggaagttgctaatatagaaaagaagtatttgttatatattctagaagattttgtgcctgcgtttattgaaacaattgatcttaatactttgtccattactacgagtatgaacggattttattttgctccagttgagagacaagttcaaatttcaataataaacttggtagaaaatataatacgtgattacaatgaagtttcacatgtttcaatattatttgatgctcatatgctttattcaacgctcgactctttgtcaagcagaatactttacaattatttagtaatgcataatggaattgctatgaatgataaactttgtaatgaaccttatggaagattccctacgtcatcgtctttagaaaaaaagggtgggttttcagcttttggaagaagcaataagttttcgggcgatggatttatttttggccccacctcaactaatgatcagaatagcaaggggaatttgatcttttctcccaagatttttcttccttgcaatccagataagggttataaattattagcatttacttataatgaaatcatggtggtaattttattcagcccagaattggatttgaattccatagataataattttgataaaaatactcattctgaactaaacaaaaattttcaattttttctcgatatgaaaaaccaaataattaattgtaatggtggtatttctgagctctatgaaaatgtattcgagcaattcatgagcattatgaattcaatggattcgtttcgtttcttttatattaacaaatcgaattatgcgataagaagatcaaatagattacttgggacaacgaagacattaatgtcttcaatagagggagattgcgtattaaaagcaacaaaagtgataaatactagcgatgaaaacatagatagctttgtttttaaatctagtaatgaaggatgggttgtatgtagaaagtctctcgatcgtacattctatttattttttgaagatagtaaaataccactttccaaggttttaggtaagttaaacaatattttatga

SEQ ID NO: 2404 - DNA, 588 bp, Cryptosporidium hominis
atgtctgaggccgaattgaacccatatattgaatttaacaaatacaaggtattgattgtaatcttttctgctcttttagcctcaattgctgctgagcttttgtcttattttctattttttagaaaaaacgacttcataaaaatgcaggacaatttaattaagtcacgagcaaagctagacaaattaaaactaaaggataggacagggataatcacagaaaatacaactttatcttcaagttattcaagtaaaattaagaaaaatcctaaaattgaatctctagagcaaagcattacgaacctaacttataaaatttcaatgattaagatgaagtcaggcatattagtaggtattttgtttgctgcactaatccctttgaaaaatacatttttcggagatctaccaatatgtaaacttccatttgaaccaattaaaattttcagattagttactcaagctgggctaaagaatgcatcagtcgatgacgcaggaagcattttcatttttgggcaggcattcatggcttttagaatggctattcagaaggcagtttattttgacacctcatcgtcattcgggaggatgtaa

SEQ ID NO: 2405 - DNA, 876 bp, Cryptosporidium hominis
atgtggctatcaacacgagttgaaaatgtagatacaggaatagcaactaagcaaggtccaagcattccaattgaaggcatgtttaatactctgctccgcatgggattgctattcgagctaatgtgctatcttgggcttacaatgataagttacaactatacaaaccagttcagcttcaattaccactcactaggagaaattttggtccaaggaaatgctccgaaatatatttcattttgtttcttcttaggaattatgggttctcttcatttaatgtcattccagctattgcttgcagatgacacatgttttgcaagaggatatgtgacgggatcaaagataataaaaattgcgactctcttagacttcattggaaagactattggttttgtatttacaatgcaacttggtggtagcactgatttagagtctgcattcaacatggcagttgcccaaggaggtgttgagattaatttcttaactttcggacaaatattgtgtggtattgcatttgtgtcgtacggtcttggatttttgcttttagagctattccaagatgagggcgtaggaaactcatatggctatatcaattttcttgcattttcagcatctggtgcttctttattgttgcatgcaaccacttttaaatgcactggagcgactctatttgccttaacatctttttccactgcattattatgggctcttctctttgaaccatcgataaatgaattctcccctgcatttggtgagactgaattaacaaacgatgttgagacacaagttgaaaagttcacccgtacaaatcaatattataatgttgatgaaaactacggaagctattcgcagcagccttcctcaggatacatgaattaa

SEQ ID NO: 2406 - DNA, 2085 bp, Cryptosporidium hominis
atgtacggctctataaggagaatgttaactctggaagatccgaagaatggagagtttagtgaagatgaattgaaaagaattagattaaagcacatttttttaatatttatttttacagtactctatgtatcttgttttttaatggaacatagttataataaaagcgcaccaatatctaatcagataagatcaaagctatttgcatcaacatctgagcagctaaatagaattcaagatcaatttggaactcctgaattggaatccattatatcaggatctacagtttcagatgtattaaatttacttcaagcatcctgtaaatctaagtctttaattgaggatggaatgaccgaatttttcaattgcgatataatcagaattgattggaataaaactcatccaaaccctactcatcctgagttaccttgtgattattcttctcttgaaaaatatgttgaagttggagataacacgccattaggcgaattcccacctgcaatcagaaaatattatgaaactaataaagtgccattagatcaacagtcaaagccaatttttcacatgtatcatgattcaaagctattacttccactattctctgattctgcagatcacaatttaggtccgataccttcaattcatgaaaagttaaatttaataggcaagaaactttataaagaagaattagagaacggttctgatattaaaaattccgatatctttaatagcaaaaaagttgtgcagtccagcgaaataaatgagagatataagcgaaccaatgtaattggaaaagttattagcgaactagattcgaaaccaaacaataacaaattagtaattgataggaaccatcattgggatttactatttaaatgcgaccccgaatgggttacagttgtttttgaggtatctgcagttcaaagagaaaagtatccactttggtggaaaacaaaacttcactttactcgcagctctccatatttaaatcattatattccagaaatagaaattacaacgggtttggcatatcaaaagcactatcccatttcaacattattacctgttataacgttattattattttcgtggcttttatttcctggtgcaatatcgagtgtgcttatgtttccttacaatgtatatagattaatttcaaagagtggtagattcagagatattattggccactttatagatccatttggaaatcgaattaatactttaagttggtttcaaatattgttggaaaatacaataggaatactaattactttaggattcttattttctagtctagccattcattttggctctgaactttgtattgaaactgcttataagaaatgtgttgatccacatttattttggtctgaaactcttcatttgactggtgcagagtattatggacaagtacttttcagtttgtggataaagactaaactacatgctattgcagttttgttattatttataaggttactagaaatttcgttattctccagcaatacaagctttttactcatgacatttatctttgcgttcgtacctttcatgtattttaccgcaatattccttgttttattatttgcattctcaataataatgcatgctatgtacggagctatttatattcaattttcgacaatttcaatatcattttattcattgttcttatttgcgtttggaagcccattctccgagacagaagtcgggatacatgcttattttgaaaagagcgcatacggtgcagcagctatgttgttactatttgagatcctctttgtcacaattctgttaaatatgttcactacaattattatgaattcttatgcaatagcaactaagaacacagagtgtccaatgaggatgaagaaagttacagcatcactttggtatcaagcaaaactaatttttggatttgacgatgaactacaggaagagttagatacaattgagcgattagggacgctgataaaagaaagtgaagatgcggtagtactagatatggcacttcatttgccacctgttatatcaccaacaaacaattctttagacacaaaaactccacttctgaaagcaggttga

SEQ ID NO: 2407 - DNA, 1632 bp, Cryptosporidium hominis
atggtctaccaaagaattagaatagtcaagttctgcacattaataggtgctgctggagttggtatttactttggatggaaattatttaaaaaaggaaaggtttgctccatgatcaaagaaatttactctaaaaacaaaaaagataaaaaagagcatttatttgaagattattacaattttaacaaagataaatcaaatgaagttggatcaaatgaatgcgaagtagtaagctcttcaggactgattattagggcagtaaataaccttaatattcagtcagaagagggttttgttcctggaattgcaaaaataatggtaaaaaattttggatgtaatcacaatcgaagcgactctgaaagtatgatggggcttctttctgaatatggatacactttagtggaggaattagacgaatgtaatttaatagtaattaacagttgtacagtcaaagggccaagtcaagattcgtgccaaaatttaatagagttagcaaaatcgaaaagaaaatttgtggttgtaacaggatgcgttccacaagcagatataaacttgaacttcttaaaagatgtttctatcatcggtgtcagaaatattcatcgaatagttgaggttgtagaattaactttacaggggaacattgttctactgattccagataaaatggaaggaaaatcaggccaattaatagattctcttgaaatgagtttacctcctttatcactaccaaagattcgtcgcaatcctttcgttgaaataattactatttctgttggttgcttgggaaattgtacctattgcaaaactaagcagtccaggggcgatttgggtagctatcctattgaaactatcattcaaagaatcaatcaaagtctaaacgagggtgtaaagcaattttggctgacttcggaagacattggggcatacggaaaagatattggcacaaatttatccgagttattaagagaaatattgaaaattctaccacaggacataatgattaggatagggatgacaaacccaccatacattttagatcaaattgatgaaataattgatattatgaagcaccccaatgtatttgaatttttgcatattcctgttcaaagtggtagcaacaggattctggacttgatgaaaagggactatgttatagaggaatttagtttgctagttgattcaatactaaaagaaattccactagcaactattgctactgacattatctgtggattccccggagaaagcgaccaagaccactttcaatctgtcgaattaattaataaatacaagtttccggtaataaatatttcaaaattctatccaagaccaggaactcctgctgcaaaaatgaaacctgtaccaaatggagtttcaaaaggtagaagctccgagattacaaatatttttcagtcttttaatcacaacgaatatatatttgaaaatttgccagatgataaagttgtcaaggtatggtttattgaacactctgaaagaagcaatcatacagttggacacacaaaaaactataataaagtgttagttaatatggatagtaatctattgggaaaatgcgcaatggttaaactaatcaaaccttataaatggcacatagaaggtatcgttatcagttaa

SEQ ID NO: 2408 - DNA, 2208 bp, Cryptosporidium hominis
atgcaaaaagtcaaaaatgaagcaagacaggtctatatcttgggttggctaatccacttaagaattcttaatcgaattgttgacaacattttcattaaatctcacattttatccctgtacctatattataatcaagaatatgatacacaaaaaagtattagaggaatatatcagtggttcagaaagtacttcaaaacatattatttaccaaatgaatattggatttacaaactccataattttgaaacgaagactaataatgcgttttcgaaatcaaattggatgggtgcatactattctttattttcaaatgaagataaaaattttgccccatgcttaaatggagtaacgtataatgcaactggaagagtcgagaataattttcttgaaaaatttcaggaaatatacagacaattcgcacctctgatagatcaacgtagtttctttcttggtaaaattctcggaagaatgatcagttctattttatctggaaaatgtagtgctgaggccagtaacattctttttgctactctgctccgatcgctaggtcatcattgtcgcctaacgttatttattccccctattattaactttaaaaaaagttgtgaattgcaatgcaacgataggagggctgagctttgggttgaggtcttcgaaccaaagttcaataaatggatttcagtcgatattcaccgtggggggtggaacttcacaggatgttctacagttccgtttgtaacttatccggaaaaaaatactccttcaattgagcacaatagcgataagggattgttttcaaaactattcttaagtgaatttaatgatgactctgacgattcagataaaaatttgagtcttaaaaaaataacacccatatcagttattcccttaaaaaaaactgaaactagacgaagatcagtcaaatatgaaatgagtaatattgttgagcaagatgaacaaagagaatctttagcatttgaattttcaaataaaaagaaaacagaatcattaacactcattcaattacagtgcaaaatcgatatctcaaggacaaatattaaacataagattaatgagagcattggatggtggattatatctgttaatgagtatgggtacttaagagagaccactggaagatatgtttcagactggtctcaagtgtttcaagctcaacagaagaattcatttaaacaaaaggttgagtcaataatctcaacaataaattccacttccaatcagtgtagctctaggctgcttaaattggaattattagatgatttcgaattggaaaaaattatacacgaaaatgacgtaattcctatttcaaaaacatctttcaaaaaccatccaaaatacgccattatttcatgtcttaattctttagaaatcattcatccaaaggagcctattgttggatattttcagggcgagccaatttatcttagagaaaatgtccaaacgttaaagactaagactcagtgggatcaagaacaacgcgaaattaagattggtcagcaaccaataaaaattatcttcaaaaagaaaaatgatgacgctgacttaaagggcaaagtgaaactagaatattatgcagaatttcagacgcagattaaacctttggcagagttgaaccaccttgatcaaattccaaaagatcactttaagtcaataaatatttctattaaaggcaatatacctaattcatgcgttcatataaaagattcttgtgaaggtcttaataacgataaagttatgtttacttccaggtattactctacgtggaaaactgaaaatattattgacataattaaaagaagtaacatcgactacgcaagagcgtttattggttatgactttaaaaatggatcaaaacctaagtacgatggagtaattattaagaaaaaggatgttactccgtttcaatcactaaaaaaacgatttgaattaatgaatataaataaaatggctaatttcatctggaatgacgttctgcaaagtgctaaagattttttgaatagcctctctcggaataatttgtcaaacaatacattaaataaagactacgatccaggttcagagcccaattgtcaaaagctaattaatgtaaattacaaattctgcaaaataaaaaacttatcagaaagattattagaagaaagttacaaagcaattaacaaaaaaaagagaaaacaaatcgatacataa

SEQ ID NO: 2409 - DNA, 1119 bp, Cryptosporidium hominis
atgactgagaattctactcgtgaaaaaacagtagtgagtaaacctggttggggagctgtgagatgggcggatctgagtattagcgatgcttcaaatagctggatatatactcaaagcgatacaaaaaatgaatctaaatctattgggttaacttctcttcttcaaaaaaatataaaacttaatgatagcacaagcgaatatcaatacagaaaaactaataaagaaaataaggaaaaaatgccaaatagagggtttttaacaattaatggtgctgaaacaaatattgaacctaaattagaaatatcgaatttacctcagtacttaggtaaagtgaacaatgaaaacttcgaagcaatcgaaaagggtcaaaacattgaaagccaagaatttcggtttggggagggaacattcacaggtggcttaactgatataagcaaaagtgatcaggcaattaaattcctcatacaagatgccaatttaaatatgccgaaagtgttcggagatttgccacaaatactaaataataattctagcactaataaaaaaagaagtaaagatcatactgagaactcagaatatagcgaaaatattaatttcaactatgaactacaggttgatgaagataaaatatgcaagaagatcaaacactcaaaaacgagtacttctgcagccgaaggttccaagcttggcaaagaaacgaatcaaaatgccgtatatgagaggtgtgcacaaaaaaaaacaactaaccaattgagtactcctagaaggataagtaatagtacaagtaaatctccgaaaggaggaactccgaaaacaccacaaattagcagtagtggccgtaataacgatttatcaatcgatggtaccgcgagctctaatattgattggaataaacggatttctagtagattatttcaaattgccattggaaagggtacaagagcatatcagaattttttgaaacttaagcctagaaaagaggatagagaacctaacgatcctcaaactccaaacgctcatacaaggtgcccacagaaacaattcactgatcaactaaatcagtggaggaagtctcttcatcaatatgatgactttgactccaatattctggagttgtga

SEQ ID NO: 2410 - DNA, 582 bp, Cryptosporidium hominis
atgaagcaaaaatcagagaataaaggaaaaggtagttcgaatgaatctcaaagtacgcatcaaagtagtaataatctaaataaagattcttcaatcaccactaatttctgccaggaatcccctcataaaaaactcagcaacgaaatggtttctttaagagaaaaggttcaagaagagttggtagatattgaaagaaaaatatatgaacttgagacattttactggaaccaaactactgatattggaaatatgttaagaggttgggacggctatgcaacgtataatagcaatacgggaagtataggaggaagaaaatctagtattggaggtaaccgaggctcttgtagatcaaatccaaatgtattttctgaaaaagatcgctggttctccttatcttcagttacatctcctgtagatatagaggcgctaggcactactccaaatacaggggcacactcaggagaaatgttttctgcagctggctcaaatgtgggttcaagtatttcataccactctgaatcgcagtgtcagggaagtgaattagacaactcggttaactgctcacgtaaacagcgccgataa

SEQ ID NO: 2411 - DNA, 810 bp, Cryptosporidium hominis
atgtctgaaagaaaagtcttgaatcgatatttcccaccagattttgatccaaaaaagttggaagaaagtaagaaacttttaaaaaaatcaaaatcaaacagtagaggcggagggtacagaaaaaagaaactattaaatatcagaatgctatacccttttactattagatgtaatggctgcgaggtttatcactatgtcgggacgaagttcaattcaaaggtagagaaggtacaaagtgattcgtatcttggaatacctatttggagattttacgggcgttgtactcaatgcggaaatgaaatagtctttagaacagatccgaaatcaggagactatatacttgagtcaggagctaaacaaaattttaatatgaacaataaagaagttataaaaaaaaaatctgaagacgactttgaaagtaaagtcattaattccgtattggaatctagatctatggaggagcttgaaatactgaagaatctaaataaaagactaatgaacagagaagtcactgaattgaatgctttaaagcatattctcgatgataacgaaattatacctgaagaccaattcatcactccaacagataataaatgcaatgaaattatatcagatagagaaagacagctaattacaaatagtgtaaggaattgtattgattcatttgaagaaaaccctaaatttcaaaaaaaattaggtagctgcgttgtaaactcaaatggtccaaagaggcctagtgctgctgttaaggtgaaagaaaagaattcaaaagatttattttttaactactacgacactgaatcggagtag

SEQ ID NO: 2412 - DNA, 1449 bp, Cryptosporidium hominis
atggggatacaaggattactacctaatgttgacaacataagtatcaagagcaaaatcgactcgtttaaaggaagaagagtagcaattgatacatatggttggcttcatagatcagctgctaattgcgcagaaagtattgtattaggcaaacctactcgagttcatattaattattgtatcgaaaaaatcaggactcttcaagggaaaggacttattccagtttgtgtgttcgatggtgccactcttcctatgaagagagttactgaagaagaaagaagtaaaaggagaagcgatgcaaagagagaaattatcagattaaaaagtgaaaaaaagtcttatagttcatataatatgagaagtttgtgccaaaaagctcttgatatcaccccaaatatagctcaccaggttttggaagtattaagagatgaatacaaaatagaatgcattgttgctccgtatgaagctgacgcacaactttcatatctttcaagaataaagtatattgatgcggtgataactgaagatagtgatatgctagtgtttggaagcatatgtacaatttacaaatacgacgataagacaggtaactgtagagtgatatattggaaagatttgtataaaagtggtgtgatttcacaattaatgttctcatacgaaacttttgtactaggatgcatattgactggttgtgactatgtaaagtcaccacaaggggtggggataaaaactgcgatgaagcttgtccaagaatgtaatgcagatttagaaaggataatattacagcttaaggatttaggcaaggatataccacatagttatgcaattgatgttcagaatgcaatgattacgttcttccaccaaacagtttatgaccctattgaaggaaatatggtcccactttcaaatagtgacaagcctaaaagtgaaattgagactaacgttaccttagataatgtaccaatatttattgagtttaataaccagatgaagcaaggcaatttgattgaatgtaacgagatgaaaaattttattgggccgattattcaaggcaaggtagcaaaggatatttgcttaggttttattcatccagaaactcaccttgcatttgatgatccaataaatagtcattctgagttccaatttaatcttggccatgattgtaacgatagagataaccaaataaagccatctagggactctagagcttcattagaaaaagaaaatttagatgataatatagggaaaagtgaatgcgatattgaagagttaattaaacaatcaatcagatctccaatcaatcggaagaaatcgaacattaggttattctcacacgaagagagccatgttggccttaagaaaaagagaagagctatttggctaggttcagaagtggaaaataatgcaattaaagaaattaaattacttgacaacttagcatataaagcataa

SEQ ID NO: 2413 - DNA, 3642 bp, Cryptosporidium hominis
atgactttaagcgacagcacaggcaataacagtactgtccctacgcaagggaattcaggaaataattcttccaaatttaaaagtcagttgagagcagatgctcaggagtttaagcctacattcggaattactggttcaaatgtcattccaaattcaggtatttattaccatggaatgatgcctaactatagtcacgtaattgaatatgatgggtaccgagtgggtggtacatattataacaaaagtcttaaaaaacaaaacaatggagagttatcaaagtcctcaacttatctcaatccaaacgctcaagaatttattcccagaggttgggtaaatcctacaaatgagccttttataaatcatttagaacatcaaaaatttgtgaagccggtctgcgccgatacttatactcaaaatttggatcaagcagattctcaacgaaatgatgacttgttaaatttaaaatctgaacaaattaagcacaactctgctgattctgcaaagcctaagatggagtctagctctccgccacagaatgtaactaagatgacaaataaggctgataattcgcgagatatatctttaaagtctcagaaaaaagccttagattctgatatggatctatcaccccagaaggtggaccaaggtttttctagtccagcttctaacaaactgtcatcgagtgatttatcaaatcaatcaactcactttacatttaaggataagttattagcacgtgttagcactaataataataataataataataataataatagtaataataataataataataataataataataatgataatgatagtgataatgataatgataatgataatgataatgataatgataatgataatgataatgataatgataatgataatgataatgataatgataatgataatgataatgataatgataatgataatgataatgataatgataatgataatgatagtggcaataacattaatgttaataatatcgtttcaaatgcaataaataatcaatctacaataaattccacagaaaaacaaaattcagagattattaaaaacgtggcttttgcaaaaactagcgagatacaaatttctaataaagaagcaaaggatcttgataattcagaacgtcacgatacaaaaaatgaaatatttgatgaaaagagtcgccattccaatcaaaatattacaactaaaactaatttaaacgtccttggtagaaaagaaactgatacaggaccagtaagctgggcgcagagactcaaaaacagcacatcaattccgcacaacaaaaaaactggtgagtgttgtacagcaaatgttgaatcaacattttctagcgaaaacaaaccgcacacagaaataaatgttgaaaaatatgatactcttaaatctaattctcctaagaattcaactaaccaaactggaggctcctcaaaagataactcggactctaataagacaaaagactctaagaaatcaagagagaaattcaactcactcgaaaactcgagaagttcaaaaagagaagcatcgaaaaaaagtgatttagatgaaaaacaaaaggtgaaaaaaccagaaagtagtatatgtgaacatattgaaagtgaaactctcaattctgataataactcaagctctattgaaagcaaagctaacttaaatgaagataaggaaattgtagctttcgactgtcccaaagaggaaaaaactgccactaagaaaaactcactttttgaatataaaaactttccaatatatactttgcttgcattaaggacaatttctagtgaatttaagaacttagacacgagtttttctcccccagaactttttaaacgaaattttggctcaaaggagttagatagagatggcgggcatcgtggcagaggatggtcaggaaacttgagtcactctaccggaaataagcattatcatcgtgaaactggaaattacggtccgaataatcgcagagatagatttcaaagtcatgggaatactcaaaactcccagggaagtaagcgtgttaatgataatgcaaatggaggagcccagaattcaacacttgattggacaagggatgaaagaaaaatgttcagattggaaagttctgcggaaagttgggttgtaaaacaaaaagaacaaaaggcaaaaggaaatcaatttgagactcgacttcgtcagtatagggcaattttgaataaattgacaattgagaaatttgacaaactatatgaacaaatattatcagtaggtataaacaatgaagaagagatgattgggctgttaaagcttgtatttgacaaagcaacgacacagcatcatttcatacctatgtacgttgaactctgtgataagctacgcgatcacttaaaagatgtaacaaccatagagaccaggcgtattttggtagatctttgccaggagctgtttgtggagaacttatcagaaatggttttgcctgaacacattcaagacaatgaagaagactcttttgaatggcaattaaaatataaaaataagatgaaaggtaatatgatatttatggctagcttagtccgcaaaaaggtcattgcatcaaccgttgttttgatgtgtatggaagaacttctacaattccacttaccacatcatttagaggctttatgcgtatttctacaccatgtagggccgtttttagatagtgaaagatggaagcattatgaagattttaatactttgttccttcaatttgaagagttttcaactaataaagaagtgccaattcgaatccggtttttaattaatgatgtgatagatagcagaaaaaataactggaaaagcaaaaatgctaaggaaggtcctatgatgcttgacgatctcaaatcgaagattaatgcggaacgtggagagtcaggaggtagttcagcaaaagtaagtaattcatcacaatataagtcacaaaatggtagctcattcaaagcttccgacaaaaatgctgcaacagataataacgtcaagtccgcagccgcatcttctaatccatggcagaagcacgctacatcgagctcttcaaaaggagggcccgtaggtagcaataattctgcaaaaacttcagaaaagaacaagacttatagccaatcaaatcatgacgctaacattgataagaatggctacgggcaagaaattgatgatgagcttttagatgaagaaaatgaatactatataccagagcatataaaggacagtattggagggctaatggacagttatgtggcaagttatgatttggatgagttttttggtcatataaatgatttagaaattcctcaggagtactttgatggtgtttataaaagtatatttatacgtatagcagagtacaaggttaagcaaagaagtgcattgtttaaagctctaatcctatactcacttaaaaacaaagaatatatgaacggtgagtcagcaaaatcaggaattcaaatggctctccaaccaagtattctggatgatattctaatcgatgtaccgcaatttaaagaaattgttttgactgaatttattactgatgcgatttctaaatacgactcaaatggacaagtatttgattcagattttatttccaaagctaatttacttttgagttaa

SEQ ID NO: 2414 - DNA, 309 bp, Cryptosporidium hominis
atgaatcgcccaaaatatatttcaaaactcaggagaaagacaatcattgtagaaaagaatcgctcacaagcaataaatgaaacaattaaattcagtttgaacataaaagatgaactttcggatttgagttgtactagaataaataccgaatgtgaacttaaaaaccaaaaggataaaccttcaaaagttgatgaccatgatgaaataaatagaaaactcgattacttaaggtggaaagagagagagtataagagattgaaaagggagcactttgattatatggttaattgtaaatgtaatcatacttaa

SEQ ID NO: 2415 - DNA, 1353 bp, Cryptosporidium hominis
atgatggtaggtaggacaccaagaacaaaacatggagaaaaccactcttcgtcttgcccaagcgctgaaaatgtgactattaatgctgataaaaaatcaatttctaataaatgttgcaataaaactaaatgtagttgtacctcgtttttatggaagggtgtaaacatggacttaggaacttcggatgaaggaatgtatggagagactagggaaaaaggcttgagaaaaatatttttaaaaatggctaaatatgggatggataatacttcaattctattagatataggatccggtaggggagttccaaatattgttgcatcatttcagaatagtttattttcaagtattggtattgaacttgatgagaaggcattttttttatctctctcaaaccatctgcatattttggaatctagaaagaactcatatgaaaattctaatattgagaattctaatatttcttcagactttacagattcgaaagtaaataagaataacagtattggattctttaaaggcgacgcgactattttagaaacttttgaaccagttactcacatttactcttttgacgctgcaatgccaatttggatgattaaaagatttgttgatctgttcaatgtgagtaggactacgtactgttatgtttcatttagaaaggacttagttgagacacttgatattaaagcaaaaagaattcatggaatttctactcaaatgatgggctctggggaaggccgtatgtgctggctatatcttaaaaatgactggaaagaaattaaagaatttgcatggatacaaatctgcgataaatacaataatggaaaaagctgtgaatcatttgatttgacaaacctaacagacattgacaaaattattcgtttttctatttgtagctctagtctccaaatggacttaattaataaaaccttaaacttttggttcaataatagaaaatcgagaagagagtgtttgacagaaagaaaaattattaaccaaaggcataaagagctaaaacaactatatatacaagagaaactaatcaaaaatgatgcaaaccaactgacactcgaagatgttggcgtcaagatagcatcaaatacgcgttctaacaattcaaataagaatacgagaaaaaataaaacagatttcgcaacaaaaagtcctgaatgcaatgcaaaaaataagaataaatcttatgtagatggtatttcagaaaatcttaaaaatgaaaatagttcccaaacgcaaccaacaataaaaataatggatccatcaaatttgtctacaaaaaaaagtagagctaaacgaaaagttgcagatgcaataaagcgcgttgaaataacaatatga

SEQ ID NO: 2416 - DNA, 1053 bp, Cryptosporidium hominis
atgcttccaagagaaacaaattgttttaatgatgaaaacaactctgcctccttaattaacagttccagaactgagcaaaaattgaatatcaacgataaaaatataatagattcaaaacatttagataaaatagaaggcaaacaaagacgtgagttaatgttaagtattaatactcgaaaggagccttctatcgatcaattattgtctagcgaccaagcctattcaagaaaccagtctgaatttgaaagactaagttttatttgtctaaagccagaaccttcatcaatatcttccatttctaaagagatgaggaggctatgctctattttgacttttttatttgattcgaaaaatagtggttgcttagagtttacagaggaacaatttaggtggcactggatcaatattttgaaatgcaccactatagaggagtttagcccataccaggttattctagccccatttgaaaccaacaatttgaatttagtagctatggaaaaagttatttgcgacctcaatgcattttataaattaaaattacatgaaaaggaaaacaagactttaagaagtgtatctaaaaggggatgtaagaaaaaaaacgacacagttacatctgtaaagtttgatcaagtattagctaacattaatgatagtataaatctgggagaattgaacagaacaagagacgagatttatgaaagctcaaaaagatcttcatgcgaatcctcttccaagaaaaaattgagtaaacctagtaggaaatctatatctaaagaaaatgcagcaagaatactacgaatgtgtttggcttctggggcttcagaggcaagcgaaagaaagaacagcattaaggaaaataacagcaacgaactttctaataaattttcagatatatgtgaatcaagttatctggataataataaagaattagaaagcgacaaatttcaggtgaatgctggatgtggagccaaatcaggtattggcgaaaaggattgtataattaatagcaaagtagatacttcagcacatcttccactagataatgggacttga

SEQ ID NO: 2417 - DNA, 1641 bp, Cryptosporidium hominis
atgctatttccaacagttttgtgggcacaaactaaaaaggcactttttgtcacggttgacttgcctgatctcaaggattataaagttgagttggaagagcaatacttgaagttccatgccaatgtagaaaataatgaatatgaatttaaactagattttttgaagcctattaataaggaggaaagtaggtatcaagttactagatctctccactttatgataacaaaaaaagaagaggaacgttggagttctattgtaaaagattcctcgaaaacaaagaactggcttaaatgtgactggaatagatggatagatactgatgaagaggaaaacccgtctagcaagtttgacatgttcggcggaatggatgggatgatgggtggaatgggtggaatgggtggaatgggtggaatgggtggatttgacttgagccaacttggtgatatgagtggtatgggggatatgaattttgatgaagatgacgttcctgatgatgaagatgacgttcctgatgatgaagatgatgaagagcccaagggagagccagattgttctaataagtgttgtgattccgaacacaaacattaaatgcttccaagagaaacaaattgttttaatgatgaaaacaactctgcctccttaattaacagttccagaactgagcaaaaattgaatatcaacgataaaaatataatagattcaaaacatttagataaaatagaaggcaaacaaagacgtgagttaatgttaagtattaatactcgaaaggagccttctatcgatcaattattgtctagcgaccaagcctattcaagaaaccagtctgaatttgaaagactaagttttatttgtctaaagccagaaccttcatcaatatcttccatttctaaagagatgaggaggctatgctctattttgacttttttatttgattcgaaaaatagtggttgcttagagtttacagaggaacaatttaggtggcactggatcaatattttgaaatgcaccactatagaggagtttagcccataccaggttattctagccccatttgaaaccaacaatttgaatttagtagctatggaaaaagttatttgcgacctcaatgcattttataaattaaaattacatgaaaaggaaaacaagactttaagaagtgtatctaaaaggggatgtaagaaaaaaaacgacacagttacatctgtaaagtttgatcaagtattagctaacattaatgatagtataaatctgggagaattgaacagaacaagagacgagatttatgaaagctcaaaaagatcttcatgcgaatcctcttccaagaaaaaattgagtaaacctagtaggaaatctatatctaaagaaaatgcagcaagaatactacgaatgtgtttggcttctggggcttcagaggcaagcgaaagaaagaacagcattaaggaaaataacagcaacgaactttctaataaattttcagatatatgtgaatcaagttatctggataataataaagaattagaaagcgacaaatttcaggtgaatgctggatgtggagccaaatcaggtattggcgaaaaggattgtataattaatagcaaagtagatacttcagcacatcttccactagataatgggacttga

SEQ ID NO: 2418 - DNA, 1104 bp, Cryptosporidium hominis
atggattgggaaacagataaattatatataaaactatctgaaagctcaaacaaatatggaatagggtcacagattataaagtccttccatgaatatggaattactcgatcagaagaaaataatcctacaaattatttaattgaaggttattcccaagagactttttacaataatttgattccgcactgcaatatttatcccaaatttgaatacgaatcccacttagacaaaataaggaggataaaaacatccaaaaatttaggaatttcattaagtaacaaaaagccgttggtaataatattttttgtttcaattgatgtatatgacaaaataaccagtttaaataagcttaatattaaagattattttgggcacattgtcattgacttgttattttttcaagctaaaaagtttgcttcaatcatgggggcacgttgcgtagttgtttggataggtataagagattgtttgtctcaggagtcattgtttagcaaggaaattatagaattacaatctaatattggaactgaagacaataataataggcaaaaacaaaagtttattgacagatcatgcttagataaatgcataacaaatttgttggtcaattattcaattgatagttttgaggcgaaaaatgaatttgaggcaagccaatatttgttaagtattatttcaggtttacatgaagtccaaaaaaggcctatttcctcaaagtacaagccaaaaaatacatcaggaacaaatagtaatccatggattactcaaattatgcagatacctggactctctgatgactctgcaagaggaatagaaaatgctttcaaaaccccaaaagaattaattaggtttataacagacaatatagctaggcagggattaatttcaagcaagccaagtttgttctttgagagtttatatggacattccagcacattggacattgaaaattcttcttggttcaatgagcttgccaatatttcatatttttgctccaagggtttctgcatccgtaaaattggtaaggcaagggccaggaagttggttattttatatggaaatttatcatttccatcaaaaatgattggggaccaaatttattaa

SEQ ID NO: 2419 - DNA, 942 bp, Cryptosporidium hominis
atgtacaatgttcaagacgattcagtttcaaatataatgaaaaatttatttaataatgtgagagatattataattattttttttgagtatatttacgagcttaatttcaattttaatgtgtatggaggtgatggaaattaccatattcaaagttatattagttttatcttgtctaaatataattttgatgatattgaattagtgaaagatattatcatttgggtaacaattcctacagatgagaataaggaaattttatatgaaaaactatcaaaaaatgacagagagataattgggtcaaacaaagatgaaaccaatgagtttttggaaaatttattcccttcaaaactgtcatctattaaaaacgaaactgaacaaaactcttctatccaaacaggagatgtattaacaaaaaactttagcagctcaaataataccaacttgaatatagagaattcacaagcggtgggaaacttcaactcagagaaagaaagcgaaatattttctaaaattattaatcctgaattactatttaaactaattcaaactgccatattgaaaaatacaaactgtaaaccaatagaaataaataaacagaacttcaatgaaagcaatagtgaaactaaatgcgtatgccctcttggatacacattgtgcagttcaattgattatcattttggaaatcatattagtacctttgataagagtagaaagatcgaaataagaactcctgaaggtgttttttcagataattttgttcttaaccaaggtgggatattcgaacaagtttatgaagaagataaagaaaaatattgcaataaaccaggagcaaaagcaatgtgtagttccaattctgaactgctagatacattaaaacattttgaaataaaggacttgtattcaatgtttgttcgctttcaaagtgctgaagaatctagctaa

SEQ ID NO: 2420 - DNA, 1299 bp, Cryptosporidium hominis
atgacttctatacaaaaggaatatataattggttgtgttggtaaaccttcttccgggaagtctacatttttctcatctattactgacaatgcagcaaaaataggtaactacccattcactaccattgagccaaatgttggaataactcattacattgcagaatgtccatgcaagaaatataatgtaatatgcaaacctaagtatggaaattgcaataatggataccgatatgtaccaatcaagatgcttgacattgctggattaatacctggtgctcatcttgggaatggacttgggaataagtttctcgatgatcttagacatgcgcatgttttgttacatataattgatattagtggaaatacaaatgaaaaaggtgagtatacaactaattataatccaataaatgaccacgagtggcttagaatagaaattgaaatgtggatttttaataatattaattcaaattggtccagtgttgttaggaaaagcaaaacatcagatatatcaatttccaagctcttattaaatcagttttctggatatgggtgtaacgaattaatgatcagcaagcttatatcttcaatgaatcttaaagattctgttgatttttcaaactgggataaaactaatatattagatttagtaagacaattcattaaaattagatttccgtttgtgcttgtgctaaataaggctgacataatgagtgagagttctgattcaaatattgtaaagttttacgaaaagtatggaagtgatcatgaaattgtagtagcatcgtctttagctgagtatttcattaaaaaaatggtaagacaaaactatattaaactagtatacgatagtaataattacaattattcttcatttatcacaagcgaagatattcataatgaagaatctcacagtcttaagttaatagatgacaagttaaaatcaaggttagaaaatattaaagatatggtactattcagacatggagtcacaggagtacaagatgcagttaacaaggctgttgatttattaggcctgataccaatatatcccgtaaagaacataaaaacttttacgaacaatttgcatgatgaaacaaataattttgcgtttcaagattgtattcttgttcctaacggaactatggttaaaacatttttaaaatcattgcatattgatttagagaaaaacctggtaaatatagaaactgtgggagggattaagatatctgaaaatcatattttatcaaaacaaatgaatgtaataaaaattaccacggttagctatgatgagaagaaatag

SEQ ID NO: 2421 - DNA, 1476 bp, Cryptosporidium hominis
atgaaacttaaaaatcagaatgaattgatttattctagttcatcaaaatttgataaggattctcaagaatttattatatctgatttagataaaaaattttttttgaacgaaattgatcaaattcattttaaaaataatagtattgaatttggaactatagatcgaagtttggacagagaacatgccacaaattaccaagaaaactcttttaaaaaacgttccaacaaatatattgttagttattctgagaaatcttctgatataaatcaatgtgaactaacagaaatagtacccacagggactgcttatttaaattccacttcatttgcttcaaagcctttaagggaagtctatgttgggaatttacctcagggaatcacagtcgcagaattactagaatatattaatcgttcaataattaaaaatagtgtatctcatactcatggaaatccagtggtatcagcatggataaattctgatggtaagtacgcgttttgtgaatgcagatcaatagaagaagcaaatgctttgttaagacttaataatttacttagcttcaaaggaaatttgctgagaattggaaaacctaaggttagcgaaaatattattggagatcaaccgtcaaataactctactttaatcaatcaaatctcacaaagtacagccattatatcgccatattttaataacattcctttggtattaaaaaaaaaggaaactattctaattactggaataaataagaaattcgttttagaggatattaaagaaatgttcagcattaaaaatattgaaatactggaactaattgattaccgtaataaatataagatagcaatatgcgaaggggatcttaacacagatattaccgataaagttgtgaataaacttgggacagaaattaaaatactaagaatgaaaagttgtaattcaaaagtcatccatgctgttaacaatcatcttaaaaatatgtcttgcatagttagggaaagtaataaattattactcaagagggaaaagttcaataatattcaaaataaaaatgtgatatctttgctccttcctcaaaaaccatgccgctgtattttactttcaaatattcttgcggttgaggagttattgattcctagtacttactcttctattcataaagaaattcacgaaaaatgtttaaaatatggagaaatatacaaaaccactattccaattccggaaagagctctttctagcaaagatcaatttaatgatccttattttggaagagcatttatttttttttataatgtggagagcgcaataaaagccaagctagatttatttagaatgaggtttctcggaagaaatataaaaataagttattattgtgagcatgaatttcttaatggcaatttattttcatgcgagcctaacagattcgatccaatcgatgatcaagaacttttaaaaattataaatcctatccaagtagattgctaa

SEQ ID NO: 2422 - DNA, 300 bp, Cryptosporidium hominis
atgttgattgaacagcagttaagcgttgcaaaggcttgtttagataatctatcaagagaaaagaatgaaaccgttgaaaaactattatcattggaacaatggggaactttaattcaaacaatgaatcagatgaatcccgaactgcaaaattcgcttaatacaagattaagtgagctcagaaacaaagttgaacgtttagaaaaacaagaagatactttgaatgatgtcattaatcatcattcatctattaaaggtaggagcgaaaacgaaattttggcaaatgataaaccattgaattaa

SEQ ID NO: 2423 - DNA, 642 bp, Cryptosporidium hominis
atgtcatatttatttcatgcaattggtcatgaatattcttattttgacaaaaagaattattccaaagacgattggatagctaaaattagcaaatctacaactgtttatgttggaaatctttcattctttacgacggaagagataattggtgaagtatttggtttatgtgggccaataaaagctatttatttgggtttgaaccatcaaacaatgcagccttgcggcttctgttttgtccagtattataatcatgctgacgctttaactgccgtaacattcctaaatcgttcatattgtgatggcagagaaatacgtgtagattgggattctggagaagatatttctggaagtagaaggtatggacgcggaaattcaggatttcaatggcgtgatgagctaagaaatcagatagatcccgaccgtcaactcgatggagttgatacaaatagtcactctaagagttataaattttctcacggaagcaattcgagctttcagagaagacatctgggaggaagaggaaggaatagtcgtggcacatttaatatttcacactataatagacaaattaaacataaacatcaagcatttgatcaattaaagaataccaacggatttcatgataactatcctgattattaa

SEQ ID NO: 2424 - DNA, 1761 bp, Cryptosporidium hominis
atgtttatggaagaaattgaaacaaatttgaaaaaaaatactagaatatttgaggagaattcatctctatttctagaaaatattttaattccaaaagttaggttgaaaaagttgattgaaaatgggagtttgttaaagttatctggattagatcaaatcagtacaacttctaaagataattctaactttagctacgtatttatcgtgttttattcaatttcagatgatttaaatcactcgaatgatgaaattaataaaagatatactatatggaatatcactgatctaaaaggcagcaaatgtaggttatatctcttcggagaagtattcgaacaatttcaaaatgaattgattggatatttatatctaatcattaacccatcaataattacttctgatgggaacaattttaaaagttatttaagcatttcaaaattaagtcaaattatcaaagtaggtaaagttaatggattctctatttgtaaaggggtaaataagaatggaacattatgcacaaatcctatcgattccaactatcaagggcaattatgtaaacatcatatttcttccaagacaatagaaaatctaaaaaaaaaatcaagtgaaaatcgattagtatatccttcagccttgcaaaatgataataagcctttatgcgatggagaaatagaaagtataaaaacagattcgttgaaacatatttcgaaagaaaataagatgaaatttagaaggttagtaaaaaccaaccttaatggaattgagcatcctaatactagtgaattagaacgcgtttggactgatcttgatgaagatacgtcgagtaaacgcgaaatttttaatcttaatgacaagttaaataaagcaattaaagaaaataataatagcgaagtactaagcatcctgagatatctgtcaaacttcgatacgtttagtacatcccttgatgtcataataaaaagtggaattatttactccatttcaaatctagaattaaaaaccatggaaattgagactgcaatatttgccttaagagttagacataggctctgtaatagtaaaggatactggccaaggatcaaaatcgaaatacccgaaaaaaatgaaaattttcgagttccagaagcccgtttagatgtaaactggaaagatatgtataaaaaaatctcatctttcgaagataaaatttcaaagggcgagaataaagaaagaaatttattgttgggaagtttaacaggtgtgaaacagaatagtggaaaacaaaactcaaacttaaatgctattttttctaagattgaccaagttgtgtcactaaatacatcttgtgataacacaattaaaaaatttgaatctaatcaacttagaaaaaaactattggagttagaagaggcagataaaacgactgagcttaaaagaaatatcaattcagtcaaaatttgcaatgcagtaagatgtaagaaatgcggtatttggacagagggtaatgcaaatctcatttgtaaagatgaacatcctgaatccataatattcaaccaaaatgcaataaaagaatcttggttatgcaaatcatgcaatgaacgtatatatagcataaatggctacttaaatccatattgcccgagatgcaaagtagatacagtgtgtaacttaaaaagaaattcaatttataaattgagagtagaatcccctgataaaaaaaaaaaaacactgttgattaggaatggagagagaatggatgaaatagaaccggtagatttagtgtaa

SEQ ID NO: 2425 - DNA, 834 bp, Cryptosporidium hominis
atggatgaagaatgttttaatgtacactctcctggagtttttgaggttagaaaggcaggaaaaagttttaggaaatctgctcctgctgtagttagagcgataccaagagtaaataaaagatatgctaaaccccctttttctgtggaacaattggaaaaaatatgtgcagattatattcgtccatataggcagatttatagaaatgctgtattaacttatacagagagaaaaataaaaagtaaaaggaaatgcgagttattcagaaaagtcttgttgaacagagaaaatttatatttcaatagtctgaaaaaatgcgtaatttttgatacagattgggctaaagaaaaacttaaacaagaagaaaataaaataatatcattgacaaataatgaaacaaaatctttgatagatgtatatttattgagatcagttgcaaatgaaaagacaaataaacaaagagagcttttagtaaagctcaaacaattttggtctgaatatccagaaaaacttaacaaaaaaatcgagtttgaaagaaataaagtattggatatgatgaaattaattggcgagtcgaagctgaagggcgaactagtaatcgaagcgacccaggatatttcaatgaatttatctcgaccgaatacattcaccaacaatgataagttctctttagaacaactagagcaaattagattgatggctacaggatacgaggtcacaacaggaaaattttcagtaatgattaataatttgactcaaaggatcgatcatattctaggagcagaaaaaagactgaataatgttgcgaaagctttagttttgaactctgaaaaatag

SEQ ID NO: 2426 - DNA, 537 bp, Cryptosporidium hominis
atgagtgcgaggttaagtattgaagatgtaattgagaggatggaagacgaaaaacttcgcttgctacaaaatcagtctgttacgagatatgaccctaatgttagaggccgacattctgttgtttgtaggcattggattagaaacatgtgtatgaaaggggatttttgcgattttttgcaccaatatgattatgagagaatgccaccatgctttatatatcaaaagtatggcgtatgcgtggatgaggcattggggaattgtcccttcaaacacaaggcagatgacacaccactttgcgcgcaatatttcctcgggttttgtaaatatgggcctaagtgtaaaaggcgtcatgagccaaaagcaagacacgaaataccagatttccttccagactcattcctattatctataatacaggacaaaaatttaatacctaaaatggatccagaaacatcttccattatcaaagtattagatgacatttgcaaagaaagctatgcacaagctgtgtgctcggaagtatcaagtaatatttaa

SEQ ID NO: 2427 - DNA, 5028 bp, Cryptosporidium hominis
atgcctacaatgacttttagtgaaaaaagttcgatcgtcagcaataaaatgggagcattcccatctattcttccctcaatagagcaacaaattattaataaattagataaatcctcaaatgaaagctatcaatcatctaagataaatgattttaagactaacttaacagaagtagaattagaatggtgggaactacaaaatttacaattaaaagagaattatgaagatgacaatgcgagcactagtagtgatatatctttgatttgtatactagacggctcaagcagcgatcaatctaattcctcgttaattaacagaccacagcataataattttgtagctgggcaagtgaaattcgatttattagataatgttattgggaacttaaagcggaatccaggtttggcaatcgactctttattgttcttctcaagtacaagcgaatctatttcaatctctctttggaaaactatttttccgtggatttggaataacttggagtaccaacaaagaaatgaattaacgcttgatattattgaattgctttctaaagaaagacatcatagagtgagttcagcaatgccttctgaatggacaataccgcatgttatacttgattccctattatcatgtgacaatccacctattttaccggcaactttgcttttgcatttatcaacgaaattaagatgttggcatattgcatccaactatttgagtaaccagattaatatgagtaactcccaagcaaacattaataagaaagaaaataactttatttctaaagtgaattgtaatcatgatttaaaaaataacttagttcaagatgatggacctgatagttcttggatgatattggcacaaatttatggagaattacaagaagaagacattgtaattggcattagaaggtcattttccaattgtctcgaaacccatatgggattagcactaatgcagcaggcggagtggagtaaagcacaggaaatattttacaataaccttgatgcaatatataattcaagtcctaaagctactaatagtaatgcagattttaaccataatattctaaattgggcaagaatttttgaaaactctgattcatcactattaaataatgaaacaatgatttggatagatagttgggttgcttgcgcaaagcatctaaatcaatggaataccctaaacgagtttgctaaggagcgcagaaaccctcaacttcaattggaatgctcatcaaaactacaagattgggttttagtggagaaactagtcaacaagtatattctgcataaccctattacaaagttatgtcaagcatatcattctttatatgacttgctattaggaggaattaataacaattggaatttgcaaagtaaaggaactcaagaatcactgtctaactctaatactaatataagtaaccagaatcgagtaaataattcaacaaatagtcaaaacttaaataatggtgcttactgtcagcagttttcacaaagtatagttcaaaataattcgagatcaaaactagctgaatttgaacgccactgttcaattggctatagaactgtgctaaatttttgggctatgctaccaagcgtagtaactacatgtcatgttcctctactgttaaatttccagcaatatatagaactgcaagaaggcttcagactctcatcagatatagaaagaaaactttacccagatggtccaaacagcaatattaatcactccttaaacggtaatattgttcagaatactgcaaattttggttcaaactatattattcatcactcaaatgcaaataatcttgctcaaagctcacaatcaattaatacagggaatccaaattcccatggaaatattaactcacattcaaaccttcagaatacaagcaactcaacgccaggttattttgaggctagaatgttgaatgtatggagagatagattgcctaataagtgggacagtatgatattatggaacgatctttttgtatggagaaactttgttttctctatcattatgaatctaattagtaggtcagaccatttaacttctcaggcaaaatctctttggccaagttacttgcaggatatgccctggacaatgataaaattcgcatcaattgcgaggaaatcccatcgtttaccagaggtctcggttgcattgctacagagattacaaaatcatttacaggtttcaggaggagatgcatatagggcagaaacatttctcgcaactttggaaaaagttaagctttgcttatctgatactactcaattaagaactggcctaaatatcctcaatatgactgatttccaaaaatgcccggagccttattttgatgaatacagggcagaatttctgaggttaaaggggattatttcaaataaattatatccgaattattatattgatggcgaaattccaaataatgcaaactctgtaacaggaagcagtgtattaaactcagaacaaggacactctggtttaaataatacgtctgctacaggtattggtacttcagttgttcgtgttaatgcagatttactttcttccttaaaggtatatccactattcgcaagaggatggatcacttgggctcaatatactgataggttattatatatacaccaaaacatgagttatgcagttaatgcagtaatctcttacttaatgggaatatatttaaggccagataaatactctattttactttcaagagtactttggttattgcctcatgactctcctgatggaaaatatctctcattagcatttaaaaaatattcagatcatttaccttgcgctgtttggcttccatggattcctcaattgatagctggaatagataggattgaaggaagtgctattttgcatattttaaacaagattgtgttaatattcccacaaagcatttatttcaatattagaagtagctatcttgaaaaaagagaaatggctcacatgtattggtatttatcctctaattctgaaactgaaaatgcaagccagggtcctccgcctccgccttcttctggaatttatccgagttttatttctttgggatggcaaagaattgaatcactgatgaatacttgtagaattagacacggcgcactaactttagctcttgaacactgggttgaagacatagtattacactgtaaacctgacccacttgatgaactcttatgcgcaatacgtacattattccaaatgacaattgaaatctcccctattaatgatgaatcaataactattcaagattcgaatttgagtgatacaaaaacatccgacattttcccaaatataggaacacactttttggaacacaatatcattagaaggtacgagcagttattgagtaagtcttcatccttgaataataaatctttcgaaagatctaagaacattatcaaacaatattggaacgaatttaaaaatgactttcatgtttatttatgtaatagcgcaaaccctcctattgaaagggtttcacaattaaaactcgactatgtcttggaaaagctcaaaaagtggaaagatcactttactaagtgtacagaaaggtattcaaatgaaaatatcagaggaaagtctctgttatcggatttctcaactactctctgcgatctattccatagaatcaatattcgtttggaagttcctggacaatatttgagaattgtctctgaaagtctctacttaagaaattttgctgttttagaaaacacaaatagtaataatccgattggtggagttatatacctacatagatcattgcctacagttgaaacggttgtaagacaatcatacacactgaaaagaataggatttatcacttctagtggaagtactatacacttcttaattcagccatatagtgggcttcaacaaaaggttgaggaacgcattcttcatcttcaagttacactaaatacacttttatataaatataaggaaactagatccagaaatatttcttttgcaatacaaccttgtataccattgcatccacgttgccgtatcattgaagatacaggaaataagaagagctttaccgaactttttgaagaggaagcgaatagcagtaactgtacatgcccaataaaagaccttgacttcccgatattacttcatagaaagcttatcaatatctcactcaggaagttgaataatataaataattcacagcttgataaggaaatgctaaaaatttatactgagctgtgtgataattgggtcccggatgatatctttaaaagaagtattttaagaaagttcaactcacatgaccaatcatttttattcactaaacagtttactactcacttgggtttactgtcaatattttcatatattctgggtgtaaatgatgttactcccggaaaactatttatttcgttggatactggccaggtttatcagtcagaattaaaatcctcttatgtctcatccacactgcttattgataaaactgaaaaggttccctttagattaacaagaaatatggagcatttaatgggtcccttcggtaagaatggtatccttccaggcactatgctcgcatttgctcactgtctacaaaaatatgagtttcacgtaagaaatttactctgctctctgcttagagacgatttgcatgcattttctgtacatagagctttacagatccctcaaaattgtaatttgtatcaaaaaccaaataaccctcctgtagaatcggactttgatcatggttcgcaaacagtcataaactcacccaacacaacaagtgaacattctcaaaacacaatttcccagataatgcagcaaagattactttctaacgttgaaattagggagaaagtagatagaaatgttcgcaggatgatggagaagatagcagtattaactaatcctaggccaatcaatgaaaacaatcaactcattgacaggagtgtactcgagctgatagaatgttctacggatcctaaaaacctttctgccatgaagccgacatggatgccgtggctataa

SEQ ID NO: 2428 - DNA, 993 bp, Cryptosporidium hominis
atggaaagtttatctactaaaaaattaaatcctcagaaacattatgagtttctattggatctgtattccaataaggaaacagttaatagtcttctaagttatcccatcaaaatatcaggtctattttggggtattggaagtatgaagctattatttaataatttacaaagtgaagatagaaatcaaattaaaaaactagagactcgtatttttgagtttgttgagagctgtaaagtatttgttgatggagatatgacgatggttggttattctcagaataaggggttaaacgctaacatagtttctacgcattacgctctccttatactaattatgattgacaaactagatcaagctgattcagctaaaatttcaaagtggatatcttcactccaaaataaggatgggtcatttcgttgcgatcaatatttggagactgattgcagattttcctactgtgcactatcaagcctaacaattctaaaccgaataaacgaaattgacataacaggcgcccggtcttatttattaaggtgttacaattctgatggagcatttggcggagttccctgctcagaatcacatgcagcatacacatactgctgtgttgtttcgctcgcacttttaaactctctggatacaataaatattgataggcttgccttctggctttgcgaaagacaacttctttgtggggggtttaatggtaggcctgagaaggcacctgatgtttgttactcatggtggatattctctctgctttactttttggggagagcgaactacattgataagaatttattggaggaatacattttttgttcagaagacattttgaaaggcggattctcagatagacctggaaatgtatcagatgtatttcatacattttttggaatttctgctctttctttaataagattcgacacaattgataatataattagccctatttttgcagtccctcttaatttagtacctggtgatagctaa

SEQ ID NO: 2429 - DNA, 2832 bp, Cryptosporidium hominis
atgaatgttaacatagactacattgcattctcatttgagaaaatacaaagtaaatattcgctcatgaatatgaaatactttccaattgcactaagagttcattgtgagcaatacttaataaatccatccggaaaaatcatttcagataataaaactgcaattcaatcgcagctaattgtaattgataaaaacataaataaaaaaagtgagaagatatgtattaattgtgagattagcttgcctaattgcggagcagttaatttttcatcgctttgcaactatactaatgtctatatttttaaacttttagatgaaaattaccttggtaatggagaatttgtacttgggtactccatacttcccttggtttcggcttactacactgaaagactttcatctattaacttacctattctaataaacttttcgggggtattcgaggaaaaattaatttttgatttgaatgcacaaatatatgaaatacttttcccacaagaaagtaaattccaagatgacatttatttgagcaaatttagcgataaattacttgggtatttacgcttatcatttaactttaaagagaagaagatttctcacataatggccaataaaaacgttttgaatacaaaacaaataattaattctagctgcatctttaatattatttcggataacataaatctattaactgttggagattcggggaaaagaattgatttcagtcttctaatgaataataacaaatgttcaatagattgtttaccttgtttttctatggagaattcattaattaataattatttaatgaataaagagaggttggagttagaaagagcaataaatcaattatatataggatatattacaaagttcaataataaagacttatatgaggatgaggttggattgatctggaaatataggttttatttatttaaatttaaggcaggaatacctatgttgtttcattttattaatttaaacgataaggaaataatggttgaaattgattatttaatcagctcaatcattcaaacaattaaagaaccgattgatactcataaaaaaagaattttgaatattgaagactcgttaaatttgctttcaagaaaatacaaggagttcttgaatattcgcaagcttgcaatagaaagcttggagttttgcacaaaagaagagttatttcttgttctaccacaactggttcaatctcttagatatgaaaatggaactgaactaatgaagtttctaaaaagaaaagcaacatgcgatctagaattttgtgttgaattattttggttgttaatttcggaaatttcaattcaagaatatcctaaagtctttgagcagacaatattcgaaatagttgatggccttgctgattataataattataatattaaagaaagtatggaggaatctcattgctgtaaatatcatttctgtttagaaataattgatctaattctttgccagatacaatttagagcaaccttgttatggatacatcgtatttcagttgaagactgtaagagagaaagagcagagaaaaaaatacaaaaatttcaaagtatattgagcgattttgaactaggaaagatgccttattctcaatcaaagatttcttcacgctcaacaggtatagataaaataactgttaaattaatcaactcgatcaaattaatgttaaaagttgaaagcgaattttcgaattattgtagcaaaaaaagaaacttaatttctttaaaatttgttagtagtcacaatgttgaaagtttaaaggaccttccttcagaaatcgagggaattgagctgccattgttaaatataacgaacttgagtgatcttcttctccttccaattgatgttaatagagcgttaattggtattgttccaagcgaaagttttattatcaagtcttctcaatgcccaatcatattttcttgtagaatggcaattgtcaataatagcaaaaaagaaaatagtcaggcaaatgttccaagagaggatatttacacatccgaatcaatatatcctgtagttgaatcaaaatatatgtacaaagtgggggacgatttgagacaagatagattagttgtacaacttttggaaatatcttataagctacttaacgaatggaatgcgaatagttcaattatcacatataaagttacgccattttcacaatttgatggattaatcgaatttctggacgatttttcttcaattggatcaatcagaaaaaaatatggaaaaaattgcatattgaattattgggcaaatgcatataacactaacataaacaatattcctcataatgttctaaccacctttataactagttgcgcagcatatagcgttattacatttatccttggtgttggagatcggcatcttgataatttactggtcgggaaaagcggccactttttacatgttgattttggatatatatttggagaagatccgaaacctttcccaccaccaatgaaaatttgttcagaaatgatagaagctatgggcggattaaactcattagggttcaagctttttgttgacaaatgctgcgattattataggtatattcgcaggaagtcatggctaatatcaaatgttttgttattgatggtagatagtagtataaaggatctcaattcaagacctgaaaacaattatatagttattttggaaagaattaaagacaagttcaggttagatcaatcagaaaaagaggcagaaaggtatttaagagaaataattatgacgtcatcaaatgcactttttcccgcagttgttgatactcttcatgattgggctctctactgggcctaa

SEQ ID NO: 2430 - DNA, 2007 bp, Cryptosporidium hominis
atgattgataaatcgagaagaggacttagtccgctgataagctattcaattcaaagccaaggatgtctgacggcagatcaacaaacttatttgcatctttcgaaccagaatttcagtggttttaaagatttttattcttcaggcttaatgacctttaagcagtttactttaagtcaagacgataatttagctccaaacgaactcattgaaatgtatgattcttacaagactaaatatgttcaaaaacatcaattagaatttttagaaaataatagaaactcgtccctaattctcgaaaaattccacccaatttggattagaaaaattattgatgaacggagaaatttggttttgaaacgtattgaagttttttctctgaaattaaaaagaggaggatttagaaaagtaaataaaacaaacaatgacatcgaaaaaataggctgtgaaagtactattactgatactggccacactgatgagaatgactcgattacggtatttggagattatcctaattttgagactgatttgaaatctcatattatgttgcttacagacattcctagttatatttcatatttagatataacaaagttctttaacagtgattttccattaacagatggggggcttgggaaatgcgaaggtttccttgatattcttctttctcctcccagatttacacgtggtattttaaacagacattgttatgttttatttgataatatgaagaatagagattctgcaattgaattaataaaaggtaaaacaataaagtcttcagttactacaaattcaattattatgtcctactgtgatgcaaataatcagatggaagatacaaatgaacatgaagatctagttgtacaacaacctggtgcaaagttttcaatttatatcattcaaccaaagacttataatgagaattattccttaaaaattaggcaaatttcgaatactttctttactcaagaaagactttcaaaagacaagagtaatatgaaaaggattattgaaaaaattgaaaatgatcaaagtattaactctaacataattgaagtgatagaaagcgtaggaggtagcgaccccatgaatattaaagctgttgttgacttgatgtcgttatatctaaagtttgcgcatggattagactattattcattatctacatcacatcctgtacaattcatttcatttagcccttcaaatcaacagatcctggaatgttcttcagatcttaataatacgaaagacttgagtttatctgacactttcagtcgagaaaatcatgaaaatttaaccaaaaataacgaaaagtcattcattatatatagcaatctcacatttttatctaagggatatattgatactttatttacgaataaatttaaaatttggtatcaaagagacgaaggtagtatttccgaatcgcaaatatgcaaggagaaaatagatgaatttcaaaatcaagctctagctaatcagcttgaagaaaatgttgatgttttattaaagctaccatctatttttgacctattacctcaaccaatcgaagataatgatgagtcactctcttgttcttggaagagatattgtgagcagcatacattaaggaaaaaagctgatagatggcagtgtggtaaatgtttgaagcaatttaaaggtgaagaatatgttcataaacatcttgctaaaaaacataaagattttctggaaacaattagagaagaaattacatttgaaagaattatcaagccaatagcagaaaaatttccatatctaatatacccaatgaatgctgacgagcttaatataaactcaatgaataggagagtaaatggcaatggaaatcctcaaggtgtatatagatcaagacacaacaagcacttacgttctaatccattcgaaaaaagaaagcattttagagattgggatacgcccaaacaacaaacaactattaactcatcaaatgatatgagaacttcgataaaatatgatgacttatag

SEQ ID NO: 2431 - DNA, 1419 bp, Cryptosporidium hominis
atgttttcacaagacttaaaaaaaaatgatcttcctgatgatatcaggcttaaagtaagtcataatataaggttttcagattttcctcttcacaggtgcttaattgatgcactattctctaatggttttatttttccttcgcctgtgcaatatcatattttgagtcaaggagttatagaggaaaacttattagtccaagcaaagtctggaaccggaaaaactattgcatttgttttatttattttcaataaactattggatagtttagataactgtttagaacgatcaaacctttgtttcgaactaaaatctctttttatcgctccaacaagagagatttgcattcaaataaacaagacgatctcaatgtttttgaattcaattaaagatatttactctatagacagtgtttgctgtataggaggaagccctatttttgaagattttggaaagtttcattttaacattcctactttattagtatctacaccggggagatttattcaattaatgaattatgaatcaaataactttttttccatagaaatgttcaaggattcacttttttttataatttttgatgaagctgatcgtcttcttgaagattgttttattgaccaatcaaagtatatattagaactatgtttaggttctacagttgcacaatttatagcatgttcagctaccttccctattgataaattacagctactgaaaagaacattatataaaatcaacataaattcgagggatgagaaactatttaagttgaggcaaattcaattatgttcatcctttacaacgaaaaatgtaaacgttggctatcttgaagtattgaatcatgttcaagacattagaaatgcagatgtcatgtatccaaattcaagattatctgtttcgaacactcttgaaaaccccgtactaaaaaatatgatattttttctatacgattcttttttaagtgaaatatttcagctagatggattaagtgaaaacaattacaatcagtgggcatatatagtgaattcaattgtagatattttgatcagagttccatttaggcagtcacttgtttttactaataatggttctgttggatataaagttatgtctgctttaaattcattaaatatcccaactttatatactaatggaaaaagatcgcaaattgaaagagaggaaataattacttcattacttgaaaataagtgtagggttgtagtctgttctgacttacttgcacgtggaattgacataagaatgattgatcttgtgattaatatcgatgtacctattgatagagagacttttttgcatcgtgcaggtagatctggtagatttgggcagaagggcattgtaatttgtatccttcaaataagcaagactacgattcatttttgtatttttttaatcaattag

SEQ ID NO: 2432 - DNA, 207 bp, Cryptosporidium hominis
atggttgacagtagacaggcttatgtttttccaattgctaaagatacattaaggatctcaattactgatttaatacaaattaaatttgattatcctattggttcccctgtaactatgaatgttgctgtggttaataagaaaagttgtttagtttcaactatttcaaatttatttccaatgaatattcatcccaatattatggcatag

SEQ ID NO: 2433 - DNA, 675 bp, Cryptosporidium hominis
atggtgcaaaattcgtttgaactatgtaagacttacaaccagtttaaacttaaaaatcttacagaatactcgtattgtactcctgatttgttagagctcactcagtttattatatttaacagcaagtcatcattcgatacaataagtgaagtggtagatgtatttagtttttttgatactgtcaagcgaatttattattcgtggcaaaaaaatccggttgcatcaagacaagttgattatgatttgttggcacttttgactgttttcagagcatcaaattggctgaactcgaatcaacacaaaattttagaagagtatattacagatttgacggatggatatacaaattgggatgtacttttccccgttcaaaatcttcgtattgcagttgaaagagcactaaagagtcaagttacagggattgtgcaagggagaaatggagtcgaggtatggtttagagaagggcatattggttctaatcaagtttccgggatggtaattttatcgccctgttacattcagatcaaagatgtgattgatggaagtatgtatacatatactggtggcccattccccatgtcacctctagactttgaggacattttgatgaattgcccgaaatcgtgggtttataacacatccatatattcatccaattcagactcacaattgtaa

SEQ ID NO: 2434 - DNA, 216 bp, Cryptosporidium hominis
atgaaaactgctgagagagctcatactcctagatatctttgggaaaaaattaaacttagtaacaattttttggttgcaatctcccaaataaatgataatttaaagaatgtttatcccgagcatcaaatactaaaatgcaaacataggttaactagaattagacaaactctcattcgtgcaagaaagatggcattaaccgtaagacccaagctgtag

SEQ ID NO: 2435 - DNA, 1476 bp, Cryptosporidium hominis
atgcatttatatgactctaatcatactaaaaatgccttttctttaggaaatacacgatcatttctcaaatacatattgtctaacgattatagactggaattttttttgaacgatacctacaagctagacaataaatatgttccgggtgaattacgtggaatagttaattgtgaacgaataaacatagatgaagagcatgtgatgattaatcactcaatattttcattaaaaaaacacgtttttctgttgttaaaattaaagattgataaaaaaaataaaataattcaattatttccaattgaaattaaatatagccaaaacgaaaaaaatgaatattctttaattgaagaattgatagttgaaaataatattgagattaccgatcctatttcaattatcgagaaaaatgttgattatttccatttaaatgaagcccttgaaaatttattcatgcctaacttagactcattaatggatttcatattttttatttggggtgcagatgatgagttttgggacaaaaacaaattacgtaacatgggaatatcaaaatggtatgaaaggctaagtaattacaaatccaaagttacaatacatgggattttatttaacattccagattcattaatacttgagtatttcgaatcagatgaccttgacataaattacgaagccttatcagagagctcaaggaagtgcctagaggatattaataaatcgataagagaaaatacagagttttttagcatgggtttttcaccgaaatttacatggtcagctcctacagacgcaacttggatcaattcaaatagaagtatttgttgcagaactttagaagaattatttattcttttaaaagcatctacaaaagtatctgaggacattgatagagcgaaagaaggaaatataagtaatgtattattgcttagagagtatataccaacactaaatgaaatgttcgaatttagagtgttcattgggggatgtagcctacattctgaatataaaattttaggtataagccaaaggcatatatgttactattacaaagaactttctgaaaatttcaaattgagaactaatattaaatcttgtatcatggaattttttctttattcaaaaaaggaattgatttcagaattattcgacatttttaacagtatgtgtattgcatttgatgtatatatctcaaactataaagacaaattatcaattcttataattgatgtacaacctttattgcacgcgtcgccccttttatttaatttattcgaactcaaactaaatttattgactgaagaaggaacagagttaggttttgatattctaagaacaacagagaataattcaacaaaaaacatgattaataatagttatctaaaaggtttcgttccggacgaacttttatccgtttccaactccgacttttataataatgaaactcttgataaactagaatggatcgattataaatag

SEQ ID NO: 2436 - DNA, 1719 bp, Cryptosporidium hominis
atggtgaggtgttccaaattaagttgcaagtatttatctactaaactcatttccacaataatttatctgacaattttaggattaactgatcattgtattttgtgtgatgctttacaaattagcaattcaacagacaatgaattagtatctgatgcaggtgaaagcaaatataagacgggttctatcgaattctatttatgtattttatttagcatagcactaattttttttggaggaattttatcaggtttaacgacgggcttaatgtcattagatagcgttcaattacgcgtattaattgaagcagggaacgagcacgaaaaaaggtgggcaagtattgccctcgaccttataaaaagacaccatctattattggttaccctattacttgctaactctatctgtatggaagcgcttccactttttcttgatagaataatcccaagctgggttgcggtcatttgttcagtcactgcaatcttaatttttggtgaaatactaccacaagcaatttgtacaggtaaacaccaacttagaatagcagcgagttgtgcaacctttgttaggtgcctcatcatttgtctatttgttttttcatggccaattagtaaatttctggattatttcattggggagaatggtaagacaaataatttctacgcaaggggccaactcaaggcattaatagcgttacatcgaagaactggtgaatttgataatgcccctatatctctactttcagtcgtaccaaacattatggacggacgagttgaaaaaaaaatttatattgaagaggttcaagtaaatgattcaggaaagaatcaacataatgatattaaaggaaaaattcaaagttttgaaaaaatgcatttaagcccttcattttttcaaacattattggatagcaatgaaagatttattattggctcccaaaagcgaatagaaagtaaaaatccgcttggatctaaaacaattgaaaattgtggattagcgaatgatgaagtgacaattattcaaggcgtactagatatggcaaataagagccttcttgaactttcagtccctttagataaagtatatatgctacacatcgactcaaagctagatcacctgcttttggaagacatactaagagtagggcattctaggattcccatttattcaggaaatagacacgatattaaaggattgcttttagttaagtcattaattactattgatccagacgactcaataacaataaagtcattgtttgactctaaagcctgtaatagatatattgtagaaccaattttcactgccccagatacaaacccctatgatgctctaaatatgtttcagcaaggtcgttgccatgttgctattctcacaaattatgttgatgagtacacatattcaactaagacaaatacacccttgccagaaaactgtgaaataattgggattgcaactcttgaagatataattgaagagataatacaagaggaaattattgatgaatttgataaaaaccaacgtaattccggcataaagaataatctaacatttattaatgaaaaaaattctattaggaggagctcatctttttttaagtttgacaagtccataaatgattacttgaattatgggttcaaaatatctaaaaaaaattataatttctacaaagaacattttgtttctgcgcctgacttgtggaatcctatatattatagtaaataa

SEQ ID NO: 2437 - DNA, 513 bp, Cryptosporidium hominis
atgaacaaggaacgaacacaagcggatcaagatacttcaaagtggaagattatttacccttcatacttaaatagtaataatacaaagtccagtggtagattatcttctctaattcattgtgtagaagatccaactgttgcagaaatagcagaagtatgtatccaattgggaataccttgtaaggttgagagcaaaagatattcaagggactgccgaactcttggaagagttagatttcaactttttgatgaaagtgggagggcttttaatgatagaattttgacaaaaaaaattctgctcaatcaaattggtataatgataccaaaattaaaaaatagacaaaatactacatcatctgttattgataatgcgaattcaagaaataataaggcaaacgttgatgaaattcatactgagaataattgcaaaattaaggaaacagactcgataacttatagcggtgtaaatatacattccagcaatgcaaagagcaattcaaaaaaaaaaaaataa

SEQ ID NO: 2438 - DNA, 855 bp, Cryptosporidium hominis
atgagctcaaagaaacatattcgagttgatgatgaatctaaccaattaaacttcaataatgaatctatagatgaagaaatttttttgtcagcaactgaaaacccatcttacggaaagaaagctaaaagaactgattcagactctagtgataatgaatctgttattgatggagaatttgaatttaatgaccctaatgaaaatgattaccatagcataaagaacattttactaatgtcgcagtattctcgaattaagggcattcaatttcatgaatttgttgatttgatttgtaatcaaggtaatataggaactacagtttctatttctgacagtattattgcattttctacaattctgaactttcgtcaatacaaaaaaactttaaataaaattgttgactatttaagtggagttatttcgaaaagtcccaacaaagaatttgaaaatctttttaattccattatatatgagaaaaatgttggattgatggttaatgaaagatttccaaatactccccttgaaatagttcctgccctttgtaattgtttaaaggacgatatacagtggactatagataacttatatactgatattccaaataaagaaagagagtattacaaatgggattacataattttacttacgactaggtatatttcgcctgatagcaatactataatatatcaaaaatacgaagaagaaaagcttgttattaattctttgcatactattatttggcaaggagacaaaaaacaactctgtggaacaggcaagaaagatgagacagaactgatgaaccagcagttcttggtttcaattttaagctatgatcaatttcaaaaaaactacaattaa

SEQ ID NO: 2439 - DNA, 309 bp, Cryptosporidium hominis
atggattctaaaggaaaaaaaaacctacgcttaagtaatagcgaccgtaagaaaaatgcggtcgcaaaagctactggagaaatgaacaaaatatttgaaactatactcaataagaaatcaactttcaaagataattcaagagcgcaaaaagagaagaataaactggcaaaacgaacaaaaaaagacagtgtaattagagataatacaaataagagcttagatattaattatggctatattaaacccataagatatctgaatgatgggctaccagtttatagattggaagatattaatctaggtaagtaa

SEQ ID NO: 2440 - DNA, 2145 bp, Cryptosporidium hominis
atgtccatggaaaactggcaaataaatataagctctaacataaatataaaaacatgcgataaattgaagggtgaactttcttcgcaaaaattcaagggtgagataaatataggcgtaaattcgaagagagcttctcaagttatggatgccgtcgggaaaatttcgaattcaaataagatacatttgaatagagagaatgtgcgagttattgtaagagttagacccattcaagattgcaatgaatctagttctagctgcgtaagtatcattaatgaacaaaaaacccaagcaaaacaaattgttttggaggacccacgtcaccgaggtctaccaaaaaaatacgagtttgatgaaatatacggtactgaaagtactacagaagacatatattcaaaagagattaaagattacgttaatccattattatcagaatgctcatgtataaatatttttgcctttggtagctcaggaacaggtaagacatttactatgcatggtgattttaataatgagataggaatcgttggattaacaattaagcaacttattgaaataaatggcaaacaagctgaacctggggccttttctttttcattttttgaagtttattgcgaaaaaatacaagatttacttactggagctgagcgtttagaacatttggatagacctttaaaatcaacaaaatctaatatttctataagaactgatatttgtggcagaattagaattgttggagcaaatagttcagaatttaaaacttgggatgaatttaattctgcttattcatctgcattgaaaaaacgtgcttctggtaagactgcagtaaattcaaatagtagcagaagtcatgcatgcattcaaattaattatattccacctgcatctaatatcactcaatgtgaagcagaaactagaaatgaggacacaatagacaatagaagaaaacgaggaagtatttcgttccatgtcaaacctaaagtaaatttgagttatccccgtacaattgttaatcttatagatctatccgggtttgaaaacaataagattacaaacaacactggaaaaagaatggcagaaagtactttcataaattcttcgttattatcattgggcaaagtgatcaatgcattgaagaaaaatgctggaacccaatcaagccaaagctgcatcccgtatagagaaagcaaactcaccaggctactacaggagtatttaggtggaggtgcagatccaccctattctccctattgcttgagatgtataatgttatgcacaatttctccatcagttacattttttcagcagacatatgctaccctaaatactccaagctatggtaataattcaatcatgagaaaatacattggaatcgcgtcagccacgactaacatagatttgaaaaatagttcagaggcaaatagagttacattaaaaagtcaaaaaattaactccagcaagtccttaaataaaatagttactaccggcaagaactcaaattcaaatactatacatcgcgtagccaaagctacaagtgaaaaaaagttatatgatagggcgaatgagcttttctctagaaagaattcatacaaaaatattgaaagtcgtatagcgcagatgataaaaggaaaggtaccattaaatgttggcgaaccgaaaaaatctagagatatcaattgtggagaaatatccaaaggctcagtcccaggcagtagcagccaaaagaatatagtaaaacagccatatttaataggaagtaccaagagtaagtgcactgaggcaaaaggatcagatgaaagattgatttcagatttaactaaatgcgacaaggcttgctgcaaatctattagatgcgaaaatgtaatagaaacggcaagcaaagctttagaaaaaaatgattgtttagcggagtcaaatataccagaacatcgtgaaggcccccaatctaaccaagataatgttggagattggcagataatcgatacttctgaaaacaagtcgatttgcgcaaacatagatgcttctaaagatgagaaagttaacgtggaactgaataaaagtaattcaagatcgagtacaaaggataagggatcactgggattgataattcgtagaccagttacaagatcccaaactaaaaaagattag

SEQ ID NO: 2441 - DNA, 537 bp, Cryptosporidium hominis
atgaataagacaatttttaaacttttatttttttttgcaatttatataatgattggcatttcaaacgcctctgatgtgacatctagtggtagcttgaagacatcaaacaaccttgaaaaagttaaactcgtaaatttggatttgtgtaactcgaaagaagcaactatcaatgttcaagacataagtagctctgattccataatatatttcattactgttaagcttggaacggaaattattgtgaatataaagggcaatccaacgacagggtatagccaagagatgattattaaaccggatgattcaattgtaaaagttatcgatgttgagccaagttacgttccagatccacacccagaaggcatggttggatatggtggcaggtatatcttcaagttcttggcagttggatccggttcaacagtttcgactattgaatatgcaagatactttgaaaggccaccaaaatgtatttttaagacagaaattcaattcaaagttatcgatctgccctgcgaagaaataataaaggaatag

SEQ ID NO: 2442 - DNA, 2805 bp, Cryptosporidium hominis
atgttgggaaattcagtaatgaaagaggactctctgatatgtaaaattgataatacaaagatagattcatacaagagctctcttcagcagtctaaaaaagaactagtatctaataatcattttagcagctttatcaacaatgagactaataaaaatgtatcttcgcactctaaatcggcctttagcgtcgcgattaggtttcgcccagccgtatgcagcgaaatcaatgaaatagaaaacaattcgatatgggaactttcacataaatctatttatgatgtgtcaaaaaaagcaaattattattttgatcatgtatttgatgataaatcaacaaactatttaatttatgacaaattaattaaagatgcagtaaaatcatgtttaagtgggataaatgtaactatttttgcttatgggcagacctcttcagggaaaacccacactatgtttggtgataataaaggaagttatgatggaattatacctctaagtataaatgaaatatttaatcctgagtatactaactgtaaccaatccgttggtagaaatagtaaaatcacagtttcatatctcgaagtatataatgaaaaactatttgacttgcttgcgccacagagcaacttaaataatagttcaaatgatttcaattcaaaaaaaattaaagtaatcgatggattagatggtactgtagactttatcaatttgacctcgaaaactgtatcttctccggaagacattcatggaatcattaaaactggtatgaagtcaaggagagttgctgaaacaactatgaatgaaagatcatcaagaagtcatgcaatactaaggattaagatagagtcccatataaattcgaatgatgtttgcgtaggtatattaaattttgtggacttagcaggaagtgaaagtatcaaaagaactcaattagaaggagatagaagaaaagagggaatgagcataaatagaagcttactagcgctttctcaagtaatttctcagcttagtgagagtacaatagttgaaccacatgcaaatatttgcccaaatcagacaaactttgctgacggctcttttcactcaaaaaataagtatattaactacagggactcaaaaataactagaattttatcagactcactgggtggtaactcaagaactattatcatatgtaactgctctcctgataaggtaaactactatgagacattatctacaattgactttgcaaggagggcaaaaaaaattcaaaataaagttagggtaaatattttgaaatcaaaagaagaaaaatatgaaatagcagaactaaaagaaaaaatagcgaatttgaatagaaaagttgaagatattgatcttcttaggcaggaaattgagttgctaaaaagccaaaaggctgaattaaaatccgagttgaatagaaataaaataaaatcgactgattatccttcaaaattgtcagattttgattttgagtggaataatagcttgagcgtaataaataaagagcaattctcccatttgcttgctgaatacgcagaaataattgatttaaaagatcaaaatatcaaaaatttaaatgaagaaattaacactatgcaagcaaaggttcgcaatacagaaaaaataacaaatgataattatgaaatgaaggttgatcttgataagaagaatgataaaataattaaacaagaaagtgagattgaacatttgtcaaaattgttatcagaatcgaatgaaaagttaaatatttttcaaacccagttagataacaaggattcggtcattgaaagactaatttgtaaaaatgagaaaacttcgttatactgcgttgaattgaaaaaaaagttagaggattcgttattagacatatatagttttataagttggtatatttatgattataataatgaaataacacaaaaaacggaatataacaaaccagatttaaatgagaatttggataacttcttttcaaatttgaaaagctacttgaattttatatcaatatataaccaaatatcaaaacaaggctcaattaactatacattggaacttctaaactttaaaaatgaaattttagagttagaatctgaaataaagtattacgaagaggagaagaataaaattgattcagaaataattatttgccagaaccagacgattcaaaatttaaactcgattattctaaatatgtttgagctcctatgcaatttaattactgagagaaacgattgttatcaaataaataactctcttcaaaatttgtcaatttccgattcgtatgaattcatgagaaaaattaaagattcagaaaaacttatagagttacttaacttagaactaaatgataaaaaggatcttgaagtaaaatctaagattcttcagatagagattgaaaatattaacaatgaaaataaaattttgaatgactctctcgaatcccaaaaaaaagaaaataatgagttaagattaacattgaatcaattgagacacgaattaaattttaactttatttcatccagcaataatttaaatgaccaggaaacatttaataattcagactttattacaaataaagataaaatattgaaatctaatcagccaaatgatgccaaacaaagtattaaaactgaaaacaaggaatgcaaagaaaagaaattacaaagaatttatgatttaaaagaaaacagatcaaaagaaaatatcattaaattagagtcaagtatttcaacaaataaagaatattcagagggatctgcatttaatttcaaggaaaatcatataacggaatgtagtacacaataa

SEQ ID NO: 2443 - DNA, 1815 bp, Cryptosporidium hominis
atgcctaatgtttctataacgataaaggagactgcaatacattctattgaatattttgaagagttgttgaataatttaaagaatgaaaatgtagattttatccctattaaagacacaaaaatatttctatctagtaaaattgatatagacgtcgattcatttttatctaagtctaaacattttttgattagtcccaatttcattagctttattgagttttggagattatatgaagagatgttaaaacattctggagtatataattttttgcataattttgatgggattttaaatggaatggtatacttaagagatagaataattgatgaatcagttgctcacaaaagggtgagcgatttgactaagataagtatttctaatacttcaagtgaacctattaaaggcattggtataacaattgctcagatacatttaataatacttgaaataatttctaaaaatatttgcaacgatagctcatctatttattggcaagatgtattaaatcaaataccacaagatgggaactcaaatatgtttttagaatttattgatattagtaattctatactacagtggctgaaagaatatttaaataactttagtcaaacatcaatatgtagtaccaacacaattgttacaaggttattaagtattaaagaggaaacaaatcacagttatggaaacaatgatatgaataatgactcagaaaaagtgatatcaaattataaaagcaaaaaaatggaagaaaaagctgaattcgaaattcattgcgatttattaaatgaaaatgaaatgagcgagctatacattgattcatttgaaagcttgccttggaaaggccaaacgatgttctcaaattttagagagttgcagatttctcttcaatctatactagaacgagtaattttacactcagacgagggaaggaataatctttttttaaaaagagatgaaataataatcagaaaaatttctcatatgattacggaattagaagactatctatatagccaatttgatattcttaataaggaaaggaataaatccgaaaaaatggaaatagaaaacaaaaatttaaaaaaacaacttaagacagcgattgaagaatcagaagaatacaaatttgaaattcaaaactctataaatcagaaaaatatatatgagaaagaacttgagcatttaatatcacagaaaaacaggttatccaatgatttaattagttttaaagaagaaaacaaatcccttgaaagaaaatatgaaggcttattatacaattataacgaattgaaagaaaagcatgatatattgtgtgaggaaaaccaacaactaattaatgaaataaataagtataaagaagagaataagattggaagtatagagagaaaaaaaaatgaaaataactcatacttagaattagatcagaatatcattatgagtttaggccataaggctaacgacttaatttatcactcgatggaaattaaaaatatcgattgcgaaaataatataaaagagaattctaattacacaaagaagggaaatttatacaaatatcctgcaatcataaaaacaatccctgactttctagaaagttcaattcaaatgcccataagttgccgatcgtatagagaaaaggttggatatttcccagaaaaaacaacggataaagaattaaggatagtgaatgttgtttcaccagtagctgaaaacaaatttgaaaactttctgattcaaaagcagaaaaaagatactcataaacaaaaaaaaaacttatccaaaactaaaaatgaaatgggatgtatgcttcaataa

SEQ ID NO: 2444 - DNA, 321 bp, Cryptosporidium hominis
atgataacaaatgacaaagtaaccaatgatgactcgaaaacttacttatcaaatgacgaaaaattcaaacctcctaatctcaatgataatacaaataagataaattctaaaactaaacataataggaaattaatttctcctgatgctaatggcaaatcagttaataaaagtataaaaaaaaacaaactagaagttcttaaattacgtgctgcagagtctaatcaaagaaaaataatcgaatttaaaggaataaaaattcaaagagcgatcaattctgcaaataaaataaaaaacttaagaaattcaataaatgaaaaataa

SEQ ID NO: 2445 - DNA, 915 bp, Cryptosporidium hominis
atgtatgtggtgaacagaaagggtgaagaggagcctgtgtcatttgaccagattcttagcagaatcactaaattatcatatggacttcatccacttgttgacccagcgagggttactcaagcagtgataaatggtctatatagtggaatcaaaacatctgaattggacgaacttgcttcgcaaacttgtgcatatatggcagctacccacaatgatttctctaaactcgctgctcggatatcgacttctaatctacacaaaaatacttcttctgatattggtgatgttgcatcgcaactatataattttaaagacaatcaaggctgccctgctcctttaatttcaaaacatgtttatgattttatcatggaaaatagagaaagaattaattcaaaaattgatttttcaaaagattttgaatatgattattttgccttcaaaactctagaaagatcctatcttcttaaaattgacaacaaagttgtggaaagaccacaacatcttctgatgcgggtttcttgtggtattcattgtggtgatattgaagctgcacttgaaacatatgagttgttatcgcaaaaatattttactcatgcaacacccacactctttaattcaggcacgccgcgacctcaaatgtcatcttgttttttactcaggattccagaagattcaataaacggtatctttgacacactaactaaatgcgcaaacattagtaagactgcaggtggccttggggtggcagtaagtaatattagaggaactggttcatatattcgaggaacaaatgggagatctaatggattaattccgatgctgcgcgtttataatgacactgctaggtatattgatcaaggtggagggaagcgtaaaggtgcccattgcaatttatttggaaccatggcacgttga

SEQ ID NO: 2446 - DNA, 2430 bp, Cryptosporidium hominis
atgaaatctagaattattcccttaaagattatcaaactcggcaaaaaccgagttttttgtaggacttttctaattactattctaatttttctgatttttttctttaagcgaagattggtgatcgatttattgttgattgtcgaacttatattaattgacattttattttcaaaattcctaaagaaaaaaaaggcgatttatagttctataagttctacaaatttaaacttggagaaaagaaatactattgagcttaaaaaattatctactgatagctgtaataactccctcaagcaacaaaaaactattagaagcctgagcgatgacagaaaattccgaaaaatcgggagaaaaaaaaataagggatatggctggactctcacaattatagcctcattaatattgatatttacgtcgttttatgaaagcctgattactaacattatttataaagaatattctaatgaaaaggaaataacaagcctaatagatcaatattcggaagaaaggaagtattatagcaatgtttttaaatataaccctccaattaatttacctactctagaattttccaattggttactcactaattgggtttttagaactatttcaaatttaccaattttattttccgactattcaaatattaaaaaaaaaggaattgaatatatcgaaactgaatttgatacgttcattaatttgaaaaaaggctcaatatcgaatataactaataatgaacttgcaaatagtaagtttgatgggcaagaaacaaatattgattttgtttctgattcaagtgaattcaacgaaaacgataaaataagcattgtaattccagctcataacgaagatgaatttattagcaaaacaataatctttactattgaatcaactccaactgaattactaagagagatcataattgttgatgattttagtgaaaaaccagtgtttgaaatacttgaagaagaacttccagaaaattataaaaaatatgtaaaaataattaggttaaagaaatgtgaaggtttaataagatcaaaaattattggtgcggatgctgctttaggccctaacatattttttttagatgggcattgtaaaccaaaaaagggttggtcagaagcgctagttaaatcaattagagaaaattacaagagagttgtatgcccaattgtccaaagcatttcaaatattgattggagtgatataggaactgctggtgcgaaaatgatgatagaatggaactttgcattccattggtatgatgatggattaccagaaattccaatagcatctggaggaatattaatgattacaaaaagatggtgggaagaaagtggtaaatatgatccaggaatgctttattggggtggggaaaatattgagcaaagttttagaatatggctttgtggcggagaaatacacgtggtaagaaattctttagttgggcatatttttgaaagaaataattcaaataaaagaaatcaagatttccaatataaaaaaatgttaattgataatatgaatagcaatcatcaaagaacggcatttgtgtggttaagcgaacagttttatgaaacttatttcaaaaattatcatgtattaggttatttacctattagttatactaagggcctaagcgaaaggctttcattaaaacatatattaaagtgcaaaccttttgaatggtatataggaaaatttaggccggcctttgaaaggcaaggcgaactatattataatttccaccacattcagcatgtaaaaagcaaattatgtctctctatagcaaataaacagaatgatcgtattggagttggaaaagctgagattgaaattccaatgacagtggtgccaaacgatgtatcgagatatagcattaaaacgacaacagattatgatattctagctttaaaaacatgtaactatcttgatgaatcccaaaaatggagttttatccttggaaatcggatgttatataacttcaaatcaaagaagtgcttagataaagcaagttcagttaatttattcaaaaaaatgaagacaaaggattttatatattctccaaataacagctcagaatctaatactgaactagaattgcctttgctgtatgagtgcgactggaatcttgtaatgagagcaagaaattacaatcaattttggacatggaaagatattggcaataaaagtggcaaaatcgtcaattggagcggcgatgaacatagatcaaatgtaacagggggcgcagaagaattcatagtcccaataaacaaaggagtagatagcgaaagttactgtttgtattcaaatattgctttaggtagttatgaagaaacgaaaatgttttacagtaattgcaaaacagaaaacaactctgaagaaatttcatttaagaaaatttggaggcaaaatctttttgtttga

SEQ ID NO: 2447 - DNA, 1173 bp, Cryptosporidium hominis
atgattaactatattcttttagaagaaaattcaagaaatttgcttttatattatcagaagttccttttattgaataagaaagtaatgaacttttggggatttgaaactaataaattgattaatgatcattataatggtttgtatctaagaagaaacagaaagtatttatgttataaatataagtttatgttagttccttcaatattaattttggtgatcaagaatgagattactttcgatatgaacaatatattgtataactgcataaactctgaaaccgaaattttcgcatgtttcaacaaagatctaacattggatggccgctacagctctcctatttttttcccaatttataattcattattagatacaaaatgtgataattttgctaatttaagtgatatctcatattattatttggcgaatttaaatcaaatattagatcacttaattgacttattgataaatgagtttaaaacaattaggcaactaccagcagttgaaaagtttgagtatctaataaatgatcaaattaaaaacaataataagaaaggtattaataccaatttaatcgatattggcattatcaactggaatgacatttctgaatctgggcactttaatatatcattaaatattatatcaaagattttgaataatattcttgacatatttaattttgttgatgaaatagctcttccagtggatggcaaactattctcaaatttgttcggtttagttattatattctataaatacgaaatagtcggctcagaacataacaaatcacaacttaaaagtgagtttgcgcaatgcattcctttaagcattataaagcaattagaaaggcaattagggagttttctacaaactaatatccccttctcagttattcataagataggtgaaataaaagtatccttggagtacaattttattaatattttcaacaaatgttttactttttctttagataaaaaagttacttatacaagaaactattttcttgaagttgtcaagttacttatacaatttttgggaatttcatcaaatggggtaaattttgtcaatttatattcagaaaatagcgaaggaattgaaggttttttatttgaagagataatgccagaaataaaaaaaagaaagagatatgacacttcattattcgattga

SEQ ID NO: 2448 - DNA, 753 bp, Cryptosporidium hominis
atgttaaaagaacttaagttgcagaaattatactccatgattatagatgaagataactttgaatattcagatcacagtaattacaccgagacaattaaggagataaagtattcacttatcaaaatctatagagaactaaaagttaaaggcacatctcctaaattggaacttcaagagaaatataataagatttttgaaaatatattattaaggatagaatgttgtaagaaatacgaaaaaaagtatcttgaaattgaaagatatataacaaataccaactttgaagaaaattacataaaatcaataggaaacatttctaaatcaattcaagatgattcaaacaatattttttcatactttaaacaaattatttctttatttgggataaataacttatatataagttttgagcctttccagcttctagaggaatacataaatgatttaagtgccaaattaaatgtatcaaattacaaaaacgaatttaaggtgaattctgatagaagaacaagaagcaaaaacgttaataatgatttaccaaatattaatttgaataaagaagttattgaacatgatttattattgggattagagaatccattaaaaaagataattattgatatttcaagtaataccgtaacatttcctaaatataatgataagcaatataagaatttggatccaaacaatcccgtattattgctacaatcttattttaagtattctaaaaaaagaagagatgaaatgcgataa

SEQ ID NO: 2449 - DNA, 621 bp, Cryptosporidium hominis
atgaaacataaaaaatatctgctattgttgtttgttcctacattcttagtacattgttcaaatataattcccaaattggaaaatgatacttttatagacgctttagacaaggatttgtccgagaatgaaaaagaaaaaaaaatgacagtttgttttgaactaacacaaaaggaattcatagagaaacgtgatgtttatcagaagatagctgtttcaataaaagataaagagtcaataacttctaatgatgcgcttagagcgcttttccatcagaacctcattacttgctacttcaactcgaatataaaagatataaattctgtcattaatagaaatataccgaaagaagagatcgcgaagatgtttgcagttagtgaaaacaccccactaagattttcgtccaatcaattaaagattcttgaacgagttatctcaatgagtacaaaaaatacaggcaaacaaatttctggaggaattgcaaaacaattaagtgggttctatgggcatttatatttcatttttgcgctgcttctaattggaatttcattttattttgctctagatcgtctgaataaaagcattaaaggcgctaaagggaagataaataaaaagaacaaataa

SEQ ID NO: 2450 - DNA, 3033 bp, Cryptosporidium hominis
atgaattttagggactacttgatattattaccacgcgtaatttttatatttgtgatcccatgcctatctctaattattgttgcaaactctctaccatggattcctgattatgaatttagcgatccgataacagtatcagaaaggattcatcaaaatgaaattcagaatttagtaaaaagaaaattaatgaataaatatgagattaaattcaatgaagagcatgaaaaattgcgtaaattaattaatgatacaaaagaaaaggtttatattaatcaagtaaatcaaatgtatgatctattagcagatcaaatcagaaatattggctttagctgcccaactacatctgctgtaaagaatcaatattgtaacgaaaaaagattgaaagggtttgaaaatgtgaaagaaagaagttattgtgaaaatgctttcgatccttctccaattgcatattcatataattcaaacgaatattcttattccgattccggggatataatattgaactatgaaaatgaagatttggttctcgaagattcaaattgtgtctcagttattattgatggcgatgtcttaatatgtggagatcttattgttgcaaatggtcagctaaatactctgacttcgtttgatgcacttgaagctcaaaatttgtcagttggtaaaactcaatcaatacactcaaaaagaaggtgtattattaggaaaggtttaactgtaagaggctcaatgatacttccattttctaacttaatagtcattggcaaattgattgttggaaaaaatgtctacaccgcagatttacaggtggatctgtcatctaatctatttattggagttctatatttattttctgatgtatatcagaataatagtggatcagatagctggaaccctttttctatcactagaattaaactttttcatgcctctaacagttgtttaaataaatttgataataatattgttcaaaatcaatttcaagatagttccaaatccaatgaaagtgaaacaaaagaccagaacttgggctctctatggtctgggagaaaaatatatgtcggaaatagtggtaaattatgggtaagaggcgatattagtgccggcgaagtcgttatttctgatgcaggccttgtttttggtacttgtggtaatttgaaaactaacactacgcatgggctaggtatacatattagggattccggaaaccttcatatgatgacttcatctatctttacaagcaggctatctttaattagatcatcagttgttatcgtgaaaaagggagaattaaaaattaatagcattttattgttacattccggttctaaaattcgaataggtgggaatgtaatgcttcacattgcatcaataagagatgcgtctacattttacgctgactctcttaaaatactgaaccaaagtattgaaaatatagaatattatcataataactataatatttcaagtatttttggtattaacagtacacaatatacagaaataaatgataaaatggcaggctttttccaagtcgtttcagcatcagctgctacaatttatggagaagtatttgcgcaaggctcaattgaaataaatgatggatctgaatttttgtccatgggcaaagttagtatttttgaaaatgctgtcattagtgacggatcagaaatcctaattttaggtcattcaaatgactcagatagcaataataattcaaataataattgtgagagatatcaacactgtattcttggctcaatacttgtatcaaattcaagtaatatgttcattgctaatggtagtttgaaggtaaatgagcatgtagatttaattgaagggagttttctattaggagaaagtatggaagttgggaaatcatttatttcaacaagaaaatctagcttttttataaataaaggtaacttaataattaatagtgtaaatccaagctttgaaataaaatctgatgataaaagtttcttcatttctaatggcatatttataattaacgggaaattaattgtgaaaaatggaaatgttgttttaattatgaaaagctatcttgaagtagaacaaatttatattaatcaggggagcttaggtatgtcgacgaagtctttaacagtggtaaatggagaaaaaggaaatgaattaacggatttatttctgtttagaaataaaattccaatcaatcttctaattaatggcaatcttacaattgacacattttctgaaatgcttattttcgaaggaagcatttcaatcgaaagcgtaatattaacatccagttcaataataaatattaaaagggaaaataatgggattcagcagtatcaagtaaacattaataaagtagttgtactacaaggaaattcactcatgaatgtttctgaaagatatttattagaagtaaatagtggaattatggtagatgaattttcaatactgaattgtgataaaacaattattaagggagatgtgtttactgacgatggtggtgtttttattgctaaaagcgctgcaatttcctatcctacaactttagtgtcgcaagattcatcaaaaatatatattgaaaatcttcaagttaattatttgatttcaagaaaaaatacaacaaacacgctttcagaaaaatccaatattccactttttatttccgaaaatggaggttctataaaaatcgataaatgcgaatacatctgcgatgaatcattttgtattaaatcactttttggaatacgaactacagaatcaatgattacaatagagaatagctttccttggttcattccagtgaaaacttctgtacagttttttgacttaaactcaacaaggtcaaaagaattataccaagtaattgatcccattgcacttattgcaagaaaaaatcccgaaggaaacaaacaaatagaagaaaaatccaaaatcaccttttcaaaaggagaacaagttagaagaggaagaacctgggaaattgataatagtaaaatcaactcagctaatgaatcccaacccatacaatggcaatag

SEQ ID NO: 2451 - DNA, 1875 bp, Cryptosporidium hominis
atgaatgattatgatttatgccttccaatttgcgagattcacaaaatttgctttaatgatcgcacttcaaacaatttcccatcaaatgcccatctaggcaattctacgttagtttggagtcagggactacaaaattcttttaacaatacacttgatattagtgatttaaaatacaagttaatttccaatatagaaaaactatcaaactttgaagaaatcataaattttcttctttgtagagttattggtgagtgtaaatcaaacactgtcgttgctatggcttataatagatatttgagattccttgaaagcattatttcaaagattgtttgcaaaaagaaacattgtgagctgttgaatattttatactcaacttctaaatttgaggacttggtaaatttaatgaaaaatgtttacatatatctagatgggaaagcactaataaatcaagagtttgagactcgtataaaatgcaaatatgatatagaaaagataatattcttaatcacacctcttcatctattaattaattactttaaaaatattggcaattactgtattcgaattttttcagataaagataaaacttttttattatctcctatatcagtttctgttataagttctttatccagacaagagttgactaagtcatcatcaatctccgacaattgtaattcatatctatacatatctcttgaaataataagaaattatctaaaattaaagtatttggtattgagaattatttttaataccaataaaacaagattggagaaacatttattcgatttattcaatttttacatctcagatggaataaataataaaattatagtgtgcgctttaattatggagcttatagaagtactatctaagaagcttacttttatgaataaattagaggatactattaaccattatacatcgctaaatgaaatttttagcccagcatccaattatataaataattttaacttgatctattatgatatattaacacagaatttcacaacggatgaacttaaatcattaatacagaacataatccaattctttgtcaatctttcaccaacatcaaatgatgaagttttaaatttcattggaaaatcaattaaagcagatcataccggtgatgttgagtcctttgtattaacttccgtggataaagaaactaataaatattttaaagcttctaatttagaaataatgaaggtaaaaaatactattttaattttgaatatctattcaattattacaagaaatattttcaagtatttttcctggaaaaatttaattagaaatgtaaatttaacatatagttgtggagttgaaaatatattacagtttttttcagaagattattcgtttttgaatctaggcaaatatatggtaacaggaaagttgaatattattactcataattgtgggaggatcaatgaatatcattttattccgtctgttgatcaagtgtatagggtttatttatactataattcaatatacaaatttttttcttcagatgtttttatcgattctggagccaatgatctttctctatatattttttcaaataaaattttctgggagctatttcttaatgacttttgttctaaaagagtttctcaagaatgtaattttcagttggttgacttagtttacgattaccttgaacaacaaattatcaatggatgttttgaacacaactacacgcgttacatttcctatatcatttgcttgcttccctataaaagtcatacttcagattcatcactttcaatattaaaacaattgatcagtgatattaagttagttgatgaaatcattgaattaattaaaccaaaagaagatcaaaataaaaaaaacatactctga

SEQ ID NO: 2452 - DNA, 1047 bp, Cryptosporidium hominis
atgggccaagctaataataaaaatcaacaaaaaaaagcaactcaactccatcatagaaatgtgcatgccaatgatgattttttatttttatctgaaagataccctgagcttaaaaaatgtatcaaaataataaataataaagtacgtattaattataaccccgcagcattatactgtatttcgaaagtattgctgcattacagatataatattaattgggacataccggataaatttttaataccaacaataccttcgagagctaactatgtacactttatttcagacctgttaactccagaacacttttataatacggaaaaagtaaacgatgaaggattaagaaacgatctaaagacaaaaacatgtattgaaggtggtacagatgtttgtttttctgagctcattcctagaggaaaacaagttttggggtttgatataggaattggtgcaaattgcatattttctcttttatgcaacaaaatttattcttggaatatgatcggctcagatatttcaattgaaagcctgaatgtttcagacactataattaaaaaaaacaatctttgtagttgtataaaacttttgcatcaagaaaggccagaatatatattattcgggatacttgacaaaactgaaatagaagacttgaaattgtcattcactatctgtaaccctccatattatgactcagttgaagattcagaaattaatatgcaccctgctcgcttcaggagttgtcaaaattacgaaataataactcatggaggtgaatctcaatttatcttgaaattgtatttcgaaagcaagaattttccgaaaagggtaatctggtacacttctcaagtttcgaaactaaaaaatttgagatttttgaaaagtgttcttggaaaagaaatcattaacaatgaattaaaatcacttagatacactactctaaaacaaggcaaacatgacaagtgggtaattgcatggagcttttttgaaaaggaagagagaacctcaatattaaagtttctcagaaacaataaaaacatgagctcttga

SEQ ID NO: 2453 - DNA, 702 bp, Cryptosporidium hominis
atggatgataaaaaacagacagaagatctcactgcgaagaatcagctatttttgctcaaggaatttttgaaaaaacccataatttgggggcctgcaatatatatttttacctatactgcaggaccggactatgacgatgcaatgtttttttactttacaaataggcttggcttttcaccaacatttatgggcagcttaaggcttacttatggaattgcaggtataattggaattgttctatatagaattattctcaagaagaccccattccgtgaaatattgctttggactactttgttttcaataccaatttatattctacctctagtgctggtcacaggactcaatttgaatataggaatttcgaatagaatgtttgcattgtctggtggatttcttattgaagccattgcagaaatacagttgttaccacttcttgtaatgactgcaaagttttgcccaaaaggccttgaagggtccgtatatgcggttatgatgtcaatacgaagtcttggaataggggtttcaaaagttatctccgcaggattggcctactcacttggaattacagcattcaatttttcaaatttggggttattaatttggatttcatctgcattcctcctactgcctcttttttttctaaatttggttagttatcatgctttttccatatttcaagtttatttttttaggttgtga

SEQ ID NO: 2454 - DNA, 2169 bp, Cryptosporidium hominis
atgaaggacataagttataaagaattagaaaatgaatacaaaaaaaaatcaatatttgaatctgctggaaggatatctcctgttttgttgtttctatccgtggttttaattatgggactttgtatttttgtgaggctttttgccgtagtaagatatgaagcgataatacacgagtttgatccacattttaactatagaacctcgaaatttctttcaaaacatgggttttatgcattttggaactggtttgatagcaggagttggtaccctcttggtaggattattgggcaaactctatttcctggtctcatgcttactgctgctttgatgaggtatattgcacatcaattgggtttacttgtaagtattttacacatttgtgtttttacaggaccaataatctcaagtctaactgcacttgcttcatacttactcacttttcaaataactaagcgaaatgaaacgggaataatggcagctctctttacgggtatatctcctacttatctgagtaggagcgttgcaggaagttatgataatgaagcagttgcaatttttgctcttgtattcagttttgcactatatttgagggcagtaaatgatggtagaatattgagttcattttttgcagctcttgcttacaattatatgactatgagctggggaggatatgtgtttgtaattaatacaattgcaatctatacactagctcttgtattactcaacagatttacatacaaacactttgtagtttatattgtattttatgttattggtacaatattgaaccttaacattccatttgtcaatgtgggcgccataaaatcttcggaacacctttcatcacactgtatggcatttctcgtagtgtgcgttatagtattgaactcctcaaaatatattctgagcacttcttcaagccgaatacttctaaaagctatatggatttcttgcttcttggtatctagctccgccttcttggtattgacattatctggaaaaactaggtgggcggcaagaagtatgactcttttagatcccacatatgcatctaagcatgttcctattatcgcatcggtatcagaacaccaagcaacaacttggtcacagtatatttttgacctccatattactgcgatatttttccctcttggaatatttgtatgcgcatattcaatttatatttctcaaaaaaaatcgccaaaaaattcaccatttcaaacatcacatagtacgtgcattcccgatactgcaatatttttaattgtatatggagtccttgctgtctatttttcttctgttatgattagactgatgttggtttttgggcctgcggcttgttgcctttctgcagtgggattttcttttatattatcgagtttaataggcagaaggcaaacaaaaaaaaccacttatgattatgggaaccaagggaattttggtattctcagagttttttttgtattattgatgtttttgctctgtgcgagttatgttgtgcatagcgtttggagctctgctgtggcgtattcacatccatcagtaattacttcaaaccgtcttagagatggaactagactaattcaggatgattttagggaagcatattattggttgagaaagaacaccccttacaatgcaaggataatgtcttggtgggactatggatatcaatgcactgaattaggcgacagaaccgtaattgtagataacaatacatggaataacacacatatcgctacagttgggcttgcattggcatctcctgaggatgaggcttataaaataatagaaaaactggatgtggattatgtttttgttgtatttggtgggtttgcaaaatattcttctgatgatatcaataaattcttatggatggtaagaattgcttctggaatttatcctcacattcagcaaaacgattatctatcggatagtgggcattacactgtggggaaagacgcatctaatgcgatgcttaattctctgatttacaagctatcgtattataggttttcggatctccagaaggatggttttgacttagtaaggaattaccacataggtaagactcaattctcacttactcattttgaggaagcttatacaactgataattgggttataagaatttacaaagtaaaaaagcaaagtaaccgttcaatatag

SEQ ID NO: 2455 - DNA, 882 bp, Cryptosporidium hominis
atggcgcaaattgaatatttatttattatgggaattgtttcatcaagttcaaatttaagttcaatcgataaaccaaatgagcaaaataatttccattgtgctaatggtcatatgaatggccacaatctagaaaatatccagtgtgtaattagatggtcatttggtggggatgaggtatttgttactggtagttttaacttttggagaaagcaggatgaatacaagttatttaaaagtggccacgatcatttgattgcaatagagcttactagaaatattcactttttcaaatttattgtggatggagagtggagatactctccagaatacccaattgaatcagacagtgaaggatatataaataattgtatagatttaacaaaatacaaagctccatattattcaataccttgcgataaatcacgctacggcgtacaggagttccatcaagagctaccaacagagtttcctgtagatgcgccagcattgccaattcttttaggtaagagcagatgcccacttgaaactgccaatggtatccatattccgtttcattgtatttcgaaccatatttactatgactctcttgttcaagaaatctttggaactcatatagtgacattttgtgtgactaagcgttggtttaaagaaaagtacatgcaaattgatcattttatgcaaaagtttacgacaatactatatgtgtcctttagattaattgatgaattttatcctatattaatttgcaagaaaaatgactacaatttaaattgtttttctaaaagtgtttctgactcagaaaataacaatcctcactatgacgcttatgtttcagatagattgctcacaacggccgaaatgtttgccacaatatttagataa

SEQ ID NO: 2456 - DNA, 7986 bp, Cryptosporidium hominis
atggtagaaaagaatctcccttgtggagaagatattcccaagcggcaactttttgaaataataaaggaaattggcccaagcagcacgtcaaatcaagaaaactttgatgagattcttctaggatggattaacgactcaagcaactttaaacgcgagattgccacttcattcatttatatgctcaatgatacatcaaaatacaataaggatccaaaatataaagaaaaaggcagcgatgatttctctgaagttctaagagctagatggaacgagctgagtaataacaaaaatgaccaaaatttattgattcaaagctctagagaagatattaggctggggtggaactcttccgtttttgtggaaggagtgaacaagataatgaaaattcaagagtccaagaataagcaatttaatactaattggaatgacattattgacgaaatcattgataaaagcgacttactagatctaactgataatgatggaagcttcgaattattttgttcacttttaggtgaatcatatcgaagggatgaaaataaagtttataaaccaaaatataacgaactgtattataaattagacccttttttaaaagaatggaagaatcccgatattcaagctctttttcttttgaaaatctgtaaaacaagctatgaaataaataacaggagttataacttacatcaaaaggactattcaagtgatatattagaggatacattaatagaaaatgcagtaaattttgattcagtctacactaatatgagtaattactcaattatattagatgctagcttaaggattcataattcgattgtttcaatgttcgaatcagatgaatccattttggaactcattaaagatggtttactcggaaccccttgtgacgatatatttaaatctaaattaccaaagattggaatctttcacactaaaggttcatgtggattattaatttgtcatgatttgctaagggccatcattaatatatataatcgaattaataatcagagattattagagctccttcaacatcttattttttatgagattccaagatattctcctattggcctactctcatctcttggagcaatttatgatgaccttccacaaaccgtttctgtatctagtgacctagctaacaagataagtgagtcgttcgatatattagtgccaaataataaggtcacaaaggtttcgttgattaaaatggcaatttacagtgctcaagagtttattatatttcctatttctaaaatagttgcaacttctcatgaaaaagaatatgatattggtcctcgttttggagtgattatgcaaatcattttcgcctcttcagagaaacacaggaatggtaatagccaatcccagtttatgagagattttatcagccaaattgcattctgttacagaatttcatctgtttttctaatttcaaagttgaactccctctcgaggagctacctttggaagttcttggactctgaatggaagaccttacctcaattttataaaatgaatgtttctgattgtttgtctcaaattttgtctagagataagcttgatttattgaaagattcagaatattctcatgaatcgatcgactattatcattggtggtttctttgtatcgatattgttttttctggaattagtatatctcaaaattccgaattggggttatcttctagtatatgtgacgaaattagctctcacgctgttaatgtcctttttactctatttaaagaagaactagagggtaaaaatattgaaactccactatttattattgctattatggactatatccgggccaggcttgtatacatgacttacgcttcagctgaacttcaaactattctagtaaatagaagaacatcattacctttcttttcggttgataaagctgcaagttttaaagtttttgctgcaagagttgttcgtaggaatttatctttaggttcatctcagctatatcagcctaaagaatgctggatttcttcgcttgaaactccctcattcaagttttcctgttggcgtattagctcatcttctatcctcgcgattcaagaagcaattttgaagtttggagtaagcactaaaggatatgaaagcacccctatctctgagcttcatgatgctttacttgaatttgagaagattaaagataaaaataattcgcaagataaaaataactccttgggctctattaataaagatgttagctccgaaattatgttgaattcttccgtaaatgaaaaagatgaaaaaacccttaataatatttcacaaactttattcaccaataacgattcagaacacaaaaactccacaaaaattaatagtaaatctgaactgatagaggctgaaaatgaaggaaatggatttgaaatcaatcaagtcaacgattttctaacaaaatgttatttaggtgaagttaatacatctgaattaacagttgagttgaaaaaaatgcactctctttcaaaccacccaggtaaaaatgttaaaatcttcaatactttccttcaaacgttatttgatgaatgtagatcctatcctaaatatcctaatccagagcttaaaattactgcagaaattcttgggattttagttaaggaggatctacttatttcatttggaaatgcactagtgtttgtattgcgatgcattattgaagcacttagaaaagggcattggaccaaaatgttttgttttggagtatttgctatggaaatgtttatagacagatttatttctttcccccaatttctctctgcaataattaatatgtctcaacatttaaaacatgcaatagaaccgtatgttacttattgcgagtcttgtattgccatccttccagaaaatctaaagaataagttatacattgaaaggagtgtaatggagtctcttaacttagatatcccaccaaaaccagaaagtcttatttcaaaggtgcacccagagatgatcaactttgaattcagacaaaaggagactagcgaaagtccttgtaaaccaaatatgtcgattgacaagcttggaagttttatcaccttaaatctttcagaaaggaaggtgcttccaactggaattacaattgatcaacttcaaggctttggtttgggtagtttagaaaaattaatgaatgatcctgaaatattaaacgcgctagtaactccctccgaaaatgtaattgaacacattttcacgatatgtaatactcttgcgagcacgaacatcgaaactaaagctatcgaaatggctgatattctaaataaaaacccggaatattgtcattggtttgcgttttatctcgtgaagaatagggcatctaaggaaaagaataaccattctacatatatcaacttcttaattaaattggataaactgatgccaaaaaattcagatttattgctcgaggaaaaaactgaatcggatattccactaactcataaaggaaatgaagaaagtaaaataaacataattgaaattactactcttgccagttatgactgtattaaggctttgctgcgatatgcaagtatattgaatgatgtctcctcattcttaaatgtactacgtcatttaggctactggctagggcaaattacaataggaattaaccgtccgattatccacaaatacctaaaccccagacaattgcttatagatagctattctagaggttgcatagcctctgtcctaccttttatttgtaaaatattggagaatattaaaggaagctactattatccgccaaacccttggacaaacaatattttatatgcactagccgaaattcattcgcttgcgaataattcaaactctcatatgttcgaggtagaacttttatttaagcaactggagcttaatctagatgattatgttggtaagtcaaactacctaggtttgagcagccatacagactatattgagcataaggctctgggagaaaaacaaagaggtcataatatttatccaaagacccagacagagcataattctcacataactttaggaagctcatttgagcgtccaaatactattaatgtaattaacagctctttaaaccaatctgctagcttatatcaactaagtgccaatattggagatgcacaacttgcctcgaccttcatgccgcctaatcattcatcccaaatgatgcatcaacaaactccacagcagataccatcatccgacatacaattttgggccaacaaagtactaatttctccctctattgtattatttcagatacaaccatcgctcaggcctttggtaccactagctttagacagatcaataagagaaatactacaggttgtgattccaaggtcagttagaattgctgcaattactactaaagaaattatcggcaaagaatttgcttttgaggctgatgaaaacatctataaaagagcagcacatctgatggtcgccgctttatctggctctatggctattgcagcatgtcgtgaaccccttagagttgcatttactgctcaactaagacaagtattacacccaacaccatcaagagatggtgaggaccatgtattaattgaacaagttgtccaagtcatttgcagtgataatattgatttaggttgccagatcatcgaacaggccgtggttgaaaaagctattgaagaactagacgaagttatctctccaggaattattgcaaggaggaaatccagagaaaccgggcatcaattcgttgatacagacttttacggaggaccgaacactcagaattccgctactttttggtcatcactacctgaaaatttaaaatacagacataattctatgagacatttgcagctttataaagatttcttacaattcaccttaatgagaaatttggaaaggagggattctgttacccaatatgagctacagaacagtttacaatcaaatcaaataacacctctatatcagcatggaagtaatgaccaattcaatagccaaacccaacaatggaataattctaacgcaattcaattctcacaccaagctgaaagtatccaaaatttcaatacggttaggagtgacaatacaagctcccaaatgccttcttctaatcattcccaaatgaatacctcgtcttcaactattgtacaacctccagaacctgtaagggtacctcttgtttttgaattggcatatctgcctctaatgatgcgtgttgacgaatgtttgggtcaaataaaggatgtaatacgcgagattgccctatatcctccgattttctccaaacagctgattcctccagtaagcaataatttaagcgaaggaatgtctgttaaccagaatgtatactcaaaacctctcgggtctaatattcttacatatactccaaaatcaaccgcacatccagttctttctgtgttatcttctctccaatctgaccacattttattttatttatgcagggtattatattcgattggaaaatctgcgtcacaaagagaagatgttttgattggaatctctcaaaaattgtttaaaacactttttgatgcaggcgccgcctttcagcagagtacaacaggtatacttccctcgagtagatgtattgcctcttcgcttggtttcgatgcagctttgttacatatcgaggtatttctggcgctatgtaatcaaatttcgtattatagctcaaaattttggctgaagcttaggaaagaggcaataggatggtttatttacactatagaggatccaaaatattccgttgatattgtaattggtgcattgagatatgatcttatctcctcagatgaacttgatgtttctctatcaaacattttagaaactgcaatttctacgcttaatgactctaatccagcaatcggtggaaatagtagatgtttgagaattgtcgagtttatttacaaactgtttttcagaagtattgaagattggcactacccaattactaagaagttaccaagcactactaaaaacttgaatcgattatcaaataacagtgtagccttccaaaacagtaatttttctgcaataccaatagtgctaccagggctttattataagccatactcttatacaactaatctgggagaacttaagaataaagtagaaagtattctattggaattggaatccaacaagtcaattacgtttcatgaaatgtggataggtgaccaatgtccagagattttgaacttttactcagtaattcagtgtaatttggatacaatattgaacccgagatatattgcgttacctacccctattaaaccacctcctgatatttcgaaaggaatcaacacgattttcgatgagtggatattgctattgagaataacaatttttaatggagttggaggttccgagcgtaataatccatacagaaatctatttcttcaaaggctttctaggcaaggtctactaagaatggatgacactacagaaaaattgtttactgtttgtattgagagagcaatttatttaagcttaaatcatgatagtgactcagacgccttgaataactctatttcggaaaatgcatatgactcacgtaatatggatccgttcccaatagattcattggttagattgattacaactatggcaaggtatgtagatccacagcaaatggctgcagtagtaataacacacaaatttctttcaatacttactagagttattcataaggatgcagagtcacatggctttaatcaaagaccatattataggattttttactctttgttacaagaatatgaaagtataggattcaatactgaaatgatacactttacctgcattctaagtgtagttcatcaccttcaatatttaaatcctaacagggtccccggatttgcatattcttggatccagattatctcaagtaaccgatttttcccgtacctactacgccatgtaaaaggttggcaaccttatcaagctctattattgcaaatcttcatttttatttcgccattcttgagaagtgtacagctatcaagtaacattaaaacaatttatggtgcgctactccgtatcctactggtattactacacgactttcctgagtttctttgtgactacagttgcagtttctgcgatgtcttgcctgttaactgcatacaaattagaaacctaatcttatccgcattcccaagaaacatgaaactgcctgatccatttttacctaccttgaaaattgaaaatcttcccgagatgaagctaatccccagaatgattgcaaattatggtgcttatattttgtacaaggatctaaaggtaaacatagataaattctggattaccagagatgcatcaattcttcccctcatcacagaaactattaaaatgccaagggatgaagcacttaaatgtggtactaaatactctttcccgataataacaggtttattgctttatattgggatatatctcccaaatggaaatgaatctaattcaagcattgacggttctcataatgggatatttaatgtctttaattccgatccatcaactaactcgattgaatctgcatcgaaactggaccaaacaccaaacctaaaaagtgatcaattagaaacttttgaagatccgtccctttcaataattctatttctttgtaaggacctggatatggaagggcgttttgtcctcatatctgcaatcacaaattttcttggatatcctaattcttacacatactactttagctcacttattttatggttgttttctaaaagcaatgactctattgtacaagaacaaatcacaaggatacttctagaaaggcttattgtgcacaggccacatccatggggtcttttaataacatttattgagttgattaagaatccaaaatacgcattttggagctgttcatttgtgcatctggctccggaagttgagaagctctttcagtctgttgctcaaacctgtttaggtcaagcccctaataagacgaatttggtgaaccatacataa

SEQ ID NO: 2457 - DNA, 3294 bp, Cryptosporidium hominis
atggaattagttgaatatgagatttctaatttaaaatctattttagagaagacagatgatagctccaaaaaaggtcctcaattatctctcaaggataaagaaaagataatttggagattagcatacataagcgtaatggggtatgaaatcgactttggatggcttgaaattttagagttggttagctcgaatattttcgaatttaagcaatgtggttatatcgctgcttcattaatttacaggggaaatttagaattacttagattattaataaatacaataaaaaatgacttaaataattgctttgaagtattagtagacaaagaaaaaggttctgataaatcgcggaattttagacaattttcagtaggaataggaaaaaatcattcaggtaaaaacatcgatattagaaaacaaaaaatcaaaaattgcttactagcattgaatttcatagggaattctccaactttagactttgcggacaatctttttatcgacataaagaaactcgcagaaataccagttgaaaaacaacttaatgacacgaatattatcagatcgaaagcaatttgttgtttaacgaaattatttcaatgttgccctgatcggctcagggcaaacgagtggggtgaaagactattatcatatttccaattcgagaggaatgctgactgtctaatttctcaatgcgtttttataaagaatagtttgaagtattatttaaacactgagtatttggaaccaacggaaaatgcatacaaaaatttaaatgaacaagaaacagaacattccgtattaagagacgaaagagaaatagtcaactctaatttaaatattaaattagtaaagatttgggaatttatagttccaaatttaatatttacgttatcgagaattaggttatacaaagaaataaaaaattggagatttcataaaattccaatgttttggcttcaggttaaattaatagagattttagaattgttccctgaagttattaatgactattttgtaaattataagataaataagataatggaagacgtattttttaatgcaatccatgcaattaaatcagtaaacgaatgtaatttaagttttagttccacctttgatgaaattgagtttctatgtataattggcattgcaattgagatgacaaaatatttcaacaagatttgtaatcaagaattatctgctaatattggtcatttagtcgggaaatttattgaaggtttactatatgcggataacaaagattatatttctatttctatttcactaatttttgaatcgaaaacaaataaggcaattcaagaattaataaaaaaaaatttggttacattgttgagatttacatgctcttttgatgaagatacaactttgaatctattaaatattttttcttatatctgtaacaaaaataattgggtttttattacaaaagaaattcttaatggagttctttacaagtatatattaaacccttataaattaaatattgaagaaatacataacatacaaaaaggttcaagtgattgtttttttccagaaaagacaaagacattattggaagagataattttatcagtttgctatacaattagaagattttcaaacaaaaatgaagtttcatataagacaattaatgtattatttcaaattctcgagaagtctttctgtaacccaaatccaggatttgaaattacagaaaatactctttttcagataacagatattctatttgattctaaattgaaaattgaatgcactgatttaatggagaaagtgaatgaatcacttggaaatgatataggtactcaaaaatatgtagcaataaaatcatataaattattaaataaattaaaaaatcgaagagataatttcaacccaagatctggaataaggtggttatgttttattttaggtgaatatggaaagcttatatcaagtaaagtatcaattgttaagcaagctgaaatattgttgattattcatgatatattaactatcgattctgaagatgatcatattccactattaaaaagtactattttactttcttttacgaagctttattgtaactctgatcatgagacccaaaatcgaatctacgaaattctgaaaatcggtgttggaaacagaggtaattgtattggctcacccgaatttttaaatgcaattgttgcaaatacacaatatagcattactcctataaatgggaatataactccagtagatataccatcagaaaataattcagctttgagatatagagatcagttattggatggagtatttaatcacaaaaaaaatagctttttagtacccaaccaatcaaataaatatggtgatgatggatattgtagtagaaatacctggctttccttatgtctatcaaataaaggaagtttatataactttagcctattatcaattggattttcaaatgggaactttaaatattcctctggagagtcaacaattattgtgaaattggggaaaaatgagaagaagaataggatatttaacatagaacgtatttctactttttgcgaggagaaaaaattgtcagtaaaaagttctaataattcattttcaaatatatttgattctacatcgcaaaaccttcatgttgaagtttccagtgaaactaataaggattttgataatgaaggaaaatttgagcaaagaattaatttaatttgtaatggtccttatttgaatcctccaatgatttcactactaataagagctttctcaaatacaagagatgaagtttcggaaataaatgaacaaatggaagaaattaacacagatagtaattattcaaagcttatttgtataaattttaggcttccagtaatacttacaaactttatggctccaactaaaaaaatgggcaagaaagagtttgaaaatttttgggaaaaactcactcaatcttcagtgaaaggaatcttagggatttcttctctcgaaattccaatcttcctacaactgctaaacttttgcgtatatagtgtgatggatagtattgacgatccaagcgcttcaaatccaatgatttatggaggaacatccactttgtatctgtccaatcgcaaaagaataccttgcatgtttaaaataataccttgtaatgaacacagcgaatcttttagagaaggcaagattcatgataatggaaaaaacgaagagctagttgaaattaaggtaagatcaagttcagtaattgttgcaaaaatattaaaacaaataatatcaacgtatatattatctaactctaattaa

SEQ ID NO: 2458 - DNA, 1294 bp, Cryptosporidium hominis
atgaaggttgctgagcttgtttcaataaaaactttgagatatattctaagaccgaagttgctgacaaaacctattgttgaacctaacaacaatcctaaagagtttattcgtttattatttaatgaaaattcacttctaaagaaacgaggaattgttctttccccctcaaattcaatgaatattgatgaagaattgctttccatttcaaagttggttaattgcaaagaaattttagacttgaaagattttgatgctgaactgaaggatatatctgatccagtgaattgtattgttgaggctagagttgctgagagcagttacattactgagaatggcaaggttgaatttaatttctcaaaaatatcaaagcactatttactgccactaatattattgtattcagatttaaaagagagtgaggctgaacgctttaagcagattagtaaaataaatttaggtgaaaagctcctttgcattaataaacaaaatccaaactatggatatattggcacaattgtagatgaagctcgaagattagtactatttcgaattccaaaaaacaagaataaagtggaacaacttcaaaagaggatttttgaatatgctttggaagacttatcttcaatacaatggttttctattgaggatgttgggaaaataatatacaaacctttgttaaattgcttaagcgcaaaatgcggattagatgctactaaatcacttgagtatatgcgtttttcaaccttatttcttaataaactacttattggcccaattcaagtgaagtgcaacgataatactttgcaagaaatatcaatgaacctttttaaatttgaaaataaattaaaaaataagctttatttacctttatatagtaaattcgtagatgaaaattcatttattacatcatcgaatactaatgtggaacttgggactcctattgttagcaacgaagcaataaaatctatattagaatatttagaccttttcccttgttttgttttggctatttttaaaagtttggtattattggaccaagtagagttagatgagcacataataagttctgaaggaaaaaatatttgctcgaacatatttaatattgaaaataacaatgaaaaggttgaaaacgtatttaatttaaagaaaatacatgtcaaagatattttctcagatttgattgattcaaaagatcaagacttcaaatttaatgtaatgataaaggtaattaagggtaaattatatagaaatttaccatttttatcttcacgttctaattcagcaacaatgcttc

SEQ ID NO: 2459 - DNA, 4863 bp, Cryptosporidium hominis
atgaaacgtattttattattgtcgtttattattggtgcatttggtgcgcctcaggttaaacccaacattcctggtgtagcttcccctttgccacacacaaaaggccaggtacctacgtatgttgaaactccgctagaaagctgccctccagggtatttaatggagaatggagtttgtgtccaacgtatccaggttcctcccatgcctttctgtcaggaaccagcaatctatcacgaggggcattgtttaatagtaacagcaccactaaagcaatgtccaccaggatacgaaatatcaggaaagcaatgtactgctactaaaaccgcttctcaacaaccatcttgtcctccaggtactacattacatggaacagagtgtatctctaaacatatgatagatacagtatgtccccctggtttcgtagataatggaagagattgtgttgcattcactatgcctgaaaaatcatgtcccccaggattcgtcttttctggaaaacaatgtgttcaatcagacacagctcctcctaatccagaatgtcctccaggtactatactggaaaatggcacatgtaaattaattcaacaaattgataccgtttgtccttctggttttgttgaagaaggaaatagatgtgttcaatatctccctgcaaacaaaatctgtcctcctggattcaatttgtcaggacaacaatgtatggcaccagaatcagctgaattagaatcgacatgcccacctaattcaatatttgaaaatggaaaatgtaaagtgattaaaaatattgatatggtctgcccaccaggatatacagattcaggagatgattgtgtactatatgtagctcctgcaaaggaatgcccaccaaatttcattttacaaggcctccagtgtattcaaactagttctgctccaactcaacctgtctgccctccaggtacagtattacaagataatgcctgtatttcaatccaagcaatcgatgctatctgtccaccagaatttttagacaatggaaaagattgtgtaaaatattctccagtcacaaaggaatgcccacccgggtttacattgagtgggaacaggtgcgttcaaatggtaaatgctcccatggaattcgaatgcccaccaggtacaattttaaaagatgatcaatgtcaatcaatagaaagagttgatacaatttgtccaccaggatttgtagataatggcgaagattgtgtccaattttctgcaccagagaaaatttgcccccaaggattctctctttctggaaaacaatgtgttaaaacagaatctgctccaagattaacagaatgcccaccaggtacaaccttggaaaataacagttgtatttcatatgaactagaagatgctatttgtccacctggatatctcgacaatggatcagattgtgtccagttttctcaaccagaaaaggagtgtccaacaggttttgtattaattggaaaacaatgtacccaaactactcaagctccaccacaaccagaatgtcctccaggtacaaacttggtaaatggacaatgccaaaaagtcgaaaggataaatatggtctgtccaactggttttattgataatggtacaaattgtgcttctttctccgcaccaaacagggaatgcccagctggatatacactttctggatcccaatgcgagcaaataaaagaagcacctcctgtttcagaatgtccaccaggatatacacttcaaggaaatcaatgtactgcactaaaaatgattgatgctatctgcccagatggatttttaccaaatggagacgattgtatccaattttctcctgcttcaactgtatgtcctactggattcattctacaaaatcaacagtgtgttcaaacaactacctcaccaaaaacaccagaatgccctccaggttctgcgttggatggagactcatgcacaagacttgttcccggggctcttcaatacgtttgtcctgttggtactagagagggggacgtttgcgtagagagatcgattagttcccctgttttggaatgcccacctggttattcattggaaacaggtaaacaatgtgtcagaagaagccaatatgactgttcagtaacaacttatgttacagagtgtaaaacacctgatgttaaagcactaagaagattagcagctgcaaaagaaacatcaacagtttatgaaacgtctgagatacaaaatccagggcatcatcatgctcattctcatggacattcacattcacaagttatgccaattcaaacccagaatatacatacacaacatcataaagaggcaccaaggccaatttgtgaagatgttccaaaaattaccccaaaaacttgtacaaaagctgattctgtcccagctgtgcctatttgcgagaacaatgctgaacttgtaggaaaagaatgtgtattaacaaattactacccattagaagcaatttgtcaagatggaacaagatcaaaagagtgtgctaagtttgtaaaaactccacctactttgaaatgtcccccaggttctgtagatgtaggatctcaatgccaagttaacaaatattcaccatatgatcttgcatgccctgcaggatatgcattggttggagacaaatgcgccaccacaagagaaaaagtttgcccgaatgaaagttgccaaagagttgtaactgcgcctgtttctttaacttgtccccctggatatcatcaaatagatgaagttatgaatatctctgctcatccacaccacagacacttagctggcgttcaatctacttctcaaaagggatattctcatggacataaatatactcctgtaatttctcagccaccacaaccagttccagttgttgctcctattcagcaaatgaaatgcatccatgcagaccatgctccatataatcttatctgtcctgttggatcaagacttgtagcggataaatgtgttacatattcggataaaatatgtccaaatggtaattgcgagcgtatatataatgagcctgctgaattagtatgccctccaggattctcatcatctaaaccaattcagccaataagccattctcatattaaccattcaaatgtttctgttcccgtccaagcacaaactattaaccaaccacaagtaattcaacaaagacaagtaaattatcagccacaagtaattcatcaatcacaggaaattttaacaacttatccaactccagtttaccagacaggcacaatttatcaaggacatcatcatcatcatcatcacagaaatctagcttcccctgagtgcattaagacaatttcagtaccttatattttaaaatgcgaatctccatttattttagatggtgacaaatgtgtcgaaaaaacagaaaaaatttgtctacaaggtgactgcagaaaacaagtcgtcgttccaccaactctttcatgtccacaaggttacagaaatgccaatggaattcaaacagcaatttcaagcaagcataccgccggaacacatcattattcaacaccttcagcagagtgtgttagaactatttttgaagagtatagtttagtatgttcatcagggttcgtattattaggggatagatgtgcattgtttacaaataaaatctgtccaaatggtaactgcgagagattaataagtaaacctgccaatatggtatgcccacctggatttactagaccacaatcaaatcatcattcagatcatgcaggacatggacatgtacatggaaaccagttattacaagagtgtacaaaacaaatatatacaccttatgacctttcttgtccagataattattcaataatcggagataaatgcgcgatccatactgttaaagtttgcccagatggaaactgcgaacaactcattcgttcaccaccaacgatggagtgcccacctggatattatagacctcaggctggtgttgcaatcagatcccatggtcataaagccagtggagcaagtcaatgtatgagaaatgtttatgagccatatgcactacaatgtccagatggattcagattattgggagatatgtgccaacaatcaacagtaaaggtttgtccaaacaacaattgtgaaagaattagttatataccaccaattctctcttgtcctcaaaactttgagagaagtggacagaggtgtattgctaatgaatatgcagattatgaattggcatgcccacctggattaatagttatcagcgataagtgcgcaaaatatgcagataaagtttgtccaaatggcgattgcgagagaataagaacattcccaccagagcttgtttgcccaccaggttacacaatggaggctggagttgcccaaggaaccagaaggtctttaggaacagcttcaaatcatccacatcatagttctggacatcatcacgctctaggacatcatcatcatcatgcagttactcaggaagtaagcattgtgaggacaactgtttgttcaagagaagtttttgctccatattcattaagctgtacagctgatagtcaactattgggtgatagatgtgcaaggttcgcacctaaggtgtgcccatctggtggttgtgaaaagatagaatctacaccagtagtttccagttgtccatctgggtatgttaccgatcaagatggcacatgctatattgttgaatatgctccattctcattaacatgcaatgatccatatactttgtttgacaataaggagtgcgttttggtaacaaaaccagatagtaggtgcccagacaatacagaaaaaactagtacaggttgcgtcaagaaagttataacgaccccaattgtgtcatatgaaacaacatgtattgggccaacttgtaacgctgcataa

SEQ ID NO: 2460 - DNA, 2495 bp, Cryptosporidium hominis
atgcttccagttattgaaaaaacttttgagaaaacaattttgatgattgaattgatattattttcatttccatttaatattccaaattttccactaccaaaaaatttggaaattttttcttggtggtatcgctttattttatcaaccccatcgagagtattcaatacagggaaaacaataatccgctcaagtaaaagttcagaatattttcaaaatttgtttaaagttagatgggttattcgcggaatttatgaaaataatccatggtattcaaatttatttagttttgaatcattttgtgttttaaattataacaatttgactagaaataattactcagaaatattactttttccttctattcttattctaaagctattatctattcagaactatgaaaaatctattgaattaatattgagttcaaaatttcacgtaaatgtaatactaatagttctggacggttttattttccatgcactctttgaggaagaagtaattaataattattgtaatattgagaaaatttatggaataattaaaaacacgaaaactgaaagattaacgaaacttgatttattaaatattaacaagatttctttattttcggcaatagagatattttctatatatattcaaacaaaatttatcgataatgaaaatgagataggctggatattttatgcttttcctagactatatcaagcattcgtattgatagatctctatatttgttttggaaataaaaattcctcaaatttatttgaagatatagcgaaggctagagatatgatagaacaatacaccaataatttaaatattaaatacaagtcagtagttcaaactactttagacagactttttatattttatcagtcttccagcacaatttctttaacaagatatataatggagatagatacattaccacatcaaagttctcagataaaaactcatttaaacagaattcatgatagaaaattaataactacaacgttaactcagtcattaaattatttatctggcttttctttaattaaaccacaggacgaaagtttaattaatattaatcaaattttggaacaaagtttattttcaaattgtaataactctagctatctattttcagtacttcattatataaagtctatcatttcagagttattttcaaatctggataagcacaaagcatttccaattttagcattgactccaaatgaaataatttcttactctttctttgaaagaaagttaaaaggaggtagtaagagactttcgagaataatgaacgcagacttgatctctgttataattaaagctcttaattgttttcattgctcaacatcaatgttcagaaacagtgaaattagctcacagaatgatatggaatttctaataaaacagcttgatccatttaagggaacatttgcaatgttttcccacaatattttacagtctaaagatgtacaatatagctattttatatggaaattcgccgtcaagaatcgaataaactataatcttgaaaaaaaacaaattattctaatttcattggaataccgtatttggaaatacgatatacataagcagcttcaatctaaaatatttaatgtcaatatagataaattatctggattttttacatctaaatctttggaatactataattatttattaaagtggctatcgataataattacatttttttctctaaattgtaatgatttacatctcataatgaataaatttgataaaacaattggtttaattaattatttattcccaatttattcgattagtcgtactaatactgttgacaaaattttgtttcagttatccagagaaatgctgagaaatcaaaatataattaacctaaatttaaataattttaaacgaataataaaattaaataatccatattatctttataagttaataactagagctcagggaatatcagacccatattttattttatcaatcattgaagttactagcaaaaacataaaaaatagctattctagaattaaaaattccaaatcacataatttcaaaagtaaatttattgaagaaaatatctatgtaattttaaatgtccaaagactattttgtatttcatatattaaacattttaaaaataataccgatatatggaatgagtggttcattttaattaaaaagtgggaaacaacgaaaggtataatattaatgttgaaatactcaatagaaatgaagatgttcagtgtagcaaaaattatatctcaacaattgttatttaaagttataaaggattgtgggaatgttcaatatacagaaaaagaattgaaacattttttttctggggataacttttttgaagaaataggaaaagataataatttcaataatttttctttagtttcaattgtcaattatattattacaaatattagagatgaacaaatttttcagaaatataactttattaaattatctaaagctgttgtttcaaaatg

SEQ ID NO: 2461 - DNA, 1629 bp, Cryptosporidium hominis
atgtatattagtgggcaaatgaaacgtacattacactttccatgcgcatcaatattaaattttaaatttttcaattcaatatttgaattatatgaagaattatttatctcaaatgttaaaattagaatgaatgaaatatatacaatttcagatttagtttcaaactggaaagatttttctgttggaattgaaaatgattcagatttttttgaaaattccaatgataatttgagtttgtcatatactacattttttttagagagaataacaaattctattaaaaaaaacttatttttaaaatataaaaaagcaattaaaatgataaaatgcattcaagtaaaaaaattgaacaatataataatttattataacaaaaaaaaaacgaacaaaaaaaaattctttcaacttgacttcattaatcacttattaatacaaagtgttccaaatcactattttttaataaatacttttgtaaaattaaatctatggtgggaattaatggtttacattctaagatggagttttgagcttggaccttccaaatcgagatctttattaatggataaaagacgcgaaatacaagcaaacaatgaaaaaacttttgaagagatattttttgacctggttataaaaaaagctcattcaaaaggccaattaaattctctgatcaatgcaatgaatgaagccgtaccattgggaggcccaagagccgctatagttgtgaaaaagtgcaaaaatgcaatacaaaaatacttagaatgtagtggggctttggaaatgttatatagatcttttctatcactttatatttcaattgaaattcctcacgcacttatgggggcaatagcaatccacctttcattactaaaccatttaaatattgattcaaggactggatacttagaatcagctttataccatttcaaaaatgcaaatttggtattgaaaaaaaaatttaagtcaggagtaattaaaaagaacaaacatgtatctccaacaaattgtattaactgcgaaagaactgcagaagtcccatttctttctcaaaatttgaatattgggaaattaaacgacgtacttattccatttatcgctgacattccaatctataaaattaatatttctccttggggtggtctttcattgccaataatacaaagaataatcagattggtcgagctgcaaaattctattattaaactcttaataaaagaaaattcatcaatgtcaattttaagtccaaattataaggatagaagaaatgtaatagtagttctatttcttattcgcgaatatcctcttgcatttaagacttctaatgtgcttgaaataccattgatggaaattttggtgcatgcaactagagaactgatagtttcttatccaaacagcaattctctttattgttttctggattcaatgaaactgtggctgtcagaatacgactcggatgcactaatatcaaatgcaataaatatgtggatctcggaaaaaaaaataaatcttaataatatccctgaattagaaaaaaacagtataatggaactcgttaataggctgtcaaaccctttgagcagaagcgaagcatttaacatgataaatcctttaaaaaaagttaaattaagttaa

SEQ ID NO: 2462 - DNA, 645 bp, Cryptosporidium hominis
atgagcactttatttcttcctgaaacaccaaaagaaaaagaaagagatgatttaaagttaataaataccttctctaaaggaagaacagaaaaaaatctctcattgtttgaggaaacagatttacttattaaaatacaaaattccaaaagtgagaactatgaagagcatttagattatttaggatccgataatcgattattacttaatgattgtttgaatggaaccccagttaaaaaaaaatataataaagaatactcatttacacaatcaaataaacttctaactactcccaagaagtatttcggagaggatattttgaacactgttccaaaaaatatggtaatgttcacaaattatatggataaatcattatcaaataaacaatgtagtagaaaactaaatgatacttggcagaaaagtaaatttaggcgttctttgattagaatgaagtccgcatgtaataagcaatgcaagttttgtaatccagaattttcatgcagaaatatttcaataaaatcggtaaaaaaaaatcttaaagagtggtttatatatttatttaatgcattatacgactttataatatatcaattaccacttgcacttattttttatagttttgcaatatacctacttagctgcctttaa

SEQ ID NO: 2463 - DNA, 234 bp, Cryptosporidium hominis
atgattggaattgttgctgatgtcttaggcagcagtaagattactgaaataggattacaaagccacgttggaccaattttccttgctattggacctgaaggaggttggacaaaagaagaattgacagacttaattacaatgggtttcagagtcgtaaatatgggagatagaattcttaaagtagaaacagcactaatatccctatattcaaaggtaagttttgcaagaacttag

SEQ ID NO: 2464 - DNA, 255 bp, Cryptosporidium hominis
atggtttttaggtatttgaaaaactcgaaccttaaaaaaaatgaaaatgaactggaagagtgtattgagattgattgtaaaagtggaagttcagaatcgtttaatgaaacaggattatatgactatgcatttgatcattcaataatttcaaaagctgcttcagatgattgggtagctgcaatacctcgaattcataaacaagtgggtttaaatttttcaattttagatttatcatttttaggttatgagcaatga

SEQ ID NO: 2465 - DNA, 1734 bp, Cryptosporidium hominis
atgctacatcttattataccaaagaatgaaaacatgcttagaaagctccaggaaccaccaaaaaatacattttttactagtaatatcgatagatcaaaaattaccccatatgaatggaaatgtagatggaggggactgcactttaaggtttatacattaagatttccaaactcattttttggatatccaatacaaatttttacgaagtatatttataaacatctaggaatatttttaattggagtttattcccctgatacaaatagaacttatttaaaccctcatcaatatataattggagataattcaaatatttattatgaggggtcaaattaccttggaattgtgttatcttccagtatttcccttgtaaagaaagcagagttattggaatcgccaaaaaattacacagaagagtttcttaaaaaagtagggaggaggagctgttctccatctaatgtatttcttaatagaagtaaaaaattcaagacaaaagaatatattgaaaacaaagatcaattaaatatttatgattgtacaatcatgtctgaaattcataagcattatgattcgaatgataccgagaaaaatataaaaaatttgataaatattaatgaagctgggaaaaatatacaaattactcagcataatcgtgaatttacaaatttaatcaattattcaagttcttacgatgatcaatgtttatttgaccaggtaaaaaatatggttcttcccaatcactttgaagaaactgcatctaatatgacgaatataaatagtaaatttgatatctacaaaatcaattctaatacagttagtttttctcaatcaaatgtaaattttctacctgaagcaaatatcggcattccagtagtttcaaattatttagaagcaatttcaaaagtttttacaaatagagaatacccaattgtgctgattatcggatggtgtgaaaagattgatatgctgataaaattaaccttttcacttaaaccttcaaatttcattgttttatgtgaaaaaattatagattccagttttataaatgacgagttttttggaaaaattgcccaaatatctggtgttgggacatcagaacatgatttaaaacaagccggagtattggttgcatcaagaataattatttttgattcaacagggaatccttcaaatatatataaagaagaactaattaacgttagatatggaaaacatgccattggtacttggatagcagtatgttatttattctccaaatacaaaaaaaaagataattgtttagtaggatcccaaaaaataccaccattaataatagatattaaagaaacagacattgggttattattatttcaatactcggatgattggccaaccaggatcgatggatcaacttactctattccatataagaacgaactagattttttttattcaagacaatttcttagtggacagttttttgtggataacattattgattcattgattccttttttagttccaatattagataacaatcctataaataaatcatttattaatcaaataatttatggaaatccaactagtaaaccattcggaaatgttaggtattataacgaaaagaactgtagtttgcaaatggaagagattccatttgtatttgtgaattctacattttataacttattttcagtaagtttgttttccttttataattataaatttatttttgatctaacagcaacttcttaa

SEQ ID NO: 2466 - DNA, 789 bp, Cryptosporidium hominis
atgtggggatttatagaacaattaagaacaaaagcaggaggatttattgatttatccagtggaattatttgttgtgcagcatttggaagtttattactgatatttcgtaagtacattccgcatccatctgaattctttccatttagttggttttttttaaaatttggtgttcataaacatgaaaattttaatttattattggatattctcgagggagttgatattcctgaaacaggaaagtattcaataagaattaaatgcggtagagaaactgacgaatcatctacaactatttgcttggaagatgtaaacaagtttactaataaccttacaaaatcatttaaatgttgttggaaagaaaagcgtattatttttgtaagacaaagggagaactatttatttattgaattaatcagccatggcacttttaccagttctgtaattggagaatgtagaattagcattatggatataattgatgcaaagtttccaaaaaaagtaacttataacatccaaaaagacaggaaggttgttgcgaaactactgttatctttttatagaatttctgcaaacataatagttgaggatacaaatccagtattatttcaagcaatgattaatttacaaactgatgcagatatttcaggcaataaatcaatttatgcagattttgacaaaatgtcagaaaaagaacaattaatattcttttctaaagcattacaaggaaatctatattatttagaaaatggtgacaaaggtaagttatcacaattctttttaaaactttaa

SEQ ID NO: 2467 - DNA, 804 bp, Cryptosporidium hominis
atgaacatttctttaatggatggaaaaaatgctattaaagtactaaagaacagtctatctgatgatgatgaaaataaaactatttatgttaacaatttaaatgacagtatatctatcccaaagcaaaaattggcacttgaagagatttttgcaaaatatggcaagattgaatcaattaaaatgtttaactcatattttaggaaaggtcaggcatggataacattttctaacgctgtttctgctgtaaatgctgtgaataatgaaattgggacgcaaatatttgggaaacacgtaaatgtttcatttgcagctgaagagtcagaacatagaaatatccacattcgcaattccagttccaatattcagatgataccaaaatctattaatgctcgcattgaattatacaagcaatacctggctcaatggttaaaaaatgctgaagacaatggtttatttcaaactctggacaatcctgaagaaaaccagattaaactagttaacaatcaagttttatatgataacaactacgtgaacctcatgcgttctaacaaaaacaaaaaattgaatgttcatcactttattaacaatgagcttacacaaaactccctaggaagaccggagatgcaaattgatgccactacatcctttcgacacaaggttccaaataacgctagcccgcatgagttaagcaatacagtctttgtacaaatggagatgggtatatgtagagaagaagaactatatactttatttagtcacataaatggattcaaagaactccgttttataccagtaagtttctaa

SEQ ID NO: 2468 - DNA, 657 bp, Cryptosporidium hominis
atgaattacgatgaaataagaagcctgatattagatacggcggaagaatataagcattcgcttggtagcgattataggctagtgttgaaagaaataaatcaattaggtgatatatctgtgagtgatagttttgaaaagaataaagttgaattttctttttcacttaagaagggtaaagagaaatataaaatttctatctatgtaaatagaaaattgttagagagtaatgaatctcttatcggtaataaacatctaaaaaaatcagttaaaatatctgcgttggctttctgggaattttcggataaaaaaaaggaactttttgaatattttactgaactttttgaagaggacggcatttcaccatttaaaaatagcgaatcccatgatatattttattctaactgtgaaggtttgagggatgagctaattccttcctgcgacataatatcattctttgacatttttttactctcattattcagatccaaaatacctcaactcattagacacttgggctgggatgagagcattcctcttagaaattcactaatagaacacatagcatccgatgaatgttttaaggatttagatgaaagtagtacagacagtgagtctgaggagagtactatgaaaaaaagagtaactaggagatactaa

SEQ ID NO: 2469 - DNA, 519 bp, Cryptosporidium hominis
atgacagtagaggtgaaccctatgaaaaatattaaaattgagaagttggtcatcaatattagtgttggacagtcaggtgatcgcctcacccgtgcagcgaaggtattggaacagttgactgaccaaaaacctgtctttggtcaggctcgtttcactatccgttcattctctatccgtagggctgaaaagatatcatgttatgttactgttcgtggtgataaagccgaagagattcttgagaagggtttgaaagttaaggaatacgaacttcgtagaaggaatttctctgcaactggtaattttggttttggaatagatgagcacattgatttgggtattaaatacgatcccagcaccggtatttacggtatggacttcttcgtacaattaactagaccaggtaatcgtgttagcctaagaaggaaatgtagatcaaaggttggcaagcacggtagagttacaaaggatgaagctatgcaatggttccagtctaaatatgatggtattatcttgaactga

SEQ ID NO: 2470 - DNA, 1986 bp, Cryptosporidium hominis
atggaaactcaaacggttatacaggagtttgtattagactcatgggagaaagtagttgattgtgaaatgggatcaaaaagtccgaacgtttctacaaaaaatattagagacctagttccgccaaagaaagtggacagcatcgcggatacaaaccatattgaacatattgtagaggaaccatgtgaagacctggggtttagatcaccagtttgctgtattctaggccatgttgatactggaaaaacaaagcttcttgacaaaatgaggaaaacaaatgttcaggataatgaagcaggaggaataactcaacagattggtgcaacttactttccacctgaaatgctttccgaacaagttaaaaaagttgaagctgactttgaattgcaaatacctggattattattcatagatactcctggacatgaaagtttcaataatttgagatctagaggctcgtcattatgcgatatagccgttcttgttgttgatattatgcatggacttgaaccgcaaactagagaaagtattggattactcagaagcaggaagtgcccttttatcattgctttgaacaagattgacagactttatggctggattgagcagaattggtcttcttctaggtcaacactttctatccaaaatgaaagtacaagagatgagtttgatactcgtcttaatagagttcttctagaactttctgaggagggtcttaattgtgatatatattggaagaatgatgattttagaggcaatgtatcaattgtaccaactagtgctgttactggagaaggagtgcctgacttgatttatttaattgctcagctgactcagaattatatgggcctccattgtttacaattgaatacgcgtgaattaagctgcacgattcttgaggtaaaggctatcgacggtttgggcgtgacaattgatgtgattcttgtatcaggaatattaagggaaggtgacacaattattgtttgcggtctttctgctccaattgtaactacaattagagcattgttgacccctcaaccaatgcatgagatgagggtaaaaggcgagtatatacatcatcgttttatcaaagcttcaatgggcgtaaaaatatgcgcgaacgggcttgacgacgctgttgcgggaacacagttactagtgccatctaagaattcaactccagaggagatcgaatcattgaaagaggaagtcatgagggatatgggcgacatttttagttctgttgataggacagggaatggagtatatgtaatggcttcaactcttggatccttagaagctctattagtttttctaaagtcttccaatattccagttgttgctctaaatatcgggactgttcataagtctgatgttagaagagcatctattatgcacgaaagaggttttcctgaaatggcagttattcttgcatttgacattaaggtagatgcagaggcagaagttgaagccaagaaacttaatgtaagaataatgaaggcaaatataatatatcacctttgtgatatgttcaccaagtattatagcgatgtccaggaagagaaaaagaaggagaagtctcagaaggttgtatttccttgtatattaaaaattattcctcaatacatttttaatgctagagatccaattatttgtggcgtttatgtggaggaaggtattttaaaaccaggaacacctctttgcattcccgagaaagataacttgatgattggccgcgtaacaagtgttgaatttaacaagaaacctgtaagtgaagggaagaaagggcaagaggtcgctgtgaagattcagccttttgcatcagacacaaacatcacatatggtaggcactttgatcacaacgataaactggttagtcgtattacaagagattccatagatattttgaagcaacattttagagatgatctatctaaagatgattggaaattagttattcagttgaagaaaacattcggaattccttaa

SEQ ID NO: 2471 - DNA, 1227 bp, Cryptosporidium hominis
atggatgttgatcttccaatttttgaattcactcttaaaaatcttgagaaaaaagagttaaacaatttgacagacaagaagattggtgttacggaagataatccagatgaatatgatatatcggttagattagagaatatttgctggaaatctcaatgttatgtcgatattttgccattagacttttgtgatgtaaatcattcacttttaaatgagactaattcaagaaaaacggtcggaatgggatgggaattacaaggtaaactaactaaactgggatacaataatttcaataaatacttaattagtaactatattcatttatttccaattggtatttctaagtcgaaagctaaactttgtaattgggcaaactataaggattttactcaaaagaaattattgaaattatgcattagcggaatcccatccgatattcgaggagaagtttggtgctatttattaggaagcgatcgaatgctgaggaataactcgaatgtatattttaatgagcttaatgggagcatcgataaaaatattgaaaaccaaataatcctagatttacacagaactttcccaaactctaaatattactctaattctagcaattttaataaagttggtacattaagtagagttttatacgcatttgcatcgtacgacaaagtaataggctactgccaaagcatgaattttattgctgcaattctactaattaatatgaaggaagaagcagcgttttggtctttagtacaactagttagtagcaatagaaacaaagagtttatggtttgtagctggggagatttagagacatattacggagaaaggatggatggaataatacgtgacattgccattttagagactctctgcagaaaatttattcctaaagtttcacaaaaattagaaaatataggaataaacttccaatggtttgcattagagtggttcctctgcttttttgttacatctttgcctttaaaatcaattatggagatattagatctcattttttgtttcggtagtgatgttttatttaatatttcgattgcattattagatataaataaaaaaaaattactttcatccgttaatatggaagagtgtatggaaattttgaagaatattacaaaaaatattactgattcaactaaaataatcagaaaagcaatgaaatataatatttctagtaactatatacagaaattaagagaagaaaattaa

SEQ ID NO: 2472 - DNA, 1866 bp, Cryptosporidium hominis
atgttgagtgaatcagaatggttgttttttgcctcaaatgttgaggttcatgtttctggaaagagaatcatgcaaaatttaggtgccaatgggacaggaatatattataaattatttggtgatgacatcaaagtttgtatccatgggtttaatcgtgagtttaattattcatttaaaaaggatattttatcaattttttggaagttctatttagatggaaaattcacaatggttagcaaaaaatacatatatttttttttctcgaatgcaacgccaaactcgattttttgctttattgaaaaagtatcaggtattactccccagtttttatttcccagattcagctctacgaataatattatttataaatcatctctaactttcaaaaacaaatttcccgataataatgataaaatgctaatcaccaaaaaacaaaaaattacaaaatttgaacaaatgaatcatcagaagatgaaaaactgtgcttcagaaagtacatttgaaggtgaaaggcagaaaatcttctgcaaaactaactcgggtaattacccaatcatttcaacaaattgcatcagcagcctaccggaagatttattattttatgttctctcaatgcttgttactccggttgtttacgaagaaaatgaaaaatcctgcattaattataattcattttataaagatgacttaattaaatcaaccaatctagcatttgtaaacagtaggctattgaaatttttccaagataacgtatgggagattttaattcatcatagattgcgcaaaaaatccaaaaatataatcaattttaagaatttaggaagtttgatcatttcaagtaaaaacattaaagactctgatattaaagaaattgcttccgaaaaatatctcccagcatctataaacaaattaactataaatggaaataataacattactgactctgcactatcgcttttccttttaagattaaggaatctggaattcttagaaattattgattgtaatagcattactggaagctcttcttttcgagtaattgggatgaagtcttcaattaaatttttaaagataggatcaaagattaaacaaaacttttcaattaatgacaattcattgaaagatttattcaattcaaactgccaacaaaaattaatcaaaactgatgtgagtggctttacaaaacctagtattaaacacttagagcttcaaaactgcgtcggaattactaagattcccataactgttaaagaatattgttacaacattgaatatttggacttgaggggctgcaaaaatattttaaatattgaacttgaacgtttttttggttactctaaaaatctcaaagttttggtgttatcaaatacaaacattagtgatcaattacttgatataatttttgaaaactgtcctgggatagaaatattggatgtttcttattgtgctaacatttctgaaaaaatatttgataagataccaagtaaattaaaaatgatatctggtctcaaattatcttattgtctgaatttcaaagctaatgccctgatacaaattttaagtaattgcaaatttttggaaattatcgatttagcaggatgttgtaatttagaatgtagcctaattaattatcgaaatatgacctttacttcaaacttaagaaagatgggagtatttaggctctcgtttgacccaagaagactgaatgaatggatattaaacaatatggaagtagagccaaacaataaaaaaataaatatcgaaatatgttatgatagagagcttccaatatcagaatttacttataaattcgagaaaataagagataaatacttagaaagaaataaaccaatttgggtaaattaa

SEQ ID NO: 2473 - DNA, 864 bp, Cryptosporidium hominis
atgtattttacgtatgtagttcgaccaggagatgctcctgaaggaagagggccctcgcaaccattatttttcgaaaactttttagtaaacaacctcaaactgggatttggttcaatgcttttgggttttattggtctgacgatctgctcaatatttagtggatttggattgcacataacaaagttcttaagcccatttaacgaagcaacaaactcaactggaacagcgttgttctttatgatatttatgatttttggtgtaatatgcttaaatatgtcgacaattctaatggatgatgacggcagtattagccaaacacgtgggtttaggtcaggatgtaaagcatttggccaaggctctctcgttattttgttgggattgatacttattgtagttacattgtactcaaatgtgggttactatgaaggtaatgctctatctggtctagatctcaaccacgtaattaaatgtatgtataatgcaggcttagctattacgagtgttggactaacaatacttggattcgctgcatttctcgttgaagtttattcaagtgatgggaccagagagatactaggatttgcgagcatattattgtgcaaagtttctggtatttttatgtttttaactatcatcttcccagattgcaaaactattggttctctttctacattgttaacaatcattgcgcttactcatgtaacactttgggctggaatttttgaaagcatcgctctcaagtctagaatcaaaatgacccaatcagctgttagaaatgaatactataaaagtagaaatgcgcttgcatactttggtcccccagttatggccgagggaaattatacccaacagccaacaatgtga

SEQ ID NO: 2474 - DNA, 1032 bp, Cryptosporidium hominis
atgtattctcaaccatattccggggaggagcctatgctctatcaaagtagaggtccaaacaaatcctctactaatcaatttaatatgtctgcaactaacggcatgcaggtaatgaacgatggaataatggatgatgaagccttaaatgaaagaggtgaagagattaccccacttatatcgaatttctcttgtattactctcaggactgggacgttattgcaatgcgcaagcttacttgtattgattatcctatataatgtatttggcaataaaggattatttacgtttgacctatatggtaatggcggtactttagctgaggatttgagttattatgcaggagttgtttcgatgctatgcgtatattttattggtgttttgttcttagcaggattccaagaatttatcgcagataactcaaaagctcctttgggatttagagcaggctcgagactactaaatacagcaaatattattcagattatcgtggttgcacttagagttacacaattttcgtttacatacagctatttcaatcagaaatggtatggaaaatttagccaaacaaagggtgactggtgtttgtacaactttggaattgtttgtgaggcagttagcttaataatgtacggtattagcttcttttatgtagagtcatatgcggacgttggagttggtgagcagtatgcttattggatgttaactttatttacattggctggagtctctgaactaatgatgcttttcacaggttttggcagcttctttatccttttctttgcagccgctcttattgtcacatgtacttgggcatttcaatttgaaccccttttagaatcaaactcacctttattattttcaagagacatcaatgccgacgttttaccaaaggaaactccattagatgatatgagcattgaaaagaaccaaactgtcaacaattatcagccaaattttacttatcaactttatgcaggcgcatctggagtttctagtgttccaaatccgtatggggttgaaatgcaacaataa

SEQ ID NO: 2475 - DNA, 1494 bp, Cryptosporidium hominis
atggactctacaatagcaaatccgaatattttacctagtaataatattaattataaaagatttgacccgggatattctgacatagaaaatattgaattgttaaaagaagcaattagagttggactaccttctcattatgattttgaaataattaaaacaattaaaaaaattaatgaaataaaatctatctcagatgaacgtgaaaactttaccgtgtatttacaaatgccggaaggattgttagttttttctcaatctatttctcttattttacaacactttacccaaacgagtgtagtgattttgggggatataacatatggaggatgctgcatagaagatcaattaatgagtatattagaatcttcacattcaaaatcatcaaaccagtctttactggtacattatgctcattcatgtttaattccatttgaagaattagctatgtctaaagatattaatattgcaaatattctttatatcttcgttgaaattaatttgttatcggatcattttattcaaactatcaagcataatttcaaaaaagaagacaagattgcgctattatcaactattcaatatcacagcacaattgttggttctcagaagtgcttgaatgattattttttaagcccagtaaaaattccggtttgtgacccattggcatggggcgaaaccctcggatgtaccagcgcaattattgatagcgatgtagaaaagtgcatttttctttcggatggtagatttcatcttgaaagcgctatgatacaaaatccaagtaaagtattttatttatatgagcctttttcaaaaaaaattacaagagaaacttatagtcatcagcttttacatgaaataagaaaaagttcaatagtaaattcattcaaaatagttcaagggggcggaagtaatttaattaatgactctgtagtgattggaatattcttcagtacattaggccgtcaagggagttttgcaatagttgaaagactggaaaaacttataagcaaatataatacgaacacaaataataaaacaaaaattgtcgcttgctctatttttgcttcagatttatctgcagaatgtataaatgataatattttagaaggggtcgactgttcaatacagcttgcatgccccaggctatctactgactggggagcctattataaaaagccaattctaaattcatatgaggcatttgtattattaggaaatctttctaataataacttccagtttttttgtgatatggaaaataatttagatttatcaaactccgaattttcatacctccaaacttacccaatgaattattgggcatcaaatggtaacatttggtgtaactattattcagatgaatcgagaaacggaagttttggagcatctaaggaccaaattgatgagataaagtacaatattaggcagaacaaactcaagaacttgactaaaagaaaaattaacttgcaatatgagagaaatgagttagcttag

SEQ ID NO: 2476 - DNA, 4428 bp, Cryptosporidium hominis
atggaagaagttaatataaatcaagttttactagaaagagggattagttacacttgtactcaaatacttgatgtccatgcaaaaaaattaaaaaatgaaattaatactagatgtagagaatttcagtctgttgatgagctgataaatttttcaaattcagatcaaaacagaaatgattcaaatggcttgctttcaaattttgattggagaagtagttatttaccgcatatttattctgctacattaggattgaaaaatggctttattgacccaaagctgcaaggcgagctatatcaatccgttttaaagtgcattaatcaagggtttgtctccggaaatattggcattataaggatttctgaccattctcatcctgtcagattagcgactccaattgataaaacatgctattcccttgtttggcgtaaaaaagatttgtccgaaactcacgacattcctatagtgttaggagaatatactggggatgtgaaatacgtcggagatgaggaaattagtgacgagtcatattcattccagcttacttttaaaagttcggcatttaaattcacaggcgctgttgtatcaggtagtcaacaatttggtgatttttcagcaaataacatggataaattgaatgataaaccaacttattctcctgatgggtttgaatatactgaggcaaatgataattcacattccccaaataagtcttctttcttctcaaagccgtttagtcaaacccgaaatgaattactttcaactgatggtaacattaaaaaaataggagctaggcttttacttccaaatgaaaatgaatatatattgtcagctgacaagacttgtaatgaaatggcatttcttaatcattatgaatgtgtgtttaataataattttaactttagaataaatgttcaatggcattctgtttatgttgatggctggccacatatcattttaacttctattcctgggattggaatcaaattgggcgacgaacttgcagcagactttggtgaaaactggttttctagaattcggcgtatttctgaaaacaatattaaaaacgagttaattttatttaggttaagatttaatagtagtaataatcaggggagtgtgaatttttcagatttagatgagaatttatcacttaaagaaactgattcgaaagactctctatctaattgtgggattagtggactgataaatttttatgatatctgcgaagtttgtcagaactcgatcacctcacagacaagaaaaagttattacaagccaaagaatgaagacagtgttttatttttaaaatcaaaatttgattacttgctttgcaatggatgcaatcgagcctttcactggtactgcgtaaatcgccctgagtttagagatcttaaaactagttcaaaaaattggttctgctttcaatgtctttcattgactttgagaattcttccatcactgatctatagaattcctaatttaactcctggattaatagactccattcaaaatttgtataactctactgatgatttaattccaggcgtaattgatgcaatgggaaatgttgttcttaggtcaacagatgaagttaatacagaagaccccaaaagcatcgtatttaggccttcagaatattttgattataatttaaggcattttaacgagtatggtggtcttgaaggtcttactaaactcaaaccttgctatttgtgttactcgtcgtcaaccatttcaaatcaaatgattggcattgcaacgatatgcagaatacataggcttcatattgctccagattatgacgaattttttaattcagttcagtacacctataattctgataacaatcaactggtaagtgacagttcccttcatttatctttggtagctgatgattatggtaaacgaaagtatgcagtctcagcacaaaggaacacagaagatattataagaccacacataaaaaaactttctggttcaagatatattattgaaaggagtaggagagttatttgttctcttagacaatctctctatcagtcagaaaaacacagagtagaactattatataagcttgagaaattaagaaaaattcaggacgaatattttagaaatataagcgaaggaaatggcatgattccagtactatgtattaaactcggaagcacaatattaaataaagagttttccggtaggctttatcaaggagttatatcacgttactatccaaaagagaggatatttcatatagaatatcttgacggggatcgtgaggatttagagtataatgattttatttcattattagctaatgacattaagaataatcgaataaatatcgatgatttattaattaccgatagccacgtaaaaagtaccaagaaaacgtctgaaaatcctgtaccttatagaaattcaaaaaagcgtacaatatttgggatatctgaagaattttataaatccgaaaactttgaatgcaatattatcaaaatgaaaaatgaaaaatttttgactgcgacttacaagaattttaatatcgattcaatttatgataaggttaaattgattcacaaatttattattcaagaatgcaaaataaatcaagataatgaagatgcaatattaattagagaaacccctaagtatgaatatattgatcaacctgaatggaatattatttgtggatcattaaacatagaatcaaatttaatcgagtattttgttggcgtaaatatttctcggattagtcacaaaacaaccacatttaatattacttcaaaaatttgcattgggaatgtattcctaattaaaaccatccccataacaatctataacgagtttagtattaataatgatgaattagctaagccaaatgaaaaaagtcactcagaaatattaaatactattagattttcagcaatcgaaatacttgcttggactcagagtcttttgagtgaaatttttattaaagaaacaagtttaagcaataatgatggtattgcgcttgacaaagttaatggatgcgaaaatattaatattgaacaaaattccaaacgggatttaagcgaatctttaaactcagattttaattcagcacttgtgaaagaaaattggttacaaaaggccaatttgattgctcaagcgcttcaaccatatccaaatggaattaaatggattaatgaaacacactcatggaaagttgtttattcaaatgagtttggacagaagatctcgaagtttttcgatacgattccattcgatgaaaatgctacagtagagtcattgtatttaaaggcatgtaaatttgtttcagtttctcaaacaaataataaagtaattaaaatgcttagcactagcagaaaacttaataaaattaccaatgagatatctagtccactagataaatttatttttaatgaatgggggaacactatcgaagattttttggcaagatataatttaaataatcctgatagaactgtatattccatcaatgattttaataatgaaattaactcattaaggccatttcctgataatttagattggtgtgattctacattttcctttgtagttgctctacctagtaatgaaaaaagatcatttcaacttgataaattcgaattcaatattattaactgctattcagcggcttacagtttagcaattgggaatgtaaatattgataaggagttttataatagaaagataaggaaatataattcaagagtaaagaataacaccaatcctacccaattaaaaaaacaaatttataaaaaacacttgataaataatagacacgagagtcctttggaagaaaaaaaggaaaatttttctgtgaataaatctattaatgccaaacaaaaaaactcgaatgaaacaggtaaattcacaagtttgccaagttgtcaagtttattcataccaagataaagaaactacagatacaaacacttcatccgaagaaagtttacttggaaatatttgcgaatcaaaaatagagcctaaggagcttactaatgaagattcaaagggaaattctttcaatgaactaccaagttacgatgaagataagctttctattcgagcaaaaagtaataagcgtaaaacaatagtaagggcactgcctgctccatcagatccattgagcagggctagaataattgaatatagcaaacaagctgatgagctgagaccttttccccacggtataacttggtgttaccgttctgcaaggttcaaagtaagatataggagatcaagtgatggttgttggactgcaacatcgttcactcccactaaattcaattctgtgaaagaggcatttgaaaacgcaatagataaattagcggctcatattaacgattataaaaatagtaatgaaatccctattattccgaagaaaagacatttagaaattgaaccttaa

SEQ ID NO: 2477 - DNA, 1197 bp, Cryptosporidium hominis
atgccccaagagccttggaatgcagaagaggatgagctgttgtatcagttagttcaacggcttggaccatcaagctggtctgaaacggctagattgcttaactcaacacttaacgtaaatagattagcaaagcaatgtagagaaaggtggatatcgcatgttgatccaagaatcagaagaggtgattggtcactttctgaggacagatttattttaaaccagcaaaatctttggggaaacagatgggcagatattgcaagacatcttcctggaagaactacgcatgcagtgaaaaacagataccatcaattgcaaagattacttaaccaaggaaaaactaagcttgaaaccattcttaatgcaccactaattcacgttgtaccacacttcttgcaacaaacaaatttccttaaagatcctcctgaaaaagaatccgaagttggtaatcaaataagagttaaaaaagccattattaaaaaaagacgagaatctatgagtaactacagatgcatgaatgaaaaggaatcaatcgatcaatttaaaaaaaacaagtcaatctattccgaaaatgaagtatcgttcattcaaagtgaactagaagttgataagcattactctaaatcaaacagaaaaccggttgagaactacagtcgttttgaaggctttgaacgaagactagaaaatgttattaaaaatgatcccgaattatataagcaaagaattcaaacaattgaaagtacttgcgaagttatgccatcgaattcagaaatagagttttctcctagaaacttcagacgcgcatgccttgagttccagcaatccccaccaggtgtccttcttgcaagtgatgttggtatttaccctgttactcctacattcacagaaaattgcaacaattataaaacaaataacgctattgaaccttctacgtgcgaaacaaatcaagataatgaatatatctcaaaatcagagttcttgacgccatcatcagagttgagcgagtgtctacctagcaagtgtattcaaccaatttgcacctttaatgaagagccaagtatttacaatgaaatggattatagagatcctaactggtatgtatggaatgaaaactcaaatgtatgggataataacccaatacataggcttgatacaggcagtatcgccgatccatttctgcattcattccccgagatctag

SEQ ID NO: 2478 - DNA, 606 bp, Cryptosporidium hominis
atgaggcaaaaaaagttatcaaaaaatttggatgacaacgaagatataaattctaatagattattacaaaaagatgaaagcgaaccaattgacatattgtcggatgaaataattcttttttcaaataatgagtctgctataaatcaagaaaagttatcagctattccgttaaataaaaaagtcgccactgataagttgagatttagatctgattattctggtaaaataagagggcatggaaattttgatttggataagaaacacatatttttcaatgatgatgaagggccaggtacaattaatgaagataataaatgtgaaaacttagatattgattgtcaaagaaaatatattgaacaggttaaaaatcgtttgaaatgtcaaactaaaaatgataaagaaagagatagagaaagagtgcatgaaatgcatgttaaaaaaagaagaatttcgcgtcaatttagaagtgagaaatcaaataatgccaatgatgttgaattgattgaaagcagggaagaggaagaaagcagaatttgtgatgaagataatttacacaatttaactacagcggctttagaaaaattaggaatacaaatatcaaattag

SEQ ID NO: 2479 - DNA, 1117 bp, Cryptosporidium hominis
atgctatcttcaatagatataaatttatatgaaagaaatgttcttcaggcactgagttttactttattattcacaagactttcagttggcttgatagttttaaacaacatttacacaaattgttctataattagggatattacagttaacaaaataaaatcattatatgatattaaagttattattgaaaatgaaagcgagttgataaaactttcaaaaagtcttggtatttcattaaagcagttatcaaaacaatcagaagacttagataattcaaacaatgcagaattacttagagttgactctgacaattattcatcttcgatgtcattaataaatccatcttcaatacattctgcaaatatatctagggcgctatcttttgcagataattcaaatgaatcttcttcaatagggtcttcaacttttttgaacactccaatacaatctattgatgactttgaagcagtccctcattcttcaactttacagggattatacaaccgattgttgattaaaaaaaaaaacgatgtttttgaacgtttttctccatcaatgacatttattgacaaatatagacaaagaacaaaaaaattatttaggagcttaatgtataaatgcgaaagttttatattaactattagatttgcagagtttcccgattctactcttccaatttcaacaaaagctgtttctcaagtttttcttgaccaggagatcgaaggcatgtatactcaatggttacaattttactcttgtaacacgattgaacattctctccattatatattattatcttgtattatcattccactaatgtcttcagcagaatggcttttattattttctaataagtctaaacaactactatgtatatattcaccttatgtatgtttaatacagacttcaaataaaagaaaaatcacttttttcatttttagagagggaattcaagttgtagtttctatgattttaattggaatgatatatatcctctgcaaagtaaataaaataaatagaaaaagagaaaaaagcaaaagcgatcaagaacatcttctgaagggaggttccattaaggaaagaataatcaacgctttttcaagaaaaattgtactat

SEQ ID NO: 2480 - DNA, 690 bp, Cryptosporidium hominis
atgtttgaattagatttaattaattctcaaacattaagtttgcttagattttctaataagcattctaataataagtggacgacgaaaattacatcatttaccatcaataaaaacaacaccggaaaaaattgtgaaagtgggaatctggaagttgtgagaaagttgagtgggtctggttttcactggaatcttgagacagaactaattaattttgaaaatacgccaatattactggactcttttaatcgggaaatatttgtggatattgacgaaatttctcaaagaaatgaaaagaaggttgatggcatcttagttcctcttcaccccgttcacattgaaagacctagtgaagagtcagatagttcaatgttattgagcattggaaaatcatcagatgtaccgattcatgcaagatatcaatcagcatgtaatggctgcaacttcaaaacggttaaaataggatttccttcaattgttatttatgaggagtcagtcgacaaacattgtttaattccgaaattaaggtttgagattgcaccaaatcagaatgttaagacggggagttcacaggagatagtaattaacatccctgtcgggaatagtaaggatatcaactacgtttttattgctactatacttacgataatcattacaacggtgactactgggatatcaataaaaaggtattaa

SEQ ID NO: 2481 - DNA, 1524 bp, Cryptosporidium hominis
atgtgggcggacgaagatgaacttcctgatcgaataagctttcttacatttaatgcaggactccttgaatatcgtatttgtggagtaaagttgtatcaaaaccctccatatacttctcacaggttactacaaatcccatcagcattaaggggaataaatgctgatattattgcgttgcaagaagtatttgatgaaaaacactctgactatattattgagtctttacagcccgtttatccatattttgctcgtgaatcaaaacaaagccagaatcaaaagtcaatgagatggcagccaatatccgttatacataatcagttggcactacataatggattgttggtgcttagtaaatatcctatattaaatgcaagattcacatgtttcagcgatgtaacattgattgaagaatggtttgtcagcaagggaatgttagaggtaacaattcaattaccaggaatggataaatcccctttaaccttatttaatattcatatggcaagtggagcggttaatcctgaatcagaaacaattgaaacactcagaaacaaggaaattgaacaacttttaggagcttgcgatcatgcaatccgtagaggagaggttcctgtcattataggagacttaaatgcagccccaaactgctgtggtagtaattataactattttattgatagaggctggagagattgctttgaatgtttcaaacatgaaaatagatatagcacatccgcttcatcgaatatcagttctcaaataaacttaaaatctaggcaaaatgactttgactataaagggaagcaaacatacatagatatggatgacctttacgacgatttaagctgctattctaaggaaaattttgctcatagagaagaacaaatcgaggaagaagagcacgcaaccccctctagtaacgattctttctcaactaggattgaaattgacaccactccgatgattaatatgagtattgggtcaagcataaataaaggaaatgatgatgttgcagtagtaaataagcttgtttcatcatttgcagttgcaaaggctgcagttgaggtagctaaaagaggattttcatcatgttccccagaatccacaagtatcgaagttgtgtcaactacaaaatcttcaaattgttcaaataacataaatgaatttcaggagaactatccaattaaacaatactttccaggtaataaagattattgtagtaaactattttcatccgattttacatgggacccaaataatcctcttaatgttatcggtccgcacagtaattgtcacggtcaaagatgtgaccatatatttcttccgccaacccatctatccaaaaagctggctcaatacgaaccttataagtctagcgttattctaagagaacctagagttcttgttgatggttggtgttttggttgtgttggatcaactgtactagttactctcagtgaccattatggggtatacgtagaacttaaaaggaagctcgacaataattacagaaattcgcaatattaa

SEQ ID NO: 2482 - DNA, 519 bp, Cryptosporidium hominis
atgataaaaagagctccacacttcggtgtgagaacttttaatgtaaatacaattaatttaccgatgataaatgcactgatattagaaaagttcgctgtgaaaagtaaatacactaactcccaaataaattgcgtgaaagaatgcgaggatggctatttagatcatagagaagaaagaaacaaaattagtattcaacatgattgggaatatcctaggaaaatattaatcggaagcaataagtcggaaaagctgttttattggtcggaaagtgagcagaaactctgctatactgagaatgactatcatcggatcaagtgcaatcacgagcttatttccaataaagaaggcaagaaaactaattcaataataaaaatgatcaaaccaattagttggtatgaaacttatttttcaaaatttggaagatgcaatatgtttattaatcaaagtggtgagctttattttgttaatgataggaaaaaaccgagagttatgacccgaaaaaataaaaatagttgttag

SEQ ID NO: 2483 - DNA, 4899 bp, Cryptosporidium hominis
atgcttttactttattcaggttcagagcttattataaatgtaaatattacaagtgagcaattaggagattttgaattattgggaattagctctggaatttcaaataattttgatgcactagtcaaattgaacggtgatcattccaataaagatcatttgttaggagttagatgctcgattaatctactccctgaagattttttagtccaaataataacaaaactactaataagaatttcgaataaagaattttcagtaagcctaattagggagattttattaaatagatcaaataagcattgggatattttacgcaaaatattattaggtgagactaaagatattaatactgaacaagagttaaagttttcgaacatgagctcaaatggttcaattgaatctccgatgtcaaatggagtgtataaaaagataaaattattttcagataaagatgcttgctcaaataataaatcaaaaacatggcaaatattatcaaagttttgggcaagttatttggagaaaaataaaaaatcaccgtttgatagaattgaattctcaaatttaatttctaagggtataattcctcatgaatttttagaggggaaaaagtatgactatactaattattcaaacaatggataccaatatttagagtttaaggccagtccacggtgtatgtacattttacatgcactttatgaagaactaagcttgttccctcaatttaatgctttagataattaccaaaaccgattgatgaaggatattttaattcccctttcaaagaaactactcttatctaattattatgaatactaccaatttttagattcttcctttaatttcataaatgaaataaaagacgattcaaatttttcagattggaactttcctccagtattattggacaaactatatttttttacaaggttttccaagaataataaaaaagacatttattttaaagtaattgagaagcactttcctttgcaatgctttactataaaactttatgaacaattacttaatagatcgaaaaacggagaaataattgatttaatttctaaagttgggattactaacactatattaccagttttaagcccagttatttcatttccaattgagaaatttctaaatagctactcgaataatgttccaaactcgagtttcgatgataacaaatactttttgttaggaagactagacatgctaagctccgcaaaaaatataaactcatcttactctagtgttaaccttaaaattgcaagtgggtcagataacattgcagcatctgttctcccacatggaaggaacactgtagatgaccaaaaaagcatgttggaaaatttgcaggcctattataagaacaaagtggacccattcagaataacttcagctgaaaaaagaacgataatagaaatatggaaaaatgatctgactgaatattcagatattggatcctttgaattgtcctataaatggtgttttcaagtattctcctatgacaatagatattgcgatgcactagagctactttcactaaaaaaccctcctcaaattttacttcaacgctcttcaggtgcataccctattgatgaagaatcttgggatgagtttcaaaggcaaagagtagtagatgcggtacaattagtttacactagcttacttggaagagcagcatgtacatttggcggatcttcatttgatatttcaataaataaaataaaccgtcccgtatttgtaaataaaatttatgaagttgcgtctaactctttgataagcgttgacatagagagatttaaagaagtttgctttgacatatcagtttggaatgaattttatatgggagttactcaatccctgaattattgctacccatactctaaattacctcaggatggttttaacaaaaataaaaagctctggataattgagcagatggatacattctcttctcaagaagatattccatttatatctggttttttatatggaatctcattaactggattctttaaagcggacaaatctgattcaataacaaccttccctttaattttggagccaaaagagatttataaaattctagagaatgatggtcaatcaataaagacttgttcgatgttgttagcaaccgctatttctgctctcaaatctcaaaatactacacttttaaggctttatttaatgcatattcccagcatacttccaagtatttatacaaagtctcttcaaatatctagcataagtcaatattcggcaataacttcaattgggcttttgttttcccaaagccgtagtcatcaagtcatagaaatattattttcagagtttctaagaacagtctctgatactgatgaccaggcctcaattaatccaaacatttactcaatatctgtcgcagtttctctcggaatggtgctccaaccaaatgaagaatcaattaacacatcttttaatataatgatagaagatgacattactaacgctttgttaagctgtatttcgggaaataagcttcctaaatttctttcgagccttgcatctggcccaaatcttgagcactatacagaattttctggacttgaaaggtttaagtaccaaaatgaaaatatggatgtgggaaatacttcaaaatcaaatagtagtttatcttctggtacaaacaaattctcaaactctagtaaaaattactgttctaaaattgtggactcaactttgcttgctatccctgcggcactttctctttcaatcatgcatattagaagtaaaaataaatcaatttcaagttcaatttctataccatttagtcgaccagaagaactagtaaattataggccggaggtacttattttcatgtctttagcaaaagttgtaattgaatgggaagaaagtagcattccaaacaaagatttcatttgtagtcaaatccctagttacctctggtacctcccttcggacaaaatcttcccttttccaattacttctaacaaatactcagagattgaaccacaagttaattcaaagctaatgcactgcatttctatgggaactttagattggattcactgtatccaagcacgtattgctattctctctgggattatttgggggctaggcatagtgtttgcagggaaaaggaatatcgaattaaaatatacaaccacaacaatacttgaatacttggatagaattcctttaattcaaatgcctcttagtattgcatctacaattagagataagtctatctgtagtacacatattacaattgacaggtggtcaaaggaactttgtattagagtttgtcttactagcgcatctttatgtttttcaggaagtggtgataaacaaattttgatgcaaataaaatatttcagagcgcaattattggagtctgctcagttattatggactagttcaactgctatttcaccatttagcattttttccataccaccaattgaacatgtccatagtcaattgatggcgtataacaatgctcttgggtttcttttcttgtctgccggacatttttcctttagcaataaagacaaacttggttcgacatttttaatattagcaacacacccaatatatcccaaagattcttctgatattagtactccaggaataatattccaaccattgagatatcttttcatttcagcgatgaactacggtcgaagagttgttatcccgaaacttgtaacttgctcgccggaacctttaaattatagttgcgattttagtggtattatttcagaagaaaaaatatatgtccccatctcagtcgagcttaaatcaagcaaagttcaatttcaaagtggaaagacagaatattacattcttcctacagttttaccagattgggaagacataataaatattaaagtactaggagatacttactgcccaattttaattgattttaataaagataaagatactaattgttatcaaagactaataaaaggggaactttgggttcaaactaaaaacagaaataatggttattgctggaatgaggcaaaccacatcatcaatcaagttaaaaatcaccagtttcataatgtccagatatataatttttatgataatcaattaaataataagcaaatgctctataaatattatgggccaaataataaaattcttggtgctaattcaaatgttttcagtcgatgtgacgaaataagcgatttatacaagaatttctcgcatacgctagtgctggaagaaaataagtcgttttatcgtaaaatgaataataaagaaatacataataaaaaagctggttgtgcaccatggcgtggtgctattttaaataattatatagatcaaattctttcaacttggaataagattaaccaggatgggaatggatgcgaaattctattatctcctgaaatcataaagatattgagaatcacacttaacatagataatgacaaaaaactacagacaatacttctaaatattcatcgtaggctgcaagcacaaatgagcgttctaattcgttgtgttagatactactacggcgcacacaatggaacaagaattccatcctgcgatgagaaacagtcactaaggttatttctttctctaaatggcatgccactagcttcccattttaactttattatgaaaaaaaaaattgaatcaaacgcaaagatcgatactctgcttagaaaagattataaaaaatacgaggagatcattgctcctatattaattatggaactccctacattgtcttctttagggcttcaaattctaaaagtgtttatatacgaacgctattttaaagctcaaagtgcaagctcgcaatcaatagaagctcaacaacaaataaaattaatgcttactcgtatattttcttctaaaaattacttttag

SEQ ID NO: 2484 - DNA, 1077 bp, Cryptosporidium hominis
atgaatgttttgctgttattattatatttatccttgatttactgctcctactgttcaattcaaagagcaggagtgaagcaaataaatactttaacacctcaaagcatagaacgtaaagagggaacgataattgatcaaaattctagaaacttctgccagtatacggactttcgttggtcgagctgcatttgtgataggaatattatgattggtgttcgatctttgataaaagagcagacagaaaattgctctcccgaagttacaattattgaacttccgtgtgacaaatcttcttgcaatcaaaaacttttaactacatcagatggtgttgcatgcccttcgcttgcaaatattgatggagtatgtgaccattccaaaaattttttgactgatgttatggcgaaatcatttgaaatgtgcagatcattttgctccgtaatggtaaattgtacgcactttattatggatacaaaaaactcgagatgcaaactttactctggaaataaaatatgtggtaaagaggctcctggaattacaacaggcctagctggcttcgacacaaactcatgttcagaatgtaccgttggtatatggggcggcttatcagagtgcaaaaaacccgtagactttgatcctaatctattaggatgtggagaggctgtccgcacaaggatttccaatggtgatgttgatgcagactgtccgtacaggactgagacttggacctgctcattgccagggcaaacctgcgatatgagaactgaaatatctgatatttatctaaaatctaaaccagaaaacgatgataaattagagtcttataaattattggaaatttctctgatttttgcaggaattgtcacagggattttaatttttgtaccaacttcacttatctttcctaaaattggccaatttttttatggaaaaaggttgtattctttgctgtctgggaatgagttagattcaagtcgaactcctgtagatgaaacgattaacaatccggatgactatgaagaatgggaggaggacatgaatgtggagtatgaaacggaattcacaatagataatagatag

SEQ ID NO: 2485 - DNA, 4968 bp, Cryptosporidium hominis
atggagccatattatatttgttatatcctaaaagaatatggttttgacgatgtttcaaacagagtttttgaaaagtttaaatcaatttcgaaaatccctactaaaataaattatgatggcactgaaacacaaatatcatatgaagaactaacaaatgggcttcaagatgatatttttgggtttatcaagttacttttttcatttatcgagttgtgtaaatttaataagaataatatagtaggaacagagaatttaatttttaatcaagatagttttttaaatatcattcaatatttgaagaatgaagtgattggccactcaactttcattgaaaatattaaagatatctgttctagatcaacttatctaaatttgaggagctcaaaacatggcattagtgaccaattaatgctttcgaatatgaaatattctcattttctaactaacttttgtggcaagtttattctatcaaattttatatatgctcatcagcatattgaagactctgaatttggagtaggaggagaaccagcaagcgtatatgttattaaaagagataaaacaggaagtgtattaatatctggaggcgatgatggaatgattagactctggaacacatttacgggaagtcttttagcttctgtgaggaagcacactggggatataatcgaccttgatgttaactcttgcaatgctttattagcatcttgttgtggtaagggccaactcttgttaactttggtatatggaaatgattgggttccaatggcaattattgaaaatacagacagattgacatttgttagatttgcatattcaaaacatagcattaagctgaataatgatgatatatttcaagagtctgaaatgttaatttctgcaggtgataatgcaatcataacagtttataaggtttctgatctttttatccatggatctttgtaccatttagctttaatgaaacgaagagaatttccagaagttctactaaatagtttccaaagtatatttaaacgttatggaagtttgtctcaatcatcaggttcatttgaaagagaacaatcattattttataaagcccctccagtttataagattgatatatttccactatctccaaaagcatttgatatttgcttaaatcccgtcgctaaccatgggtcttcatccgatgaaaaccttagaaactatgtctttttttcagttggtgcttctttacagtccttgagttcaacagaagaaatacaaattaatatttctggaaaaaatatttccaatgaagttatttcaatccaaaaaaaaaacgatatgcaaggatactcattagttttcatgattcctttagaaaattcccactctaagagtggaattaatttgatcaatatgccacaaaagcacaacgaacatccagatgtttcatttgcaaataattcacatgatttagttactgcttctgatgatggcacaattattatgtggatattttctaatctaagtatttataaccaaacaaatctttatacatatatttccgaccgaataaacagtgattcatattccaagaaaaagaataattcaataaaaaaagctactgaaaaatctccaattgaaagtctatcagatgatgactcagattatgtaggaagcggatcaatggatgagaattcactattacgtaggaatcccgtaagaacttcaagattcgttgtgaaagatagctcaccaaataaagaaaatgacaaatctattggaactgatagttcctcaaatttcgtccaatttatagatagtatacagtggtcatgcgatgattcgataattttaattgctcaatctgtgacatctaagggtatgttgagaaggactagaaactccacacttgtaagttgcattgaatgctgcatttcctatttttcaagaaattatggtgaaagatttctagatgtagttcttccaggcgtctgctcacgaattgcatgtctaattcctcacccagtgtcccctggaatagttttgtcgttgacatataatggagttatttttgtaatttccaactcgaaacttaaccaactaaatgattttaaatttaaaaacaattcaaatatcttattcgaacataaaaatacaaaaaatccctatttaaatggcgtttggataaaaaatgggttgagtttcgtagtttctcaaaaatacggttcttttgagatttatgatatatgcaataaaggggatttaaatcagcaagttctaactcagacatatagatattcctttcctgagcaatttttcttaaacgacttttcagaaattctaagggatgatacatttggatggatagatcagaacttaaggagaccgatatatacgatacccagatcagttatagttgacagaaataaaagaatgtatccagaggatattcaacctccgatcccaatgttttcttcacttggaaataaaacttcgaaaaatcatgcaagacatgaattacttaaaagcagaattccattatatccgcagcttgataaaactctaagcacatataaagttttaaatttaaactctgaaatatatttagaaaaggctaaaaaaagatcaatttatagaaagaaaatgcttgaaattgataaaaatgcacttaatggcagccttacaatttcaaacaactcaaatgaatttcaatctagaaatacaataagtaatattaatgaagaattgacgtgggtttcttcccaaaccaataatgatgaaacaagcagtgtagaagctcaaagttattcgagtgatttttcaaatgatgaggattttgatataaataactcgaatgctactaatacaaatagaaggctcagaatgattagtaggcgctctccgtcgatttcagatactggaagttcttcatcttccgatgattccagccttggcgaaaatgactacgattccgatttaacttcggaagattctttatataatgagattagaggttcaaaaagtattacgaggtctcgccgtaaaattaagaatagactaactaacgttcaagactccgactctgaagtcgtgccagaaattgaattcagatattacgcattttcaaatcttgatacaatttgggtaccggattcagaagagcaagaagtcaataatttattagtttgcaaactatgtaagaaatcaagcacgacagttattggctataaatatttaattaaatctgagattgagtttaatagccaaaatattaggccaattcttcatggagtaaatggatctatcgatatgggcccattaatcggaccatttgattatttttatagtacgcatagaccagaaagaaatgcaaaatttattcaagaaaatgataactttggcgaaggtagtttttacttacactcaagatgcctaattacaattccttttcttcaatgggagctcattaatgatcaagtttacacaaatttattcgatatcatgagaagagtttataatccttctcaaggaactccgcctctcccaaaagatggtttatcatcaacattttttgatacgaaaattgttaaatttccaaagcttatcggaacatgtagctactgccacgattatggcgcatctattctttgtcagggcaatagatgcaatcgtcaatttcattatcattgcacagcgctagcatatcattcttttccagaatcagtaaattcaagttttatatctcctcgcgagtcgaacatgtattggtgtgatattatgcaattttacttattttattgccctaaatgcattcatctcaagcaatcaaatgttccatattgtccaaagagagaaaatatgataaataatactgggcacaatcattgtaatagatcttggctattagcggatgaagtttcagcaggatatgtacctcaagtaaatgactacctgtattttttcccaaatgcttatatttgctcaggacttgatgatatattctttaaaaatatgatgttagaaattgctactgaaaataaaaagctatccagaaggtcaaataggaaatttgaattcataaagtgcaaattaattaatatttcctatgcatttccaagtgatacagaacattctattaaggctatactaacgtttttaacggaattgacttcaggaaaacatgtttattggcaaataagatgcgctccgaatgatggacctgattacttggttttagaagatgaggttgaaaagggaatacataatttagaacacagactaagggttggacaagaaaatcatatatttattgataatcaatggcacgaaatattgataaaaaatattaagcaaaattttatttgggaatccattgaagtcacttggaagcaggaagaaagtaacaataactctttaatggtcagtccatgggaaatttatgaaactgtacctgacaaaaagtctctcccaaacaatttggaggcgagcaatgacctaataaaaattttttgttggatgacaactcaaaatgggccaaataatccattgtcagtaattgaattctttaaatatccaattccctttttttcaaaaaaaaatatatcaaaaaatgaattttcaaatcaggaatgggtaatgcactattggaaagaaattcctcttccatttagtttcacttcaataataaatagaattcgaaataattattacagaaggttagagagtttagtatttgatatatttttagtgaggtcaaattgcgagcacttcaatcttaataataataatttggttcaaggtattcgttcgattgaatatgaactactcagattaatcttcagtaaaagattaccgagatatattattcaaacaaatacaaatatcctactccaagaaattggccttgaagatagaataaaagttattgattctagtaatatcgattctgatgaagaaataattaataggataggaaaaagaacgcgtagaagactataa

SEQ ID NO: 2486 - DNA, 909 bp, Cryptosporidium hominis
atgagtggtgcaaggagctcgatattcattgcttgcatactttatttcatttctttggtttcagcaaatggagtttgcattcttaaaaaaggagctagttgtttgaatgcttcgtactcattcattgaaggtggcatgacaccaggcgatgctatccgtgtatctgtcgttcttttaccatctgcatcgttagaattgacaaattcttcattccagaatattgcaacattaagatttggtgtggactcatgttccattgaaagtggtatagcttcattaagagcatattcactttacaagaatggtcaatacaatacgggatctaccatttcgtttgatttggttgctttagaaaaatcacttgcaattttcattgctggaagtaaagttttagaaatcccactattggtcgctgctccgtttatgttgacatcagacagtaatggaagtgctccaacattacagtttttggagtattcaacaactgaaactggattctgctcaattgcttcatcaggttcatgtaataactctagtttagtaggtatgtctaatggagttacaaaaaatcttactattagagccgaattgccatcaagcattccagatgattacttcagcttctacatctctacatacagcaatatttacaaacttccagttctcgaagttgcatttacaaagcaagaatggctcgcaacatcatctggatcctttgtaggtagagggaaaattccagccggtattaatttgggcagttctattaattttgttcttgtgccaagttcaggcggatcagtggaactcaaggtaaatgaaaaatctttgggtgttgttaaggtcgatgcaagctcaatcaaattcatctatcagtctgttagccaaggaactatgaatgtctcctactaa

SEQ ID NO: 2487 - DNA, 1800 bp, Cryptosporidium hominis
atggaggagaaaccaaaatgtaatcgttggttcttgcttttattgtactttttaatctcgttttctgtatgtggtttagtaggttcatttactgctattttaccgctgcttaggaaagcttgtatgttttcaaatctatgcagatgtgacccaagtacaaaaaactaccgaggcgatgactgtttgaatccagaattaaagaacttaatattattggaaccacttttgagtcatgaatgtgaccctataggttgtaatctacaaaacgttttacatgttgatgcctggaagtttggtttaagtgctcctctaattgctagccccattgcagggacaattgcagatatcattggcccaagagccttgggtaccattggaactatattcgtatgttgtggattattgatttggctactacttactaacatttttgaagttttgtggattgcaaagtatttacttagtttgagctggctttttttgggaatcggaagagtttgtatttcatacagtattgtttctgtttcgtcactgtttgagatgcagtctctggtaatttccattttgggtggccttgttgatgcatctattttattaccattgttaatagttaactttcaatcaggtttgaagaaatcaactcaatttgtagaaagctattctgatacaaacaaacaaactggagaaaggttatttatttatatttatgtaattctctcagtgctttcactaatatctcttttcctaacattgccttctgtaacattcaacaagcttattcataaaaagaagcttagcaaaattaaacagttcattacttgccaagaagaaatggcaaatggaaatcaagtaagaaaagactttggagagctagagaaatccactactgaagaggacatactaattacatgcccaaaaaccgtacagttaagagcaagatctgaagttacaaatgttaagataaaaattaaatgttgtagttcagaaggagttgagtgcgaatcttcagcaatgtgcaaccttaaagcctcttctgcaatcatgggtggttacagtgtagtctgctcattagcaaaatgcagatatatgctgaaaatagacaagattagaagtttttcaactccttcaaatatcttcaatgtttttgaccctaatgctaaaaatggcttaaatacaattattgatagaccaatatttgagcaactatttagttatgagtacttcacatttatggctttatttatatacaacttttggagatgctcaattctagtttcaaaaagtgaatacattgttacatctgtattgtatatcaacaagagtgttgggatagaacaggaaatgcttcaaatcatgaatatttataacattattatgagcttaggaagtatcttcagcgtaatttggggtattattgcaactaaatatggtgtcaattttatgattggtttgaccgctatcttaggatgtttaatacatgttttgcttatattcatcgattcactaccattttgctgcatttatttatatttttgcgcattttctgctctgagatcattcatctttggttcattaaattgcttcattggcgatacatttggattttcaaattttgcgagattagcgggaatacaagcctttacatgttttattttttttcagattatgaattttttaacttcgcaatactttgaagtaatttcctggacaaaagttaatcaatacttgctgattcctaatatttttttattatctgttccatttattttgaatcttttaaaagctaagagaaataattga

SEQ ID NO: 2488 - DNA, 858 bp, Cryptosporidium hominis
atggaaaaaaaatcattcaaaatagtggctaattcacttatttctggtggaattgctggactttttgttgaaacaatattatatccagtggatgcgataaaaacgaagatgcaatatagatcgttatgcaaaaatagtgtgttattttttagtactagaaactactataggtacttatactcaggattcaagtattcggcatttggttcttttgtttcttcctccattttttttggcacattccatcttttaagtaattgttcaccacaaatgaaatttaaatctctaaaaacaatgcaaatttcattgataagtgaattgttatcatcactgtttagagctccctttgaagtgatcaaacagaatatacaagttagaaacaaattatttttgggacactttaacactaattattcattatttaggtattgccttaattttaataaaataactgctaacctaatcagagacattcccttttccattatccagttctctctttgggagaagctgaacagaacaggagatggagtcttaggtgaaaaatgcaactttaaagatctattcagcggagtctttggaggtataagcggtgctatagcagcattaattacttcgccagcggacaatataagaacatatatttttactaaagcaaagacaagaaattcaaatgtctcgattctaagtgcaataaaaacgatttacggacttaatggaataaaatcattctatataggatcgtttctacgtgctttatggcttaccataggtggaataatatattttggttgctaccaactttgcaattctgcattggaaaaaatgtaccgcagttttgaaacattacctcaatga

SEQ ID NO: 2489 - DNA, 507 bp, Cryptosporidium hominis
atgaattatccaaagataaaattaaacgaacaatggcaactgctaaggctatatggcgtgctaaatagccctcaactagtccttatctatccagtttacacaattcagcttaagtcaatgtgcttaccttatttcgaaagctatttagaaaatagtaatagcattgaaagtgcacattcaacaacttcaagttcaaggataagcagaggaataatttataatttaagcggaataaaacttatttttgattctctgaggtgtatttataatgaagaaggatattggggattgtatagaggtttcatacctatgactttacactcatattttacacgaatattacatgatcaacttttaaaagtatataaaagacatagtaaaattcacgattcatttataaaaccagtatatgtaaagagcagcgcaaagtatatctctgaaataatcacataccctttgcttgtaatttctacacaacaggcaatttttgacgttaaagcgctataa

SEQ ID NO: 2490 - DNA, 2109 bp, Cryptosporidium hominis
atggacttaattcgacttaactgccgtaaaacattactaagttttcttgaacttgtatcagaaaaagacaatgagaatcgattagcacctcagattttcattgaaacatcaatttcttcttttctgagcttaattactgatattgtagactataataattttggtttcaaaagaattcaacctttaatagtttcagaggatgttgaggaaagattggaatcaattatttgtgattttgaattcgattcaaatgtgagatcaaatttcatatataaattaaaatgtgtatttctatgtcatccatcattaagttctacctgtaccatcgttaaacacatagagttaatttcagcattattaaaaaaaaatataaccaagcaaaaaattgatgtttgtttttatattggttttgttcctttttattctaaggtaatattacggcttcttcatcaacagctagcttcactaaaagttactccagaatgctattcagttaatttattttgggctcctatagatgaaacctctctttcaatggaatttaggaatattttcttcgatttccacgtatataaagaagagtcttctttacaattggttgctcattcgttatattggttgttaaagtttacaaactcgacgaatgtaccgatttattcaataggatctgcaggagtatcagtcttagagcacctgatacgatgttttaaagaaaatagctccctatccaatgttcttaaaccttttgattggaacacactttttgaaacaaatgatgatcggaattacaaatatccggaattcaaacgctctgacaaggacttattaacaaatactctggaatttactcagtattatcttcaaaactctaatattaaaaattttccggaagatgatttgacgaatgaatttccgatgggttttgatcaggtaataataattgacagaagatgcgatttggtaactccattttcaactccattttcctaccacgctctgcttgactttctttttggcgttcaaaaaacttatgttgatataccaacaaagaaagtagcatccgacgtttatgaagaatctcctcattggaaactacctcttttcggagacccactattcgcaatattgaaggatctaaaacttaaagatgtgggaatttatctccaccaaaaagcgaacgagcttcaatcattataccaagaaaaggaaaagcttaaggatatatctgcgattggggattttattaggaaattaaaaggtaaacagcgtgagcaaggaacacttgctaaacatgtcaatattgctacatatttaaatgaatacttcacaaaagattgccagactttgagaagactaaggctggaagattcaataatgtcggattctcatcaatcagtaacaggtgttgtcaaggaactaagcacgaagttttcagaagcaatctcatttagaggggcggaggactcgcctctagaggatcttctagatcaggaagatatccaaatagaggaaatatatagattactatgcctttcttgcataattgaaaatgggttcaaaaataaaaaagtttatgagcaaatcaaaaaacacatattatcagttttcggttttgaagagttatatagaatgaatattttggaaagagttggacttttcaagtttgatccaaataaaaaatcgtactggcaactaataaagcgtctcctcaatcttttcgttgatgaaagtgagtcagaaaatgatataagttgtgtttatagtggatatgccccgataagtacaaggcttatagaaatcctatgcagagagatgaataactccaaatcaggtggttatgattctctaaaagaagcgctcaactatgtatggggtcctagtgttgagctaatcccatcgatgcaatctatgataaaacacaattcgtgtttggttgtttttgttggaggagtaacgcttggtgaaattgcaactcttagaaagctccaagaaatcattaataaggagatcattgttgcaactacagaagttattaaccacaaatcattctttgaatcatgcaaaaaaccagaaagtatgagccaccttagaaatgaaaatagtaaataa

SEQ ID NO: 2491 - DNA, 1077 bp, Cryptosporidium hominis
atggtaaagatgacccttccaagttcattttgggatactgtttatgaagtaaagagctcaaataaaaatatcgagaatttagaaactcaaaaaatcttttcaggaagaaattctgaattattaaacctagattcaacaagagatgaccatgctcaatactttcaacagaatactctattggatggagaacttgtaaaagatactattgaggttgatgggcaaaagagatatattcttagatacttaatttatgattgtatttgcattgaaagagacgatagtgttaaatccctacctttgttagaacggctcaagcttgcatatctaaaggttgtcatcccaaaatgcaaatatgaccaaaataggtctacaatatcaatggatccaactccatttgagctatatcttaaggacttctttgaagtcgacgaggttccagcaatattgaacttttcaaggcgtttgccgcatcccagtgatggaatcattttcaccccagtccacctgccatatgttcctggaacgtgccctcagctacttaaatggaaaccccctcacttgaatacagcagattttgcagcaatattttatgcagaatcagaatcatatgactctcgtgtatttctcgagcttttggttgggatccgtggcgttagagcaagtgtgaattgcttttgtgtaccaaaaggaagtgtatacaatcaattagtagatcaattcaaattatatagaacctctggtcaaatattggagtgctactacgatgagaatgtcatttattctaaacctactaagtccgaagatgggaacatcttatggaataagccatttaccacagttcaaggtgggtggatagttgaaagaattagatctgacaagaactccccgaatgatattaatacagtaaaccgtgtatttgaatctattagagatgggatcaacagtgaggtattaataaatactataaaactataccagaaaagtgggaaaaagtctgttgttgagtactgcaatgtccctgagtttgttacaaattgtagaaaaggtcaaatcgaagacaaaagaagtgaaatatag

SEQ ID NO: 2492 - DNA, 1086 bp, Cryptosporidium hominis
atgtcaccaattaaagtgttaatggtggccgaaaagccatcaatttcggatactatttcaaggatactttcaaacggaaagttagatacacgacgtggaaaaactcctgtacatgagtttaatggaacttttatgggaatgaatgttcaatttagagtaacttcagttgcaggccatgtttttgaaatagactttcctcaaagttattctaactgggaaaaaacagacccagtttctctgtttgatgcaccaataataaaaaatgaatcttcatccaaaatggtttcgcatttagaaaaagaatctaagggctgtagttatttagtactttggctcgactgcgatagagaaggggaaaatatatgtttcgaggtaattaatgttgtatcaaataacatgagcaaaggaaaagatcagaaggattggattttcagagcaaagttttcttcaatttctcctggcgatattttttttgcaatgaaaaatctggcattcccaaataaaaatgaatcggatgccgtagatgtaagacaagagttagacctaaaaataggagttgctttttcaagattgcaaacaaagtatttaaagagcaagtttggagattttaataaaagctcagtaatttcctatggcccttgtcaaactccgacccttttttttactgtccaaagaaaggactctataaatagctttataccagaaaaatattatacgatttctgctactttatctaaagactctcaagatataaatcttatctggaatcgttcaagggtatttgaacttcaggtcgcaaattgctttcttcaattaattcaaaataagaagccattatcagcaagggttgttgatatcacaagcaagaactccagaagaattagaccactacctttaaatactgttagtatgctcaaactgtcatcaacaatacttggaattgggccatttcaaacactaaacattgcagaaaaactttatctttctggttttactacatatcctagaacagaaacgtcgagatatccaaagaatttcgatattaaatctacaatagcggtaagttattatgtgcatagcgattaa

SEQ ID NO: 2493 - DNA, 339 bp, Cryptosporidium hominis
atgatggaaaccaaaaatgaatcgaatataatattaatttatatttcggcaccaaaccaagatgaagctaccttaattgccaaaactcttgtagatgaagaactttgtgcatgcgtaagcattattccaagtgtgagaagcatatacaaattcaaaggtcaagttcatgatgaaaacgaagtcatgttattggtaaagacaacttctcaattgtttactactctaaaagaaaaggttacagagattcactcatatgagataccagaaattatcgctactaaagtcatatatggcaatgaaaattatattaattgggtaaatcagacagttagaagctaa

SEQ ID NO: 2494 - DNA, 810 bp, Cryptosporidium hominis
atgaaaagtattattgacaaaaatataaatacaaatgtcaatatacgaagtcttaagacaaaagttttggaatgtaaaggaaagctattgaaaagcgaattttggggtactatagttgaacatctagagactgaaatctttgaaaattggataaaaggaaggaaatgctcgagctccagatgcattttgagaggtaggtgtatttgttacaatgatgtcttttttgttattggtctaggaagtttagagtctacaattcattctaatctttcctcatttttccagcttgcagcagttgttgctttaaatgaacgaataaatttagaaggaatttatttttgcgatcccgaattcactcaagctgatagagaactcatttttgaattatttatggaatttaaaactcatattgaggttttcacatcacatgatttaagtatacctttaaatacagttaaccaccaattaaaaaataaattgtatggtagggacagtcaaattaatatattattctttatgccacattgcgatcgctgcgtttttgggatgataataaattactttaataacggtgaagggaaaacactatattcagattcagctcgaatgattgtatggggaaataatttagaaaccttcaaaattgattctaacgagaattttaataaaagatgtgaatattgcaaagttttatcaacctctctttcaaagatgaattttagtaaaattaattttccagtgaatgattacaaaaccatattctgtagttcttttagcgatctctcaatttatcatcttcccgttagctaa

SEQ ID NO: 2495 - DNA, 561 bp, Cryptosporidium hominis
atggaagttgtcgcgcgtaagaaattttggcgatcgttggagtttattaggacagacaaatatttatataaaatgaaacccgatataaaggttgatgacacaatagagcaggctcgtcaaaaacttagagataggtttggtgtgggaactactcaagttggtggtaaaggcactgcaagaagaaagaagagagcacaaaagccaactggtgtagacgtaaaaaagctccaggctgtaacttctcgttttagatgccaaactttccctgctattggtgaagtaacaatgatgaagaaggatggtacttgtcttcactttttgaaccctaaattacaggcatctgttgctacaaatacatacatccttacaggtaacccacaggagaagctcattaaagacttacctcagcaaataaatccaatggatttgagtgcgtttttgaacgatcccaaattccagaagcttttagaggaatctcaggcaaacaaactgaagatggaatccggcgaggatgacgacatcccagacttggttgaaaatttcgaagatgttgaagagtaa

SEQ ID NO: 2496 - DNA, 792 bp, Cryptosporidium hominis
atggaagaaaagaaaactgttaaaaataaagtgagaatagttgaaggcgagaaaaaggttacttcaaatgcgaagcttagattagtctatgacgcgctatctgttatatatttttcagtattatggatgatgatgtttttggattgtggaccaaactacttcagttttttttattatttaacaaattggggatgcacttcaactttaatattttattttatagcaacattagtagattatgaacgtttagtgaaagtaaatgtctctacaaggctaatacattcctgtacatttgtaagagaattaagcatttcattacagagcgtaattgttccatttttctggataatagtttatcctaaagagaaatggaggtcaattacttgggaggtgcaaatgcatggaatgggactcatatttatttgcattgactacctcattcgtacttcaaacttttcgtccctttcatccaagaatttgttcatggttgttctttcatatttaaccctaaattattttgttgtgaataagctagaaacaatgatctaccctggaataacatataacacggttgagtcatggatagtcgtaactcttgctattgcactagttcttatagctcaccaattggcatctattataacaatttgtttggtggtgaagaataagatctggagaaagtatgaaaaagatgactttgtaagcaaaagtataaaaattgttcaaaaagcacagaaattgaggcataaagatggggtaagaaaaaggttgggatcaatttttgtaggttag

SEQ ID NO: 2497 - DNA, 2706 bp, Cryptosporidium hominis
atgggagatagtgtatttactcgtgataactacaactttgagatgaggagaaaagcctcattctcaaagttgacaggggctgttccaagaggtatgacaggaatgtacttggacgattttgatccaactgcagacaaaagaagagagaaattatggtacttaatggaaagctacctgccgacagatattgagtccattcagagatcaatagttaatcatgttgaatacacacttgcaagaactagattcaatttcgatgacaatgccgcttatagagcaactgcttatagtataagggatcgtctaatcgaaaacttgaatgatacaaatgagtactttaatgaaagagattgcaaacgttgctattacttgagtctggaatttttgctcggaagagccatgcaaaacgctctcgttaacttggacattgaagaaaattacagaaaatctctgtttgacttagggtataatcttgaagcactgtatgacaatgaacatgatgctgcccttggaaatggaggattaggaagactcgcggcttgttttttggattcacttgctacaaagaattatgccggatggggatatggcattagatatacttatggtatttttgagcaaaaaatcgttcaaggccgacagtttgaacacccagattactggcttgtgcagtctaatccatgggaaattgaacgtcaggatgtaacatatggtgttcgattttatggtcacgtacgtgaatttgaagagcatgggagaaagaagttcagatgggttgatggcgaagtaattcaggcagttgcatatgataatccaattccaggttttgacacctacaattgtattaacttacgtctttggaaggcaactccttcaagagagttcgacttcaatgcttttaatgaaggcaagtatgttgatgccgtttgcgccagacaaagagcagagtacattacttcggtattatacccaaatgataacactgaacaaggaaaagagctaagactcaaacaacaatacttctttgtatgcgcaacgattcaagatattttgagaagattcaagaaatcaggaaaggtagattggagcgaactacctaaaaaagtctcatgccaactcaatgacactcatccgactatcgctgtagcagaaatgatgcgtattttgatagatgttgaagagctagattgggattttgcctggaatattactagtgagtgctttaattatacaaatcatactgttttaccagaggccttagaaaagtggagctcaagcttgtttagcaaactactccccagacatttgatgataatcaacgaaatcaattatagatttttgaacgatgtaagagctgtcttgggagatgggccatggatttcaaaaatgtctatttatgaagaggggtgggacaagaaaataagaatggcaaacttagcagttattggatgcaggaaagtcaatggtgttgcagttattcatagtgaaatagttaaaaaggatttgttttcagatttcgtcgaatattacagacgcaaaggaatcaaggacaagtttatcaatgttacaaatggtgttactccaagaagatgggtaaactgcgcaaatccaaagctttctcatttaatttccaactggttaggatccgatagctggctaactaacttcgatatgattagaagtttacaaaacaatattgatgatttatctcttcagaaagaatgggcagaggtaaaactgagtaataaggagagacttgctaagtgggttgaaatcaatacaggatacaaagtaagcacaagtatgctttttgatatacaagtcaaaagaatccatgaatataaacgacaactacttaacttgttctacattattcacagatatcttacattaaagcatatctcacctgaagaaagaaagaaatttgtaccaaggtgctgtttctttggaggaaaggctgcacctgggtatgctacggctaaaactgcaataaaaatgatgaataacctatcagtaataatcaacaatgacccagatacaaaagattacttaatgtgcgtcttcttgccaaactacaatgtcagtaatgcccaaattattattccggcatctgatatctcacaacatatttcaacagctggtactgaagcttctggaacaagtaatatgaagtttgtaatgaacggcggattgatcattggtactcttgatggtgccaacgttgaaattcgtgaagaatgcggaaacgaaacaatgttcatttttggtgctttagaacaagaggttgaacatattagaaatagagctagagaaggaaactacccaattgatcagaggttacatgatgtattcaactttattagaacaggagggatcatgcttggcgacggaaaggctcaaggagaattctgcgaaattgtgaataaaatctgttctaacggtgatggccaaattggcgacttctacttggtatgccatgatttcccactttactgtgacgcacaaatgagagttgatcaagcatacagagaccaaaccacatgggttaagacttgcatcaaggctgcctcatctatgggaaaattctcgactgatagaacaatcgaagaatatgctaccgcaatttgggagcttgaacagtgcgagagacctgcgccagaagcatgcaaaaaattatctgggtattcacctaataaatcaaagtaa

SEQ ID NO: 2498 - DNA, 480 bp, Cryptosporidium hominis
atgcctcattcatttggtaagagagcaagaactcgctcaaagttctccaagggattcagacagaagggtgttcccatgttatcaagatatttgagacccattaaggttggagattatgttgatattgttgtcgattcctctattcataaaggtatgccataccatttctaccatggccgcaccggtgttgtatacaacgtagctcctagagccttgggcgtcattgttaacaaggttgttggtaaccgtcaaattgccaagagaattaatgtaagaatcgagcacgtaagacttagccgttgcaatgaagatttccttaagagagtcaaagctaatgatgctgcaaggcacgaggcccacgttgcaggtttaccatcacctgtaacaaagcgtgttccacaattaccaagagaaggtggatttgtcgactgttcaaatatggaagtactcactcctcacattactgtctctatttgctaa

SEQ ID NO: 2499 - DNA, 1968 bp, Cryptosporidium hominis
atgaatcgtttttcatggaaatacaaaagagaaaatcatttgattgacaaaagtaatggaatattgagcagaatgttgtggtcaagatatattttttgttgcttattattttttatttggtatatttgcacatggtttgtgggtgctcatcttcttagaatagaaacaaaggaagggatttataaaaaatcagcatttatcaaagaattatcttccgtaggggagttaagggaaatagttttaaatgatttatatgaaccaaaagtaattattttttactcttcattctgtgcgtactgccatatggcttcaaatcctttaaaaaaagttgctgaatctttgactcctacaggcgtaaaattctatgcatttgaatgtgggaaaggatatagtgaatgctcaatttggggaatagatggacttccaaacctaaggctaattggtcctgaggataaaaaaataaatttagagtcattaattaattatacagagtttagcgatataaactgcacaagaaaatcagaaaagcatattgtatttccagaaaagcatattccaaagttgatggaagtgccttatttgaagcatttaaaaagtaagtcaatttctatgccagtaataaatgaagaaacatttttaatgtgttcaattatccgagcttttgacttatcaaacgtattcaagccattaaataactctgtactgtcaacttcagcaatatcacaaacaaaagcagggacttcaaatcactttggtagatggagcgaagaatcaatgcaaattagcccttcccatgcaatagttgatgcaattacgaccaaattctatattttacataattgggtcttttttggaaacaatgtagtaaatacttcgcaatttctggaaaagagacgtttaaatgccttatatagatttgttgaaactagttgggtgcttattccaagcaaaagaacgagagtaaaacttgaagaaatattggtatttctcaaaaattatatggacaacagggataattcgatttattccaaactttctttggaaagttggcaaagctttataaaaacagttgttgttgaaggtataagtactacacaaaatggtagtgatcctacattttatatatgcaaaaagtctttattctgcggaatttggcttcttttccactcttggtctatatcattacttaaaggcgttcaacaacaaggaaaaggctgccctctatataatgggccttcactaacgcctgggcaagtcgtaaatagaatagctgaaacggtcaaatatttcatggtgtgccaaagctgtaaagaacattttgaaacaatgattaataataatacatgtgatagaacttcctatattcctcccatgaataacgataaattcccagttttgctttatgaagctgagggtctggttttttggctgttcagagttcataatctagtaactctaagagttgcaactgaaagtagttatgaacatttaaaacaaaaaagatcgtcatccatttcttacgttggaactggagtatcattccctccgataggatcttgttttgactgctatcgtccaaaccagactccagcagaagtaacgaatcagatgttgagtagtataaacgatcttactgatgatgactatgataaagacatttttgagcaaggaccagtagttgcatttttagaagcttattattggaaagaaggctggatattaccaaaaactactctcgatctacagaaatcagaattagcatcagcttattcttttcctaactcaaatcaaattgacccctttgattcacttaattctttcaagaggtctgctgaaatacaagttgggtcagtatttgatatattccctgttctatacccaatccttacattcttcattttctcactaacggtcttttatttagttgagactggacctttcttgcaagaacaaaaattagccatttag

SEQ ID NO: 2500 - DNA, 987 bp, Cryptosporidium hominis
atggatgctaaaaatcaggtacagaagagttcttcttcttcgtgcgatcaagaagatacgtcaccacaaaataataccataaatagtcaaaatcaatgcgatcaacaaacttcaactcagaataatgtagataaagatttgagccttgaagacattttatatgaaactaatcagcaggcaatctcttacaatcgaacaaactatggcttgctaggaatactcaacgtaataagaatgaccgattcggatttgaatattctggctctgggaactgatttgactacgctagggctcaatttgaattcatctgaatgtctatatcttaattttgactctccctggagttctagcaaaccagctcagcctgaatctgaaacaaacgaaataattcaggcattcgcaagcactcctaataatgtttcacaaatcattgggttgaagtcaacgtatgtccagaaatttaccctagaaaccttgttttacatattttataatatgccacaggatttgcttcaaggatttgctgctgtagaactgtgtaatagaggatggttatactatcctgattcattacaatggtattcaaaggttcaaaatgaagaaaagcagacaactgagtggcaagtttttgataccgataaatggtgcaaaatccctatatctgaccctccatcaagcaatttactttcgatagatgagattcgtccaagcgtggaggaaggagtcagaatccactctaaatggatacaagagcaaaaccaaatttatcaaattgttcaacaacaaatgcaacaacaatcgaatagtcgtaacaagggttccgaaccacaaattaattctaatatgaataatatcagtgattttagttcagcatataatcaaagaagtattcaacaaactttttcccaggctgggaacaaccaggcaattaattcaaacaattattctaattttagatcgtccaataggcataattcaagcttttaa

SEQ ID NO: 2501 - DNA, 2394 bp, Cryptosporidium hominis
atggaactttgtgacgactcatctgtattgtttaagatattatttgaaagatgctttcaagagtatctcttactatgttgtgacccaactgaatctgcagcaaacgctataaatctcgcgaatgaactagctcgtaaatgttccactaaagacgaaaagcagcttctaatattcgatttggagggattatatatgatgattgagaaatataatttgtgtgaccgtattttaggaagctacagacgtcttagaaatattaagaattgtattaatgatcttaaagaaattaattattcccttgaacaatgtaaacaagttttggctaaacataatatgagcgtcattgatatagtagggatttactctgattattatattcttaataagctgtttctcattgaagaaggtgatgatttcgagatcaaaattgatattgctcacttaaagatgtttacggattggattgaattgatgagtcgtgaatgttttgaactaacaattttaaagaatggtataaataacgaaccaatttctaatataattagtttagcccagtcaaatgtaatagagatgatcaggaacaatttcaatgtcacctctgaagttactcaacattctgatgaaaaagtaggtaacagaatcataaaaccctttcaaataagatttatcttagtgttgctacaaggaaatatacttgaacatggatttggaggattttctgctcttagaagtactctgaatctgatttccttgttccacaacaatattcaagaagttttaaaaaattggtttattaaacttccattagaatatttagagcaggcagtctctacgcttcagcaaatgataagtgtccgattttatgaactatatgacgatcataattatgaaaaccttgatattatcagattccccttcaggaatattgcatcaagttccattaaatctcttaaacctgcttttctcaatgatttaagaatctcaagtaatttgcttagaatattgtttgatgcaaataaagaaagaggaataattactataaattttgatttttctaataataatagattagatatctcgcttttcacaaatgaagcaattaattctgccaaagctttattacaatatgaactcaggcaatggtttttatccaacccaccttcaaacgatactgaatttggtttattaaaaaatgcttatcttcttgagccatctattaaagcgcaagcacttcaacaagactccttaatgcaacaaagactagaacttcaatcatcaatttcccaagcacttggatctgttgaatccctttttaatcccactcaggcacttatccagccatttcttgtactaaaagtccatagggactcaattgtaaatgactcaatggagcaattagtaattcaaagtaacttgaaaaaacaacttaaagtcagctttgttggggaagagggggttgacgaaggtggagttcaaaaagaattcttccaattattggttcaagaaatttttaacattgactttggtatgtttatttactatgaagatacccgattattttggtttaacatggcatcacttgaatcaaatggagaatttgaattaataggaattgtcttggcattagcaatttacaatggaattattttggatgtacattttcctcttgctgtatacaaaaagctacttgggtacaaagttgatatcggcgatttatatgaaatacaacctgaagtcgctaactcgctactgtcactattatcaataaaatctgattctgaaatggaacagctttgccttactttttctgcaactattaataattttggagttatggctgaagttcctattgctcctgaggaatttgatccctcagaacctgttacaatttgtaatgtccatagatatgttgaactttatttagattggtttttaaacaagtccattgaaagtcaattcagagcattctacaacggcttccaaagtgtatgcggaggaaggactttagaattattttctccagaagaactagtgttagttatctgtggaagctctgattttaatattgattctttaattgaagcatcgcagtaccaagatggttatactaaagatagtacaaccgtagttatgttttgggaaatagtcaaaaagctagacttgaagctacaaaaaaaacttcttttctttgtgactggttcagatagagtacctatgaagggtctgggcgaattgggttttgttatcggccgtcatggcccagactctgatttacttcctactgcgcacacatgtttcaatttcctattaataccagattaccagaacaaggaaaagctggaaaggctattacttattgcgcttgaacattctaaaggatttgggctaaaataa

SEQ ID NO: 2502 - DNA, 4455 bp, Cryptosporidium hominis
atgccagagaggttcaaagccattaaaatcaatacaatatgggcaattcttcgcgtacagtttttagtattattactttttcttaacaatttagcttgtgaaaatgaaatcttggatgaatcggaaagaaatgcagctcttataaacagttcttcacatacaaatccggattcaattcaaaataaagtagcaaacccaatgaatgaaattactctcctttcaagttcaggagaaatttcaagctttaatgcctttgagctaaatgttcaagatcaatgtaatcaactttggacatataggaataagctggtgcatgaagtttcaaatgtagttaaattgcataaacagtttgtaatttttctaaataagatcgatcctaaaaaaaatacggtttatttggaagagatattcaagaaatctttggatctttctttagccgacaatcgtaaagaagaaatcaacaaaaaatttaaagaatatcttggattggcagtagattacaggttcatctcttcagataaagatgaatcaacagtaaaaatacttatttccaacagatcccctttaaaatcttcactaaaagatcttcttattttaaaaaatgaatatttaaagtatattagtaattttgatatttgcgttaaaaaaaaaaaaaaagtgataaaaagtggatcggactctctaaatgcgttgataaacctttctaaacttttgaatatttctgaaaacacattatatgatgaaaacattggctatcttgaacaaatttcctcaattacaaacaatcttgattctaatcttagttttattaaaacgttaaaaaaacttcaagaagtttgcgataaaggtcttactcaggacgatcaatcaaataaaaaaagtaagattaaatggttaaaaaaaaattctaataaaattaacaaaactatgaatagttttgaagatatttttaagatgaattcaaaaaaagtccataatttgttaaattgtattaaccactttcaaacctcgaactcaattaatgataacactctagcaatggttaatacaataggaaaccagattgtaaatcactctataaatagaagaaatatcttatcaattatctcatctaggtatacaattacaacattaaatacttatatactgaacaataggttattttctttatggttatttgttcaaaaaagattaacaaccattcaaatcgcaattaaaattatgaaagaatccaaagaattaactaatcgtatgaattctgttgtttctatggacgaagcaattgatttactaacaaagtgttccgaaactttaagaaaaactgcatcagattggaatgtttttttttctgataaaaatacactaatcattaaaaaactacacaaagaaacacttgaacagttaaaccattataaatttgaaggtgatcgaaatacacttgcaatgtatatggaatggatttggctaaatgatcatattcaaagtgttattgaacaaggatatgatgcattcgagggaattattaaagccactttgaaaagtccgcttacaaattgtgcaaaaaatttaagctcactatataagaacctcaaatcggaatttagtgctaaggaaaattttagtgagaaaactagaaaaaaaatcaacaaagaatatagaaatgtattaaatgatgtttcaggtcatttattaaagcaaatagattctcttttctctctaaaacactcatttttgtggccgcataataatgcgactttaatttcagcaatatcaatgtataatcgaacttcggagtttgtaagctcaataaacttgcctcaagaacaaaattcattcgaaaagccaaactattcttatgagctgttaaaacaacaacaaataattactaatggattttctacattatatgaaaatattaaaactagatttaattgggatttaagcctattccaaactgaatttggatatgtgaaaaatattaaccttggattagatacagaagaaaccattaatttttctaagctaaaggtttatcaagactcttctgagcaatttggagaatggtttgaaagcacgcttgagtttttgaatttgaaagaaaatttctcaaaagcaaagaatattcttgagcaagcaattcaattcagattacaatttatacaacagtggtccgatataattgcaaaaattataaataaagtagggaatccaacagcattaagtattagtaaaatatctgaagaagcctacacatactatttaaaatatcaagtttcaaaatcaaaggagttttcgaattattttgagagtgatttatctattctgaagtacgtagatgctgtggataattcactatctgatttaaacagagaaagttttgtctcaagatttgaaactacaaatgcgcccaatttagatggttcttatcatggtgatgatgaatttccatctgtatcatctattaaaagttacttaacggatttaaaaaatagagttgatcattattgcagttatgaacaaaaaagaaacaaaaatgatgaggattacctctcaattgtcagacagatttgtgataaattttccatcattttttctactattaatcaaaatttaaaaggagtagattcaaaattgcaaatggtttattcagatttagaatctcagaaagaagatatctcgaaacttgatacaattattcaagattgcatttccttagataataaagtaggtagagttaaatgctggattccaaatcaatctattgaattaccactgagaagggcacttcaaataaggaaggtaatgaataattggttaagagaaactattaaaacaaaattacttgtattttcgaattttattgaagattgcttgaagttgaactttaagggatccttgattttccaaagcattgaatcaaataaagttgagcaaactcagattgaaagaattaattctttccaattgttattaaagttaataaatgatttaaagccaaatattgtcgaggaattaaatacattagagactatttatttgaagtactatcagaataagataaatgaaataacatctgcatcaaagttacttttatttaattatttgaaacttaactccacgaaaactactctaatacataattatggaaaggctaatttgtttcaaaagattttcagatttcctaagcttttactatccaaagatgaggttcataacatagaaagttctacattcgcatttgacagtcctgtaaataataacgcaacttatgcagcagatttaactgattacattaaaaataatcagctatcttcaaataatcacactattttgttaggaaaatatcttaaagcactttcaacattaaaaaatagaattgaggatattccgcaaataaatgataataattcatcattattaaatgaaaatctaaagtctgaaattgaatttgagaaatatagaaacatcgaggagaagtcattattaattctcggcgagtcagataaatatctcaagcttgcaaatatcgagcattttagattctacactattcggaatataacgggcaatataactgatgtaatttcaaaactttcggaggaaattaaattaaaagaagaagaactagaaaaaagagaagaagaaattgcaaatactaattgttacagacggtggaaatggaagaaaagggttaagaggcgaaaaatgaaaaaaattaaagatgaaaaaatagataaaatgatcaaaattaataaatctaacgctaatttgaataatttgaagttaaaaaagaaagaagctaatggaaaactaaagttatttttgacaaagacaataaacattgaaaattttgatacaagctgcaatccagtagaagatcttgaaagcatatcatatgatgacaaaagcgatttagaaagcttccaatttgatgacttatacaagtttgatgaaagacccggaagatataatcccaaaaatcaagaagaacaagaaattgaatatgatgatgatactggaggtaaaactgaatatggaaagaaacccaattcgcttatatcaaagataagcacagctgtagatatggctgttacaattaataactcaattagacagtataaggaaatcaaaaatacattagaacaaagcggaatagaatttggacaagaaaactcgggagtaaatttaatggcagggtttgacgtactgaatgcattgaccggaggacctactgaggatttgagtgcaatgttaggttctattaatgagcaagatcaagtttttaatgaagccgatattttgggcgaattacaaacaggtgaaatgccaaatggcgtggagaaggaagtcaaaagtaggcctttcgaaggcttggatatttcatacgatgattttaaacgaaaggttgaattcgagcttaaaaactctgatttgaattttgattttgacgattaa

SEQ ID NO: 2503 - DNA, 981 bp, Cryptosporidium hominis
atgcaagagctagattcattggagaatactaatattgaaacaattgaatacagcgttgactttcaaaatgaaggggtttgcaaatttttatttaagacagaacactatgctcttttttccaaattaaagagtcttctagataatgagtgtttcgatcttgaaaatcttgatatttcaacacaagtcatagatttaaacccacaacattatactgcatggtacttcagaagaaaaatcattcgcgaaaattatattgaacatgaaaataaaacggagttccttagagaagaattaagattcgttagaggtatttgtgaaagagctccgaaatgttatcaatcatggtggcatatgagagttattagagaattacttggatttgacattgaagaattaaatttcataaataagcagctggaatttgacgcaaaaaatatgtatgtgtggaatcataggacttggtttattaggaaatacaattctgttgaaaatgatttacttattagtgagttggattttatctcaaagttgatttcggaggattgcagaaacaatagcgcctggtgttacaggcattttatcttcactaatttaaaaaaaatgaatgcattaaaagagtctgatctacttgaggaggtagattacatagttaattggctgatgtttgctccacacaatgattcaatatggaactatataatttcattctttagcaaaataatggttaatggaaatgttaacaaagaaaccttaattaagaatttgagtcttgaaaatgcgcctaagagttttatagatgcaattgatgaaatttatactaatcattatgatagttgccatcaggttgtatatattaaggcttgtatggaatatgaaaaaggtgatactgactttgctttaaaagctttcaagcttttacaatcagtagatccaataagaaaattctactggaaatggagggcggataatttaaaaatttga

SEQ ID NO: 2504 - DNA, 153 bp, Cryptosporidium hominis
atgaaaaaaagattttttaacaaagtaaataatgtatttgactttgttgttgcattgacctgtctatcattattattcttaaatggtgatattcgaagacttttcgctacaaaaaaaattgccgatttaagaaataaccagatagtaagttaa

SEQ ID NO: 2505 - DNA, 234 bp, Cryptosporidium hominis
atgtaccttaaagcgttgatttggaagtctttaattgactcccaaacatgtagtagcgtaaatccttcaattaaagatgaagaatactcaaaattcacaaatgaggatttgcttgaacagctttcgaagattgaccctgaaagagcattgtcattaaatataaatgaccgacgaaaaataattagagggatagaggtaaatttttataaatatttattaaccacagttaagtag

SEQ ID NO: 2506 - DNA, 1128 bp, Cryptosporidium hominis
atggatgaaatcagacgtcagattgaagatttgatgggagggattgaagctccaatagagaagaaaaaccctcatgataatgatgtctgtaaattctacttatgcggactatgtcctcatgaattatttgaaaatacaaagctgtatatgggtccttgtaaaaatatccattcggaagttttaagggaaaagtatttaagtgaaagagagtcgaaaggaaatactcgaattaaatatgagacagatagtttgagagtatttcagggaatggtagatgattgcaataaaaagattgaaagaaaccgtgttcgtgctgagctttcaggaagttcaaaactcgaagatgaaaatatacgggcattagatcttgagattaaagaaattatgaaggagatcgatgatttaggtgcaaatggcgatatagatggctctttgaagaggatggaagacttaacaagactaaatcaacaaaaaatgaagatatctgctacaaaggaagatgttgagaatggaatgtatcgtcaaaaacttcacccatgtgaaatttgtgccgcatttctttcagaaactgacaatgaccaaaggttaaatgatcactttaacggcaaaattcatgttggctacctaaaaattagaaagcaagcaaaagatttaaaagaatggatcaaagcgcattctcccaatagggatagcaactacagacatgaaaatatagctcataaaggcgatttccgatataaatcacatagacaaagctactccagtgaaggccgtgcttatcactattcaaacaattatagagataggagaaatagggagcatatggattaccgtgataattatggtaatcattcatccagaagagaaaataaccaaacgagatatgaagagctcggaaataattataagtcgactgggcagagtgactataacagttttgggccgagaaacaaacgtataaacactagatctaacccttattcggcagttgaattaaatagaataagttcagaaaaacacaaaaaacatattaaagaggatacaaaaatctatcctcctagtgatggagaaatttctccagaaagtgactcctcacgctctctatcaaggagtatttcgccatattaa

SEQ ID NO: 2507 - DNA, 2718 bp, Cryptosporidium hominis
atgaggaatataaacttctcgtcatcatcttctgaaaatttgacgagaagttcagtattaagaagacaattacatgaccaaagccattttttgccttctaattctttagtaaattcgaacaatacggtacaggattataggtttttacccaagcaaacatttagaatcgaagataataatttttattctaatttgaatcaaagtaattacaactctaattggaagcaaacatcatcgggtcttttaaagtctccaattaatggtttaagtagaagttctcaagatttgaggaattcattgattgaaaagactacagaaaaaagtagcaagtatgttaaaaccccatacccacatacttacaaacctgacggctatttaaaaaatgaaattagccttccaagccatggaaaccaccttcctttattgcctcccagcagattccctttccaatcagaagcgagacgtacaattaacagattatcagatagtactgctaaatacaacttaggttctaatgattatgatttgcaaagagatacacaaacatgtaggaaaagaaatttacaacaagtttataagcaaaaaaatgaaaatgagcatgaggaagaggagttccacgatgcaattagtgatgatgaatatatcagcagtgaatccatgaataatccaaacaaaagacttaatattcctcctcaaaaaaaaacttacaaccaaactccctcaactgcagctcaaacaggattgttaggtacgcaaaacaatactccaaataagccaacaaacacctatggcttaccactttctatgatagatgatgattataagccggatcctactccagcttataacttttcagatgaaaaacttcgagatgtacaaaaacagacaaatccattgggtttaacgcattattcacatccatataactttccgaaagcctcatttttacctcctaatacggaacctagttccaacattattctttcatcagtacaaagaataagaactccactaagatacagatctagtttacttggcgcactttcaaatcgaacaaattcatcatgcaggattttgtctgctgcagaaatgaagaaagtattctgcaaatcaaagaaacctattggtagcttaaaggactttgttcacacgatagaacttcgcaatgaaactttaaatgagccaaaaacaaattcagaattaccaaaagtgcctgaagttcattcagaaattgagtatgctatcgaggacaagtcttccaagaacgataaggatagtagttctgaaaaagattcaaaaaataacaaagaagacatcattagttctaaatctgaatgttcaaatcaatctacattggaagtatccaacatactatcaaaaattgcagataaatcaatttcacctgaaaaatcagattgggataaagagctagtggagaaagcgaataatgtagacaacttacaagtttcttcacctaatatctttgttaatgattcaaagctaccagacttaagcgaacaagataataaatctgctatcaccactattgacattgaagcaacagctgagaaaaaagatgatattaaggaaactaaagaaatagtttcggaagatttttcattgaaagataaagattcagaagctgctgaaacaaaaaaagatgagcctgtgccatggtggctggctaatgttgataagccaaatttagttgaagtagacaacgaaggagtgtttatgcctgatgaagatgatgaacagaaagataatgaagagaagcccactatttctgcagcaggcctattttcacttccctctaccgaaggttcaagcgataaaaatattgcaacttcattattttcatttgggaattcttctacaaatgtatgcgtttctactggaacctctttatttgggtcttcattattccaaattaacaagactagtgagaatagtaccgctcctgaggaaccaaagcctgaggagaaagctcctcctttgcttagtagccagtctagcaccttttcatttggtcaaggcattgacaacagtgcttcaagcaacatttcattattcggaattacctctaaagctgtggaagaaaaaactacaactagcgagatagaaaagcaaatttctgaaacagttgttgatacagaaaaagaaacaacagattctagtttaaagcctcaattatcaatattcggaaaacaatctccagttgatgaggaaaaaaagcaagctgaaaattccgagaaaaaagttggaatttttagcacggacaatcctggatcgctattttcttctaaaaataacatcagtgacttgttttctcaacagagttcgagcataaatcaattattcggatcatctagcgcttcaaactctactcaaaatgctttcggcacgaaggatattttcagtctttcttcatctggagtgtctacaacaataaatgattcagaaaagagagaagtttcagccccaattttcggttcaagtgatatggaaagcaagaatcctgcttctgatgtttcgttatctgcatctttgggtttaggtaatttgaactcgtcttcaaatatgagttttacgggtggcagcacttcttcacagacggctttacagactccaggattatttgacgcaaagttaataaattttactggaagcactaattcttccagcacaactggcttcatcattgtttggtggctctaa

SEQ ID NO: 2508 - DNA, 312 bp, Cryptosporidium hominis
atgataggttcaaaggcaactgggttgcagacaaagcatgtggatttggagtatatacttatgccaatggaaacaggtacgaaggatattgggaaaatgacagaaggcatggcaagggaatattttattgtgcagaggataataacgtttatgagggcgaatgggcaaatggaaggaaggatggcaagggaattcttagatttgcaatgggccactcaattcaaggagtatggaaagatggagttctttcacaattccacagcctacagttcccaccagagtcacaatggtcaaacccaaacttttgattaa

SEQ ID NO: 2509 - DNA, 1098 bp, Cryptosporidium hominis
atggaaacatccagtcattcttattctggggatattaaaggtgggctatttcatggaagaggcgtattgatatactcaaaaaatgaaaagtatgagggagactttgtaatgggtaagagagaaggttttggaaaatttacttatgctgatggagcttcgtatgaaggtgaatgggttgacgataaaatccatggtcaaggaaaagcaagtttttcaagtggaaatacatatgagggacagtgggaaaatggaaagatcaatggatatggtaagttaactttcagcaatggcgatgtatacgaaggagaatgggctgatggtaagatgcacggaagaggtgtgtataaatacgtagatggtgatatttactcaggtgaatggagagatgataaaaggcatggaaaaggaactgtaacatatgtaagtagtacaggagaccaaattattgaaaaatatgaaggagactgggtaaatggtaagatgcatggtcatggtaaatatgtgtatgttgactccgctgtttacgaaggcgactggttcgaaggttctatgcatggcaaaggtacatacattttcccatgtggaaatgtttatgaaggagaatgggttaatgatgttaaagaaggttatggagtactgacttatcagaacggtgagaaatacgaaggatactggaaggatggaaaagttaacggtaagggtactttaacttatagcagaggagataaatacgttggcgactggcttgacgcaaaaaagcacggtgaaggtgaattgttttactcaaataatgataggttcaaaggcaactgggttgcagacaaagcatgtggatttggagtatatacttatgccaatggaaacaggtacgaaggatattgggaaaatgacagaaggcatggcaagggaatattttattgtgcagaggataataacgtttatgagggcgaatgggcaaatggaaggaaggatggcaagggaattcttagatttgcaatgggccactcaattcaaggagtatggaaagatggagttctttcacaattccacagcctacagttcccaccagagtcacaatggtcaaacccaaacttttga

SEQ ID NO: 2510 - DNA, 2781 bp, Cryptosporidium hominis
atgtattcccagattcctatttcgccctctttaagatcaaaatacaattcaggtaaccaaggggtccaaaggaaaataaatgctgatgacatgaatacaactgtcagctcatactctaataatatgttagctacaaattcagatggatacgatgtatttgacaatgttaataaggattctgagctgaatatgccaaaaattcaaaaatctagctttccgcatgggagcttcagaccatcttctagtaatataagtattaataacggaataaatatagattctaacacgaatagtaggccaaatattggtagattctctgtgaatccaggtaatttgaacgtgaatggggcaactaatcagattcaaacaagtagtgctccaatgagtactcctctccctgctatcccacaaccacctatcccgtttcagaacaactcctctatttctggaggaatccagtatcattctccaaaaaatactatctccactcagcctcctaataatttgcagcctgtaaatcagatatcaaagccatttcttcaaaataccaacacaaattctaactttcagaacatgcccattccatatcctccaaaagctccactttcagattgcaataattctgagtctgaatcttcgtttagcaagaaaatgcaggataataaggaaagacttgaacaattaaatatttctagaacaatgttggcatctatgggttctcctagtgattctcggcattcttattctcaggacaaatctcaagaagctgataggactcagaacccattccaaagtggaaaaaattcaatatctcattttggtattcaggaacctaattctaataagaatacaagcagatcgaatttaagattaccaccgaaagttccaggtattagttctaacaatgcattcaaatttaacatatcacagccagcccagaataatcaaattaaccttgaaatgccagaagtttccatgaaaagtgtggatagtaacgctgaaagaaatatggttggattgaaggatacagttagacctccaacagcacctacatttttcccttcaaataaattaaatctcgataacaacagtaatctagccaataatctcgtaaaacccccttttaaaagtcataacgatccttcagtaagtcaggattcatttttttcatcagatatccaaaacacctccaagatatctcaaactcctcgccaaatgccatcagttgtacgtccaccaactgcccctaattcaatatctaaatcttcatcattaccaaaagtcgacttacttattaatttgatggataaaacagttgaaaataaacgtagagaatttgaaaaactaaacaagcttaagtctgcattatctgagcttggcgactttaataagaaactattggaagaaaatacgagattgaggagtggaaacagtagtacaaatttacaagaaggcagcttgttatcaagagatttacaaaacgaatctacggagttctccaatagctatcagacgcctttgagtgatgctgtaagccctttcattcctagtgttcacgatccagaaacgcaggtcaactctcttaagacaattattaacaaaaaaaatcaacgaattttagagttggagaaaaaattatcaaatagagaatcaaaaaatctttctgcaacagaatttgatgtttgccattctttactccaaaaaataaaaaccagagatgaggatctgagcagcactttagaggaaattcaagaaacttatattaactctattactgaccaggttaatagctgcctctcaatccttacagataaaagctatggaaaactgaaaactattgctaacgatgtcttaaatcaaatagagttcaattgtaaagctctgagtgtgactcttgaacatttatttgaacaacaaagttcaacattggagaatattaaacacgaaggaagagtagacacacaattggatagctcaaacttacaaagtaaattaagttcaagagaatttaatgttcatgaagttaatctaaataatattcaatttgatacagttgtaagtaatggctctaagagttttgataacacttttgtccaagaaaatcctcaagatacttttaaatttaaaaaatcacaaggaactgaagactattcgaataatggcgatgagtttcttgtagcccaaacaaaaaaaatgtctttaaacggaaatgttgagctagataatgaaattaacgttcctcaatctattacaaatagcagtattggagttaatcacgacgagtcagttatgcaaaatcaacatcaagaacttaatttatatcagaatagcactttcaatcatgaaactcaagaccatataaatgattatgttcagaatcaaggtttcaacaccatgaatgtagctcaaggggcatttgtgaatgaccatgctaataaccatatatatgagcttcataaggacgaggatcattcgtcttcaactcaaagagtggaacaagaaaactcttctcatccagcgtttggttttgaacaggaaaaacattataatagccattttggccaatatgaaggaaacaatctttctccagaaaaagagaatgctcaacagggagctgattacactaatagcgttcctccaccagtgttcgcagcatattatgaaggtggtgacaatgagaataataatctcttcactatggacacaatggtaaatgcagatggattatactttgataaccattctcattaccatgttccaacgaattatagtaatatttaa

SEQ ID NO: 2511 - DNA, 1659 bp, Cryptosporidium hominis
atggttaatatggctttgcgttcaaggtcatccaacaatcaaaaacaacaggcaaataatacaccaagtaatacttcaaataataatgaagcagtctcaagcgaattaatttcatctgaaaatcaaaggaaaaagacgaatgcaagaatctacagctcaattgaggagcatccagataagactttggatgaatgtaaggaagatgaagcagtttctacaatagaaaaaggcccaacagccgacttcccaagtgtgaaccaatgggtactggcgctatttgaagaagaaggtaaacagatgctcgctcgcgtagtaggttggaagctttatggaactcaggtcactcatttatcgcatttagtgaacaaaaagacggcagggaataaacagaactctttaatcaaagtgagttcatcgtctaatgagtcgcaaatcaaggaggattatgagttttatgtgcattttagaggtctaaatagacgtctggatagatgggttaaaggtaaagatataaaactctcttttgatgttgaggaattaaatgatcctattttaattgagaggtttcagaaacagggaataaagtttatatcttcattaggagtttcaaattcagctaataaatctgggaataagtctaagaaaagaaatgtaggggttttggatatttctgatggagaagatcctgatgagcatgaagggatggaccactctgcaattcttgaccatgaggaaacaactagacttaggacaattggcagagttcgtataggaaaattcattttagatacttggtacttttctccactcccagatgagtatcaaaatgttgacactttacatttttgtgagtactgtttggactttttttgctttgaagatgaacttattaggcatctttccaggtgccaactaaggcatcccccaggtaatgaaatatatagaaaggataatatttcagtcttcgaaattgatggtgcattaactagaggatatgcggaaaatttatgttacttagccaaactgttcttagatcacaaaactctacaatacgatgtagaaccatttttattctatattgtcactgaagttgatgaagagggatgtcacattgtcggctacttttccaaagaaaaggtttcattactccattataatcttgcatgtatcctaactttaccttgctatcaaaggaagggttatggaaaacttcttgttgacttgtcatataaactttcgcttaaagaaggtaaatggggacatccagaaagacctctctctgacttgggtagggcaatctataataattggtgggcccataggatatctgaatatcttctcgaatattttaaacaaaacaagatatgtgaaagaggtggttcgaaacaacctctccaagtaagtaattatggaaagtttattgacaacgttgtaagaagcactggaatcaggagggaggatgtaatcagaattttggaagaaaacggaattatgagaaatatcaaggatcaacattatattttctgtaaccaggaatttctcaagggtattgttaaacgttctggaagaccaggaattactttaattgataaaaaatttaactgggttccctttagtagagctcctccatcggaagttgaatcacttccacaagagtag

SEQ ID NO: 2512 - DNA, 1872 bp, Cryptosporidium hominis
atgaaagataacatcatgtccgagaatgactcaggccacatttcaacagaaaatctgttaaataataataaccaggaaaaagatttgtcaatagacgatattaatgttgcaaatacgccatcagatgattttgggcataaagaagaggttactcaggattctggtccagcatcgctaaattcatcgccaatgcaagagcataaaagtgaggttgaggatgtaaagggagaaaatactcaaacagaaaagtttaatgagtcggtttccattgaaataaatgatgcaaaacaagaaaatttggatgaagttaaggaagataataccacagaaggtaaccctatacaagatgagaccaatgattcaaatatagagttgcaatgtgctaataattcactagctaagggagagtcagcttcatctaattcagaggaacattctggttctattaatatgccagaattatcgcttccatataagctctggattgatgcaaagagcagagactggatacttgaatggcagacaaagaatggaagatggagtgttaggaagtttagctgtaagcgttggggaaaaggaaaagcttattctcatgcaatgaatttcttggcatcattgacttcttgtggaattatcaaggattctaattataatcagcaattaggagattctaacgaatactcagctgaatctgtaaaccatgtaaacagatctgttgaggatgagcttgtactgcaattcctttcccagcgtgatgcagttgctaatgcagaaaaacaaaagaatggattcggatcgaattctgggttaaatacactagcagctatcgcagctgcagctgcagctgcagccattgcttcaactccaactaagtctcaggctccaactaaagatcatacttcttctcaaccaacagccacacctcaaccacaagttagaggtgcagtcagaaagagtggtgtgcctggagtctattggagccagaagcctcaaggatggagagttgtttactacaccggtaaagatcgtgaattcgaatattttaaggttccagcgaacgcctcagaggaaataatcagtgaaattctggaagtagctaagcgattcagatctcaagttactgcagaaggtcgtcacttaccaaatggtgcggtaggctccagttcaaagagagcaagaatggcagaaaggaaagcagcagcagcagcagctgctgctgctgctgcatcagccgctcctgacgcacccagacatttacttcaatcaagaaccaatcacttccctgaggaaggacttacagattatttaaggaatccatctgatatcgcctcaaagagtcttttagaaaccgatcccttatcacaattttcatccaagtttagcccagcaaatattgcaggattacagaatccaacaggagctatgtcgccaggtccttatgaatggctctataatcctctattaatgaacttatatggtaactattctgctgcaagccaggcagctgcaatgcagcagtgggcattatttcaaaattcctttcctcaaaatggcggaatgcttccctcagctattccagggcaagttgatacctccactcctcaagctaacccaatgttaaattcctttttgtcaaacccattcatgaatccgtttgggttacaagtaccaccaatgctaggacaaaatgcaaacttgatagctcagatgcctcaagtttctacaatgaatccaccttcacaaatgaacatgaatatgtttggtcgttattatggaatgaccattccgcaaggccaaaccaaccactcgcccagcagtatctcctataggtcaaaatgccaatcccacatcttcagctccttcacaacctaa

SEQ ID NO: 2513 - DNA, 675 bp, Cryptosporidium hominis
atgtcatgccaaggcgaagatattgtgaagaaggaatcccagcctaagttttttgatgacaaggcaggggaaatgataatagccagtactagacaaagaggaaatccaatacttgctcatgtgtgtaatgtcccttacgattttcagaatattgtaccagactttcttgttggtaagtatgatgctgtggtttttattagcataaaatatcacaagcttcacaaccaatatttgaggaagaggatcgaatccttgcagaagaactataaagtcagaattttattatgtctggtggatattcctccttcaggtgcaattgatgcggctattttggaaattactgatatttgttttgacttaaatatgactctgtttcttgcttggagtccaaaagaagctggccatattttagaaactttaaaatctcatgaaaactcttcaagcgaaatcattaggggaggactttcgttagacttgttttccagaattagggacgccttgagctccttgccaaggattaacaagacagactcagagaatcttttaaagcattttggatcgatttcaaaggtggtgaatgcttccgaagaagagctttcaaagattcaggggatcggccctataaaggccaaagtaatttcggaagtattctccacagagttctcggactcataa

SEQ ID NO: 2514 - DNA, 1245 bp, Cryptosporidium hominis
atgtcaatggaaggtgcaaaattggtgagagtgcatccagaaaaggctctcgagtttccgcttgtgttgtacagctctgtgacaactcctcttattttggagaatattacatcttcgacagtagcatttaagattaagactacagctccaagaggttatttagtacgtccgagcagtgggttgattcaagcaggccaatcaaaggagattcaggtaatcttgcagcctttgcaatcagttgaacaagcttctccttctcacaggttcttgatccaaactacaacatgtgacagttctgttgaacagcttactaaggatttctggcaggacctcagcaaggaacaactcttcgaacacagattatcagtcatttttaaacaggaaaacataggtgttaatgaacctctctcatcaaacgcagttggaacctcgtcaaatccatctcagggagttccaacatctcttatttcttcagcagctggatcttcatccagtaatactgctcaggcaggttcaatggactcagagtttaaaaacaaatatgatgagcttgttcaatattgcctggctttagagaagcagagcaatgagcttaaggaggaggtggtttctttgagggaaaaactggacaaatccgagtctaagctcaagtcctcaaaccagggcaatatcgcacaagggtttgagttctggcatataattgctatgattattgttgcaattgttgctttgaaactaatcaactacttctaaatgcccaagatacttccctttaccatgtcaaactggaacgtgatcaaacttcttgcctatgtagataaaatcggtgatcaagagatagaatcaaaaatcttatacaatcgcattattgaacttgctgatatcatttggaatcacatggagggtttaaataactctttaggaattcaaacaatatactcttttggaaaagccccaacaaattgtgaatttctgagttctatggaagataattcagaagaatgtaagcctgttgggataattggacaggtacagttgtttgataacgataaagctcttaatatacctactgaccctatttctaatttggaaatggaagtatgtctaagatgtgtccaatcttcaaataaaaatacgctttcatacatttatttacacgtaattagatggaaggtcagaaacaccaagttagaactagaagaaaaactcaaaaatattaattttcaacttgatcttgaaatttag

SEQ ID NO: 2515 - DNA, 492 bp, Cryptosporidium hominis
atgcccaagatacttccctttaccatgtcaaactggaacgtgatcaaacttcttgcctatgtagataaaatcggtgatcaagagatagaatcaaaaatcttatacaatcgcattattgaacttgctgatatcatttggaatcacatggagggtttaaataactctttaggaattcaaacaatatactcttttggaaaagccccaacaaattgtgaatttctgagttctatggaagataattcagaagaatgtaagcctgttgggataattggacaggtacagttgtttgataacgataaagctcttaatatacctactgaccctatttctaatttggaaatggaagtatgtctaagatgtgtccaatcttcaaataaaaatacgctttcatacatttatttacacgtaattagatggaaggtcagaaacaccaagttagaactagaagaaaaactcaaaaatattaattttcaacttgatcttgaaatttag

SEQ ID NO: 2516 - DNA, 954 bp, Cryptosporidium hominis
atgattagagaagaaacaacttctagtgattttacttcagactacagtgaggaaagtcaaaatgtaaccatctctaagtctagaccaatttctcattcattcaaatttacactatttatgtgtctattgcaaggattcagcgaaaggttatttgtaaatatgcttttatttgggtatatttggaggaaatcagcaggttatttgaactcagaatggatacttttttcccaacatcttattggatgcattggctttttgttttggagtctagtttgcaattatttgaagccacaaatagttttaagtatatcatttatagtttgtggtttgatatctatgatacaaccattttctagttcgtacattactttgattctctgtagatatttgctttatttttcatatggagcattggagccatcagtacaagtcatttctgttaactataaacttaatagccctgaaacagccaagttatttggagcagtatcttgctacaagagttttggatcatttttatctattgcagtttctacaatggtttatctaaaagggaatgatgaagttgttacaacatattctcgtataatttggattcttactggaggagtttcaatattaatttctcttatacttgccatttctatttataaggactttaagagctcaaataataattcagctcttgaaatggttcttcaggataattactactataagaaattggaaagcagcatctcaaataatagtgatgaaagcaaagacaaaataaaaataattatcatctattttgtgatatttttggtaggattattcacaaatatagtgagtgaaatatatagtttctatcaaataacttcatcgttttcttttgaaagatatgaagatttgggatttaatggagatcgttcaggtgcatatctgttaagtttaaatttgacttattatgcatga

SEQ ID NO: 2517 - DNA, 822 bp, Cryptosporidium hominis
atggactattatgaaattttggaagttaaaagggatgcatctactagtgaaataaggaagtcatatagaaaattagcattaaaatggcatcctgataaaaaccctgataatagagaagaagctgaggagatgttcaaaaagattgcagaagcttacgaagttctttctgatccggaaaaaagaaatagatatgacacctatggagctgatggtgtttctgctgacttttcatctgattttcatggatttgatcgccactttagtatgggacatgccagccgtatatttgaagaattctttggtacaaacaatatttttgacatattttcatctttcggagaatttcctggctttaatgagtcatcgagaagtagtagagggttttctagatcaagagggagtagactttctccttttgatgacttacattctcaaatatttagtaattttggtctatcaggctcaggttttggaaacatgcaaagcttttcatcttcctcattcagctctgggatgggattccaaggaggggtctcaaaatctgtttctactagtacaagtgttataaatggaagagtgatcactaggactaaaactactgaaagattagcagatggaaccgttagagagactgttcaagaaattgaagaagatggacgcggaaacagggttatcagaaactctgataattcctcaggttctagtagaaatagaatgttaaggcaaggaagctcgcaagaattcaacgatggcttttccctttctactggaaatcttcatagaactcgttctcaccgacaaagcagaactcaaaatcgttaa

SEQ ID NO: 2518 - DNA, 3303 bp, Cryptosporidium hominis
atgaatcccataaaaaatgagtatttaattgaaggctatagtgttccgtttccatatgatgcttataaatgccaaattaattatatgcaaaagattttgtattcacttaaatacaaaaaacatgcacttttagaaagccctacaggtaccggtaaaacattatgtttattagcatctacccttgcatttcaaaagcattttctgattagccatgggtcattaaagaagcctattgaaaataccagttctgctggagttattaaatcagaaggaggatcaattgaattgatgggagtcccacgtactgttctagaaaacagtaaagagacaaaaatggatatgcttatccctagaataatatactcttcaagaacgcacagccaactttcccaagtaatgcgtgaattaaaatcttccggaatttctgatggcttcactattgagttattcgatacagacgctgaaaataaagcaaagattgaaaaatcaacttcaaagaaacgcccagttattaagggtggaaagaagcttttcaaagcaacaattttgggttcaagagaccagctatgtgttcatcctaagatttccaaatttagagggaatgcattgataaaaaattgccgaaaaataaccaaagagggcaaatgcaaatatcataacaacttaaagcaggcaaacacttcaggggttgctgcagatatccaagacatagaagatcttaaaaatattgcatcatcttctgattcgggttacttttgccctttttatgcaactagagaaattgaaagcgtttgtaatgttgttttacttccttataactatcttttagatagcattacacgtcagaacctaaaaattgacttaaataatactgtattgattttggatgaagctcacaatgtagaatctgtttcagaagaggcttattcatttgatttgagagatattgatctcgctctttctcaaaaagcgattcagaatgttctagaggccacaaagcttgggcttttgcaagaaaaagaatctgatgaacaagattcagaagtagatatttcttttgatattgaagtggcagttgcactggcaactggtattcacttactttctagaaatctgaaagaaatcccatgtccggttcctacaaataataatgggtcaaagttcaagagcttcccaaaaatgggtgaagttcaagggactacttatccaggttctcatatttactctttgtttgcttcctctgggttcggaattgataattttcaagctatagatgaatgcctcacgaatatgataaattttggccagaacttagttgggcctggaggcaatgtatcaagccaattggatgtaaattctattcagataaatgcaagaataggcgcattagaaaggtttcagagatgcttaagactaacattcaatgaaacagtaatgaaaaaccctcagtggtttaaactatacattcattatgagcctgatagttacaaggaaattgatggttttgatgaaaatggaggtcagaattcatttgtagacccagaaactacagatcaaggattgagcctctatcttagtttttggtgttttagcgctgctgcagcactttcttctcttgtgtctgcaggagtaagatcaatgattattacatcaggtactctttctccattggataccttggctcagcaatttagcagctcaaatgtaacatttgatgtgtttcttgaaaatgatcatgttatagatagcgagtcacaactttgggctgccactttagaaagagggaattcagctaacaatacacatttaattggttcatacgaagctagaaacaatccatcatacttttcttcacttggaagtgtagttttcgattgtgttaagcgaattccggatgggattctcttattctttggatcctattctttaatggatcaggctgtgaaacattggacagatcagggcctaattgaacgtattaaggcctttaaaagtgttttcattgaacccagaaattcctttgaattgggttcggttttggactcatatatggattgcattaagaagggagcagattcttcatcccagaatgatggatatttcaaagacaagaaagctaaaagcggcttgtcagattttgtcctcaaatccaagaggatttcttcttcaggctcactacttattgcagtatgtagagggaaggtttcagaaggaatcaacttttcagataatgcttgcagaggagtaatcattgcaggacttccattcccttcaatagcagatgctagggtttgtctcaaaaaacaatatatggatgaaagcaaaatggatggacgtcaatggtacaatcaacaggcaattcgagctgtaaatcaagctattggacgcgttgttcgccatagaaatgactatggagcaattattcttgcagacaaacgcttcaatcaaccaaacatttataccagactttcaaaatggatcagaactaatacaaaacatctacctcaattagattccagacagcttgataatatttcagacttttttgaaaagaaactttctattactgtaaatagcactaattgccagtcttcagaaggcaataataacaaagaaatccccactaaaactttacctagtaatattacaacaagcaaaacaactttgtacggaagaaatccttctgtagttagtttccctaacttgtcaaacgaaattaatacattgttgaaacgggtagagaataaaaatacaacaaaggaagaatctaagggagaagagaataatactaataacaaaataatcattccaaaacctttccctggccttatatccaaggttagtgtaccttggaagagagtaaaaacttcttccccttgctcagagtctcaaaattcaacaccatggacattttcttcaaataaaaacgaaagtagtaatcatgaaaatcaaaaaaggacaaatttcaatattattccattagaaaagatgaattaccaagaaatattgaataattcaaaggatatactaaaagaagacgagtttaatcgtttgaagccttatatacaaaacttgagccaagttaattccaactctttaagatctattgctaatattttgtttccaagctatataatggaggaaaaggagttaactgaaagaaaatcgttggccctagaactcttaaaactactctcgaataaatatagagaagagtttaggacaatgattgagaagatgacttcaaacatcgatatgatgaaagataaggctttggttgatgcattggaaaatgaattatag

SEQ ID NO: 2519 - DNA, 1470 bp, Cryptosporidium hominis
atgttattagcttcagaaaactcatttcttgaaaaatataacaactgtccagatctgcaattagaattcaatggaggaaaggatttggtcattgaagagaaaactggaaaggaaactgaaattatcattccaaataacaaggaatttgaggagtcaacaaatacagtaatcaatcaggctgaatgtgagataccgaattgtaaaggtgaaaatattgttaattgtcaccattcatttggagatggcattgataaatcgggattaaaggagttaaatccttattatgttttgcaaggagatagcttttcatcttcaaaaatctgcaatataggtgagattattggctcagaaagcttgagtggtgtaatttctgatagtaatattcatgaagaacttttttccataggatgtcaagaatcagacgattgccgtgaacttaaagtttttaccaacgaaattggtggtttaaaatctgatcattcgcagcacaaagcattgtctaattttcactttcatcataattttagtatgttcggtgaagtaattcaggataatggacaaagaattgtgcatccacaatgttatcaacatcaaataagatcatccggattggataaattcactgctgttgataggaatgggaagagaagcatactaaatgaggttgaaactcaggcccagttaatgccatcaattcctggggtatactttgataggaggcaaattggttatagagtcaggtaccacaactcatacgtcggatgggttgctttgagtaggcattcttcaataaaagatgcttacgagtatgcaaaacagctttggttaaaggctagaaataagagtaaattgaacaaatgtcaaacagatcagattgaagcgggaaatagaggcatgggagtcagaaagagagccagatttactctgtacgatgataatcaagagctaaatcagactattctttgtaagtctggacctagtagtgaaaataatatatactttgattccaaccatatcgaaaataaccaaattttccaaactaagtgttataattctgattatagctctgggaatgatggctatggagtccattctattattgaaaatggatataccttttcagagaatgcaatggcaaagcaggtattagaaaaagaaagctccaatgaattatcaaagatgtctcaatatagtgcattagaaacaatgaggaaattgtattatgcaacccaagaatacatggaaaagtggccatcatctgatggtcactatacaatccattggtcaaatacatcagatcttagctcatatttatatggagaaaacgaacaaaatcacaaaaaagatttaaataacaagaaatctaaaaaccaacgaaaaatatacattaattcagaaaaacaaaacattaattttgataatttaaacttaaataagaagcaattagaaagctttaattatatttggtga

SEQ ID NO: 2520 - DNA, 2745 bp, Cryptosporidium hominis
atgattaacaacagtgaagaatacattagaaaaacaccattcttgttttggaatgatgatggacagaataaggctccaatgacaccctcaacactttcaccggcgtctttacatgaggtaagctctcccttattaaatagtaataagaggatgatacccaattctatatataacaaggtaaaagagggaagaaaccttatttgtattgaaggaaattcagaagaagaaaaggtaatttctgagaatattccttgcttgataaacaacagtattggaatgctaggatggtcagagaatataattcatgatgatgatctttcgcatagtaatgatagaaatgggatctttagctataatttctataataataatgctgatgatatgtttcaaagtgaagaaaagatcggttgtcaagaaatgcaagatcaaataattagttcaaagtttcttttggatagtgaaaataaggcaaatgaaaggaatcaagaaatatcaaacattcagacgcaatgctgctcgagttttccaagtgaaaaaatcaatttgaatagacagatttcaaattactcaagtagtacatcttctgtttcaatatacaatgttacagatactgtctttaaagagatgcgttcagagggaacatctgagccgaaagatatctctagatatatggacaatgagtatctagatattctaaagacaaatctaatgcttgagtttacaaaaagtcgaacatgttacttaaagcttgttcctagtgtgatagagatcttcaaaatagtgagggatgctccaaataggtgcccaattccaatagtacaaagtattgacgatttagggaaagagaagaatatagaagagtttgagaactactttgtaaattgtatttcaaagcaaaattctgggtttttagcattttgtactgaaaaacgagcattaaagagtggaggaggagggaaatactatttctttgataagaagcttcaactgaatggttgtcataaagttgatgttttgaatcaccacagacaaaagaatatcatgggtcccgtgtttatgaaggtactattatttatgtttgtagtagatccaccataccacttggatccaagagcaagaagtagcaatcctcaaaggctgatggacttttattaccagctaaaatcaatgaacaaattaaaatcaataaaaaggctcttaaaggtttggtgtatggagatgtgcccagaagagtacttggatgcaggatatcctttagggagtttgttgtgggtgtcaacattggatatagaaagccatattaaaaagtggagatatagagggaaaaagtccaatggacaatttgaatatacgactccaaaaatacatggctttgaggaaagagctttcaaaaaaaacccggttccagaggtttcactgtttacaaataatactgagagaaatatgaatgaagaaaacttacaaataaactcaaacaaattgttggaagatttgaatcttcaaaagcaagatttcatcgaagatgatggttgtattgataattcaggaacaaataatgtagattgtgttcgtagttcaagctccagcgaatgcaatgactcagcagcagaaatgcaagcactaaatcaaggttcaattttttgtaaaagtactaagaagagtaggggaagaggaaggccaaaatcaagaccaaaacagatcttctttgaggaggaggagcatgaattcccacgaaaaagaatatttttatcagaaggcgagaataacagctccataattacaaatgaaaagttcagcgaaagatctcaagatgagtcgattgaagaattggaacttgaacttggtatggaatttgaacaagcatcaagtcaaggctattcttcaaactttatttgggatctagtcagatcaattcctatagaaagtctaaacaggttatatgtaagctggttggatggaaatattccaggagtcactaaactgattgtaaactcatctgtagtacaagaatatctgaatatacaaaaaaatgtagaaaattcccgtttagaggaatcttcagatcgattgtataactgtaaagaaacgaattcggacattttaaacaaaaaacaaacttcagaagtaattaattctaaaaggacaatattataccataaagctttatatttggcaatccaacagcatcttctaatgtattcaagcgaactacaagctctacttaaagctcttgaaggtaacaacgcaatttcagaaagagatactgatcatttggatccttttcacaagaatttagatgttgtactgaattcgatatctcctttacaacatttatccatgtctttccattgcaattcaccattaagaattgtggaagagggtcaaatagatgatgaagaacatatttcaagagaggctggaattagaagctgttcggaagaaaaacttattcatggctgtgatagtcacaacggctcgaatatctctagagacggtttagtagatgataatggagagagtctaatagagtcacaaaacttatcagaaacccctagacttggaaataatatgcatgattcatctagtgttttttcaattattacatcagctcaatatcaagactttgtggaacttcctgacattgcttcctcattttctgatcaattgctcagtgatcatacagaattatccaaacattgtgccaacatgagcgagcctattgatctattttttgcaatttcctaa

SEQ ID NO: 2521 - DNA, 978 bp, Cryptosporidium hominis
atgaaattatttctaaaagttatcttgttcctctccttttttagtacgatctcactatgttctagacttgagtggactggtgatgagttcgaagtaaagcgactgtccgactttatccctggcaccgttccgcaggttcaaagaactttaatgtgcgagtcttgccagctaatcaccttcgccttaaaggaatatatttccaagaaactaagcatttataaaagctcgcaacctcctaagggttttacagatatagtggtttcaaatttcttggaaagccatgttgcatgctcaaaccatatttggcaacctttagctgataactctctcgagtttactatagaggatttcattagtgcatgcagatcaaatctaagtacctgggagcctgagctagaattaatgtcaacaagtaaattaagctttgatcaagaaatttccagaatttgtttggggaccaagtcatgcaaggacaagtcggaattatggacagagcaagaatatccggaaaacagggaatcgaaaaaaagtctgttaaaaaagagatcagacgagtttatcgctaagaataaggatagaaagggtgttatcactactagttcaggactacaatacatcgtggtcaaagaaggcactggccaagagaaacctaagccagaagatgaggttgaagtgttttatagagggaaaactcttggaggtattgaatttgattcatcatataataggggagaagagccctcaaagcttcaaatctcgcagttaatccctgcttggattgaagccctaactatgatgactgaaggacaagaagtcattcttttcgctccttatgacctagcctacggcgaacagggtgcaggagaacttattggccctaacgaggtcatcattttcaagctcaagcttggaaaaataattaaaaatgaaaataaaaaacctgataacgaggttagctctgcttctgacgaactctaa

SEQ ID NO: 2522 - DNA, 2574 bp, Cryptosporidium hominis
atgaaaacagcttcagcttcttcttcaggaagaagggtggagtacgaagcaaaggaagttaacgcgtcaggtaattcaaagaaaggtgagcaagtgggatataataatggaattcaagagacaaagttctctaataagaaatctagtaataatttgccaaataggaaattaaagctcgaccattgcgttttaaacgggccagaaaaccattcgtcgattgagatttgtaaagatatccatgaatcgaattcaaattgtagcattaattcagaatctgctccaaagagtaacccaaagagggtgtttgaaatgattgaccgaacattaaatactctattagaaaaaatagttccaagcgcaaagaagaaaaaggagaagatgataattttacaatgtgtagagcttttggtaagagaaacatttggcgattcagcaaagctgttcctcacaggatcagcagcagcagaagttgactcagaaatgagtgatgttgatttagtcgtattcactccattagattcaaggcttgctttaacgaaaatagcaagtcaattcaaaagtattaagaagaagcataaggaggattgtttgaggtgtagaaagcacagtggacaccagaaattcaaggctgatactgacctcagctcagaatgtatagaaggacatttatgcgaaatggaagttaatgtaattgcaacagcaaaagttccagtaatgatgataaaaagtagatattcaaagtttaagacagaatgcgacgtatctgtaaatatgtatacttctttaatgcattccatactatttcagtgtgtgctttattcttatccagagctccagccagttttaaggttgttaaagtattggttacatattaggagactcccagttgctaaagatggcggccttccatgtatagtttggcttcttcttgcaattgttcactgcagtgttaacggaaataagtcttcaaggtcccaaagagagcatctggaaagtatatgtattccagctagacatatacttttgagcttacaagttcactcttctggaactagttttcaaagtacagaatttggatctcctttaaactcattccagaatggatcaatcagtacttgtgagtaccatgattgtgattctagaacatttgatactgaactgggcaatcctttgagcattcaaaatttcaaaatggatattctaactcataatcgacaaattgaaagaaacaggtatttaagtcattctaattcgaacaatattaactcaaaagttccagatactatcgattttggtgaaactggaactacatttatgtctcttgtttcattcttcacctcactttggaaccgaagctctctcacctgcagtgtttcagttattaataagaatgttcaacctaaagatgttaaaactgtttcacaaattatattcaacaatggtggaatatgggacgaaatattaactcttgacgatccctctgcctcgttagtaagacaacttgagctattaaagtgcgagctagacgattttggcttcaagaacaatttgcttgcgcaaatattcgatccaaaagatcctaataaactcgaaaaagaacatttctattttgaatcaaaggaggctgagaaaagacacgagttggaaattagtctagccagcatcctaccaccaagtgattgcttgatggtttccaaccttgctgcaaggattacttgtggtacctggttagtctatttgtacgagcttaaaagatgccacaacattttggaaacttacttacaacaaatcgcaatttctacgaatgaagtcagcgaacaagagttagttaatgaactttttcatccagtaaacgatgagatataccgaattccagcaaagttgtcaacaaaaactcccgtatgcatgtatccgtgtatggatttagacctcattattgaaaaaaatatcatcgctttggtccaagttccatattttgagcaaaaccacaaattctgtttggtactcatatatggccacttagttattatgagaattgaaaatatctgtgtagattgggagggaggatggtggagcaaagagttcctcagtagaagagatgtaaggtcagtgcttcatgggtctctcttctctcctatccccctttcattcagtcatctaggaaatggggggtcagcctgctgcattctgcagccattagattctagaactattaattgtttaccaaaaaacgaccaaagtgacttcaattcaaaggacatagtaattgacgaaattatggttaaccctgccgtattcatcacgcttctaaatgatgttgaatggtattcagttgatgatatgaatgggttctacattatgcccgttaaagaatattatagattcctcgatatggagtccattgcaaaggaatccccgtattggtatgagaattactttggaaaaaataattatttgcagccacatgttccaagttgtagatattgtaaaaaaacttcaaattctactggtatggaaaagatcctccagtacaaaaaccaattttgggcaattaagagaaagagtatctcgtaa

SEQ ID NO: 2523 - DNA, 1551 bp, Cryptosporidium hominis
atgagcgaacgcacgaagaagctggcgattccaagccatttaaggctggattctttatctttaagctgcatatctactggcttgactccaaagagtgagataaataactcgagtatcagcaaaggattaacaagtacaagatcagtaaatgggcaacaatcagaagtacaaaaaaggctttcagttcagcttccttcttgtagatcactaagaacttcaataagaattaacagaagctctactctatcacatttgggcaaaaataatacaaagccagacgtgaatcaagagattggcttagaaaagcaacctagaagcttctccaactcaagcagagcttctcgaacaaatgtcacaacaccaaaggggtttgaatttgcaacttctgaaagagcagagcaaaggctaaaacataataggtcttcatcttcgggttccaatatttacaaagccgaactaggtctgaatttacatcagctttacaatggaagaattcccgctgctccaatgtcaaccagatccacatcatctattggtgcagaatcaaggataagcactttttcaaaggctacaacagttcccaagccttttagcttcgcaacggatgctagagcggcaagtaaatccaaagaactatatgagaaattagggagtttgaaagataagtttaatgaggaagtttcaacaaaaaataaggagtttagtgaagataggcgtattaaaaccatcttggaatctataaagaaatttaatttgagtaatagcgactcatctttaaatacaatcactacagaaatgaatgtaactaaagaagtagttggaagtaaatacggtattccaaggagaaatactactgttcctaagactccaaaatttgcaacacaaatgcgttcagaaagtaaaaaggcccaactcagaggcgtcctagactctatgcttctttctgaaaagaaagaaggtaattcaaattggtctaaatcagatacaacttcctctatttcaaaatctaatatattgaataataaccgaacgcaggaaaaccatgataattcttctcttgcattttttgagcaattaaaaaagcaggactctgaacctagagaagcgcaaaaccagcatgctgaccaaaaaccagaactgcatgcacgcatgcaacctcaaaaactccccaagttgcgcggtttcctatcaatgaatagtttagcacacttgggaagacaatcattcggtacgctagagggttctaaagaaaatttcaagaattctgaggagaattctccgatattgaactgcaaatcaactatttcgggaatgagctctattagaaagattaatgagtcaaatactagtattcctaataactggaagttccaagcaacagttgcaaggaaacaacttcgtcaatttactggccttgaaggaacggactttaatttgaaagaattagattattatcgtcatacagagaaaccagaatttaaggaaattgacagtaatcaccatttaacagatgacgatctaaagaccccactaccaagaacatataggtaa

SEQ ID NO: 2524 - DNA, 1263 bp, Cryptosporidium hominis
atggtgtcgttgagggctttactgccgtttatttttttggggctatttcaaagtatttttttatgctgtagcggagaagaaattttacaattttgtaaaaaacataatattacccttagtgagcttgaagatgaagcaaaacaagcaggaattagtattagtacactaattagcatgatgaacgcggaatatccttctcccattgaagagcatgtcaaaaataaagttgatcctaatgttaaggatccatgtattgattctccgacagggaatgaagacgtattaggctttgttccatcaagtagtgttatatactctagcgacattctcaggaatacaacaattgaggagccaactactaaagttgattcagagcaaaaggtatcagcttctttggatacagaaacgttgaaattgagtgaaaaaactttatttgtgaataatgctgatacaagggcatcaagcgataaaaatttaaagacttcggaatcatgttcttgctctaagcgtaaacattcaagtgagactggaaaatgcagagttataattatcaacgcgtcgaaaaagaatagagttaaatgcactaaagatataaatgctaagagaaacgaggttgggaagagatattatattattaataaaaatggagaaagagaggagtataaggttgttagtcatcatcagaaaaaagttagaaaaaacaaagatagcaaagctaataaacttaaacgagttgaagttgttaatagacacatccaacccgttattattgcacagccaagtattgcgccattatatgctccaatgcaagtaccacaaatgcctggacatcctggttatgttacaccacctcagattcctagattccctactcaaggcccacctcaagttccacctcaggttccacctcaagctcctcaaatgccccctccaactagagataatggcgattttgagtacatgaataaaaactacaatggatcagataataagaattcattcatcggcccattgactatctcagtcatcgttattatccttataattagttgcattattggaggtttttgcttctgcggagctaccggcgcaaacaggaatcatggaaatatgccacttatccccccccctggcacaccaaatgcccctcaaaatccgccctataatagcagagctccaattgttcctcagaaccaaccaactatgcaaccacctccaggaagacaagtctttggatatgcagttgttccaaacatccgataa

SEQ ID NO: 2525 - DNA, 774 bp, Cryptosporidium hominis
atgagattagaagtactatttgcattaattcttctgatctttaatattaattattcgcaaggtttaggattgagaagaaactataatagctattccgaaagtgcatacactgatattaaaagcagtgaagcaaaagactctgattctgattactccgatattaaagattcatctgagatcctaaacaaatccattcctttaaacaaatctgaaaagtctaactatacatctcaagtagaatcagaagatgaagacgatgaaccagaggcattatcaagtaaagttaaaagtgaaaaacattttagtgaaaaagatgatggtgaggacgattacaattccaatattgaaagctctgaagttgaaagctctcggaatcactcccagagcaaaaagatcagcaaagaagaagtgaatatgcctcaggtacagtatatggctaggcaacaaagattcaatcttgcaagtactgttaatcccccatccgacgtttcgaacataaactatgtattcctttctccagcagctcaaagacgaattgatagaaaaatctcaaaactgcaaaaaggaggaagatatcaaggatcaatgaaagaaactaaagctattggagagtggcagaaacgttattatagcagacctgaaacagaatatagcgaagccatgagttctaatcaaggaaacaactcaattttcatgtgggtaatcctggggtttatagtccttctattaacgttgatttgtatatgtggaatgcgctttataactaaagaatga

SEQ ID NO: 2526 - DNA, 993 bp, Cryptosporidium hominis
atggctaacccagtccgaggaaatcgtgatccacgaaggtctcttttgattaggtctttgaggtttgatacgcctacctctctggtgaggagagagtttgagcgattcggagctatccgagacgtttatctaccgttggattacagatcgagaaggccaagaggatttgggtttgtcgagtatgtggaagaggaggatgccagggctgctttagaaaagatggatggtgctaccttggatggggtaacaataaatgtaacttttgctcaggaaggaagaaagtcaccagagtcaatgagacatagagagtatgaatcgttccatgggaatggaggtagacacttatctggccatagatatgggcctcataaccattacaagtcagatccatataggcgttatccttctccaagagactacagggaagggtcacgttcatatggtggcaatagtcatccaccgtatcgttcaaggtctagatcaccacctccttctagggggtatgaaagatataaggaacagtataattatcgtcgggatgaagattttagacgggaagattatccacgctcacataatataagaggtagaagttattctaacggaaatgaaggaggcaactacagatctgagatttatgaaagaaactatccacaaagagattctgcacgaagttacagccgaggtagaagcagaagtcgaagtgggagtagaggtagaagtaggagcagaagtaggagcagagaccgtatccgtagtagaagcagaagcatgagtgaatttggaagccgaaatgtaagttgtagtgtgagtaggaacagaagcacaagtcttaaccaatcgtcttacgaaaatcctgaaaaaggtagaaacaatcatagaaagattgagactcctcaaaatgagcccaatttttttcaaaaagaatttatgaatgaacataatgaaaagaattatgatagatccgactctgaccgccaaatgtcaaactaa

SEQ ID NO: 2527 - DNA, 1200 bp, Cryptosporidium hominis
atgaaagaggaatgcttgcttccatatgaagtgagagtgaaaaatattgaaggagatggtaactgtttgtttaggtcgataggaagccagctttacggagagagtgaacaccatgaaataattagatctgcctgcatggattatgtagatttaaacaaggaatcattttccggatttgtacatgaatattcttcaattgaaaaatatattcaagagaagagaaagctgggggtctgggcagataatattgaagttcaagcactaagtgatttgtatcgtgttccaatacatatatttgaaaagatcagaaatagtaaactgaatgctagcttattagagaagcatagactggaaggctcttctggtgctatgtcagaaaatattttctatgagaacaaggaatttgtttataagttactttgtaagatagagccaaggcattcaagtttccttgaccaaattaagaattattattcaaatagtaggccaattagattgctttattacaatgacctacattatgactccttattttatagaaaagagcatcaaaccccaataattaacaaggatattggaataattgaggctgagagcattaagaaccttaaagtttacagaaccattgcaaaacaaaaagaaaaaagcagtaagtttcctgttagaggctctaaaataaaaaccgaccaggtcggtcattttaatcacacatcatatgcactactaaggaagaaggcaattaaaaagttccctgttaattatggatctagcagtgaaagtgataactatgtcgcaaaatcgccatttttcctatccgttaagaataaataccgagacgagcccgaatcatttttcgaggggaattacctagataaaatctctgaaggtgaaactcattttgaaaagctttacctcaagagcaaagagctatatagcaagtttatatctaggcccaaatcattttccgaaagggcaataggaaagcccgcctgtgtttcaaaaattaagtcattaaataatactcatttgggagtagttgatagatacgccagggatgttcaactctcttctcatcaaaaggaatttaaaaagctgttgattaacgattcacctcgattatcttcaaccccaaatccaggaaaaaagtgtgttgcaatatattgtccacaaaatttgaaacaaagtacgtttagaaattaa

SEQ ID NO: 2528 - DNA, 1086 bp, Cryptosporidium hominis
atggacagtagaacttggtttgaaggagtttctgactgttccagaaaaataattgaagctttaaaaagtgataatcacttgtatgggagagattctaatcattttgcaaaagaaagtttatcgatattttatagttatgacttatcctcgaattcttgctcagttccaactgtagttacagaatcaaacactttatcatctgaaacaaaagataccagaatgttgttctcttcagtagatgaggagactctattgcttcttcaagaagtattaaaatatcattattctggaggagaaggaactttcattaatttgggaaccccggttaatgagataaatgggctaaattcagttcataagatagtgcatagccctgaaatgactgttcctagtgatgataaagaaacaaaggttaataccgaagctgaagaagatatttttgaaggtgttgggagcatttttgaccataaagagcataaaagaacacgaactagatctctagaaagatctttaactccagatttagatgaatttattgaaaatgtttacgattttaaagaagaagcattgcataacaccaatgttcaatcgtctattcaatctcaagtgatacaaactagaaaagatcaagattctgctcaaagaagcttcggattagcttctaggacgaaaaatagaaagagaaatattgactactcattgttgtcaagaaaaggtcctgtgagttctcctgataagagttttgagagccttaaacttcctcaatttgaagattcatcttcttcttatgcagaatgttacctagaagttgacggtgtatcacattacgaaactcatcatgaggagttagaatcttcaagtattagatctcaaaacaaagagatggaagattcatcttcggttcgtgataaatcaaaaagaaatatcgaaaaatacaaacaaaggagaaaagataaatctgttcatcaggaatggaagtctatccaaaaaattatgaacaagcaaaattttaggtctcttgaaacttttaagagtttaattagtgataataatggttcaattaagaataattttgggcaaatgtaa

SEQ ID NO: 2529 - DNA, 1464 bp, Cryptosporidium hominis
atgggacagaatttatcaaaatctggagtagtagtgtggggttcaagcgaatatggacagcatggttctaaaggggaggaagtaagtcccggaccacatctagttgatggacttagacatctaagcagcatatcaaaggtaagctgtgggtcaaattactcagcagcaataacaaattctggtgatttaatcctatggggttatggaggatgcggccaactaggttttgggaatttagaggattgtttggtacctagagtaaatctaagtcttaaaaatgttgttcaagttgcatgctctgatagacatacagcagcaatcttgagtaatggtgagctttatacttggggttgtagtaaaaatggcaagctcgggcatggacaattcgagttaagtatttcaaataatgtagtctcccaaccaatgaaggttaaagctttggaaggagagaaagtaatacaggtctcatgcggaagttaccatacagggtgtttaactgacgataaaaaggcattaacctggggtctggggctccaaggacgactaggccatggagatactcaagatatatttactccaaagcttatagaaagtttggcagggcttccaattaaggagatatcatgtggaggacatcacacagcaattttgcttgttactggaaagttatatatgttcggaggaggggcttttggaaagcttggctttgggtcaactgacgacgttttgattccaagactattagaaggacctttggaagatattcaaataacaaaggtttctttaggaagtcaacactcagctgctgtcacaaagtgtggcaaggtatatacttggggacaaggaggaagacttggacacatttttaatggtccagaacacgactttttgtccccaaaaaggctttctaacctcgaaaaagcatttattgtggatatctcatgtggtaattcccattcagtagctctttccgatgttggagatatatatacttggggtatgacaaaaaatattggtcatggaattcaaggaatacatccaaatatgccttctaaacacccaatcttacaaaacaagaatattgttcaagttgtttgtagtagctcgcattccattgctttatctgatattggagccttagttcaaaaatctccagaaacctggaaaccacagtctttagcggaggatcaagagcctaaaaaggcagatcagtctatagaagagttcaagacaggtctagatagtctaattcgcaggaaaatcctacaaggaattaaagataagcttaaaacaggaggcgatagggagaagattgaatatctaatggatgagttggaaaaaagtgaggaacaaaacgctgttttagtcagcttattagacgtttctgttcgtaaattggaaattctgaggaaagaaaatgaagaactaaggagtaagcttgaactaactaggacaaccaattaa

SEQ ID NO: 2530 - DNA, 2113 bp, Cryptosporidium hominis
atgtacgaaattgaaagccacttttttgaaaataaactacaaagctggttctctaaaacttgtatttctaacttcccagaaattcaaaaactcattctagaatttttattcagctttaaaacatccaaaaaactttctttagttaataaagagggtctttcattctacagaagtgtccaaaaggcaactttgggatgtattaaggaactgaatacgcttgaacaccaaacatggatgaactcaaacccagatttgtggctatcttggctattaatgagcagaaataattctaaagaggacgatacttcaacccttattccattggatccgagaattgtcatgaggattttgtttaactttaggaagcttcatcctgtcagctataaaaccagaattatcaaagacactaatggggaaccatttttaaatgttgaactttcagctatttctcttggaaatctggaaaatgatcttgaagacccaaaaaaacctttctcctctatatatgacatgttttcttcaaaaagaatggtttttggtgttgacttggtatatggacaaagaatttaccaatttgactctgaaagagactccggaagtggagaaattataattagtgttcagcctgaacatatttttgatgttttatctcataaagaattctctgaacatctttactcaaccctattaggaattgaaagaaaattttgtttaggagactggtcaggttactttagtaataatacagggaaggaaatgtatggaaaattcatgaaatcaattttactccctctgaagacttgtgagaaaacttgtagaaggccaacctttccctttgtttctattcttgctacctcacatttatgtaaaggaagagaagctggacaaggatccgaaaatatcaaatcttcactttacgaatcttctatagatcttctggaagagatgtctcaccaagttctggatgactctagctgtagtaggatggttgagaatgctatattatacaagtctccatctcttgcattctttttaagctcttcctgtctaacagaaagtacattccagctcattattgactctgtttctcagaaagaaaaaagtttctttcttggtaaaaatttggagcctctggaagagctttatgagacaaatcaattggatctagtttgggagaattttgatgagaattctcctctatttaaaaatagttacaaaagtaagcataggccaccatggagaacttctattgataatattatcaatgcaatgcaagaaaagcaatcccaaatcatttcccaccaaccctccattgccttcaatcatcagacacttagaaatgatgctgggtatattagtagagtaaacaggccctcttttggccattctaacgaaaattcgagcaccgaaagaaactttgaacatgatgataacgatgaagatagaacttatcttgatgaaggaaactcttttgatatttctccaagttcagaacaaaaccatgtggaaagtccaagtcttgttgcttctgggtttgttatgggagttagatgccttcctgcatctacagctatcacttctttaggatcaattattggaaatggaaatccaggtcgttctggttcaattaatagagttagaggaacgaatttgctgggaaatcaaagtcaaagattatccattcctcgttctgatataactgggagattaagttcgtgtcctacatttagttcaattgcgacaagttggggtactccagtccccatcactagaacaatcccaattgatgatattcttggaagaagaagagaatcaattcatagtactctggatccagaaaaaaacgatcagaatgaactaattctcagtgagattagagttagatataatttagatagtgatgaggacgaggtccaaaatgaaaagaatcttattaatggcaaagataaggatgaagaatcggagaattttaaagataagcaaaaattagatatttatcatttagaggaaaaaagtaatagcgaacttgaacaggctttaattgaagaagaagttttgggatcacttactagcatgcaaatcaaagactctgatgcatcaattcttgcaaagg

SEQ ID NO: 2531 - DNA, 2274 bp, Cryptosporidium hominis
atgggagaaaacgagaatttaggaaatatagaaaatgtatccggaacttcaggagcaacaggtaatgagcatggttcaggttctggagtccatgtatattgtagagttagacctccaaatgaagcagaaaagacccatggaaatggtttgctgtgtgtaaatgtgagatctgaacaatgtatagagattagttcatcagaatcaaaaagcgatagtgaaacaaaagaaaggactttctatttagatcatatttttcctatggatactaatcaaagttatgtttataagactgctgcaaagccaattgtagatcaactatttaaaggtattaatggaacagttttagcttatggacagacttctagcggtaagacatttacaatggaaggtataataggggacaatgagaagatgggagttattcctcgtatggttcatgatgtatttgaaactattagtaatgctgaggaacatattgagtttcaactaaaagtttctatttgcgaggtttatatggaaagaattagagatctattagacacaagtgggacaaaaagtaatctgagaatacatgaagataagatacacggtatctacgtaaaggacttaagtgaatactttgtgacttctccagaggaagtttttgagttaatggcacttggacataagcatagagctgtggcatctacgaatatgaattcatattcgtcaagatctcatttgatttttatgttacaacttcaacaaaagaatgtatttgattctagtattaaagttggaaaacttttccttgttgatcttgcaggatcagaaaaaattagtaaaactggagcagaaggattaactttggatgaagctaaaaccattaacaaatctttaagttgcttgggaaatgttatcaatgctctaacagataatacaaaaaactttattccttatcgtgattcgaaattaacaagaattcttcagaattcccttggtgggaactctcttacagctttaattgttacttgttctccaagtattgtaaatgaatctgagactattggtactttaagatttggaatcagagctaaaatggttaagaatgctcctaaagtcaaccaccaatactctgttgaacaattacaagttcttcttaactcagcacaaagaaaattggcagagagaaacaattatattcaaactcttgaagagttagttaaaaagcttggaggtgaacttcctgaaaataaaccatctggagataaaggaggtagtattatacttaattcttctttaaatattggagaaagaaaagaacttcaggaaggaaccattcctggatctgaaaagaccaccttaaatatgagaactttagataatgatgaattggatgagttggaggaagccaaacagcaacttaaagagaacagcgaaaagattactcaattaaagcaagagatttcagaaaaagaaaataatcttaagttaatgtctgaagaaaaggaaaatttgaatatcaaactttcagatttaatccaagagttaagtcaaacaaaatatcaacagcaggaccaggccgaaactgttgagcatcttcaactcaaaaataagtctctaataggagaacttgagcaatcacagattcatattcacgacttagaagccagaattgaagaatataagtcagaggagtcacaaagaagaaatgaagaaaaggaaaatgaatctaacaaagcttttcaaagtctttctagtgaaatacaacaacttagagaatacttacttgcaattagaagcaatacagatccaaaagaagatggagcttggagctctgaacataaagcattattagaaactattgaagataatgttgctagaattgctaatttagagctccaattaaaggaaagcaataaaggtgctaaaaagttagatattaatgaccaagatactaaaagtatgcttgaaagaatgtctcaactagatacaaatatggaacaacttggaaagctttaccaaaagatggttgaacagaattcaaacctaaaatcacaaagtcaactaaatgagagaaggttgttgaggaaggaagaaagaattgaacagcttgaaagatcactaatcaatgcaaaaacaaagtatacaaagttactaatgcaatgtaactcactaaccaaaactattgaaaatatctccaaactaaagcctatttttgccaaattagctcctcctaatattgttaaaggaatccaaggaggaggaggaaagtcctccctagtaaaggcttag

SEQ ID NO: 2532 - DNA, 246 bp, Cryptosporidium hominis
atggatggcgtgaaatttaaactaaaaccagtcttggctgaatatattactaatattagagatgagttatttgaagcgggaagcatgaaatttaactacattaactcaagtcaaatgaagaaggttattgagtatttagagtacaaacatcaatattcatctaaacagaaagagccacgggaatttcagattgaggattcccaagcaatagacctactcattattgcagacaaactcggaatctga

SEQ ID NO: 2533 - DNA, 204 bp, Cryptosporidium hominis
atgaactctgatagaaagaaagtattgttgatgggacgagcaggagcaggaaaaacttctatgaggagtataatctttgcaaattatcttccgaaagatacaagtagattaacagcaacaaataatatagagcattcacacttaaggttctttgggaatatggtgttaagtctttgggattgtggaggccaagtaagtttttga

SEQ ID NO: 2534 - DNA, 396 bp, Cryptosporidium hominis
atgattcaggttcccgaaaaaactcagaaagactcttcaatttatggcttaattggtgaatttgacttttttggggcctctgattcagatttcggagagcttgtccacaccattgttgaccaaattggaggagaaaataccaataatgaaaagctgtttgatgtattaaagaagaaattaaccattctagataatgggacattaaacttgtttgctcctgctaagttttcaaagccagatattaaggatattgttctacccgatgaatcatattttgactgtaagtcaagtctgaagacagagttgaaaagtatttgccaaaatgctcaaatagattcacaaattttttattcaaaagatctttccattttaagggtttgtcatttcccaccataa

SEQ ID NO: 2535 - DNA, 1590 bp, Cryptosporidium hominis
atgaaaggattatttgattttatttctgaagtatatgaaaatggtttccaatatactaaaatctttttaaattctactgaaacttcatattctactcaaaccaaaaacttgaaagttcctaacaatgtttcaaatattctctcaagtagtgatttggaatcttctgcagtagaagatattgttgtttcaggatatggaaagaaagaggagttgttatacaaacaatttgttgatcttgaaagcacaattttgaatatatttgaaactcaaattcttgcaatagaaagttgtcaattcgttaattatattcctatatatttggtttgccattgcgattcttggtgcgagaaattccttcaaattatctttaagaagttgttcaatccccatgagacacttatcatcagagaatcctcagtagattacattgtattctttgtaacaaactaccaaatagtttgcaactttaaattttacacaccttgtattaaatatttaatgcagtttcttcacgactttgttgctcattggagtattgaaaaatctgatcagaacttaagctcccaagaaatttttcattccaataaaagatcaggatttaaaagaagttttggaggtaattctcagaaacattcacatcttactttaagaaatttgttcggtttatattgccatgttgtattttctctttgtaaatttgtttcagttataataaataccattttaagcgaaaatgtccaagatagttcttttgaggatttatgctttctcattgactctttactaaacatgaaccgaggttttattccatttatattatgtggagatttatctccaattgataatatagacccaagtactcttacaatttttctaaaatctgttataatactgattcacaaggtgatttctattcagaaggagaaattaagtatctcgaaatattatggtgccattaagcttatttctgaactcttgaattccaatagtagcaaggagatagttaaagttgaatcaaagttattcttagataaattatggttatggcattctggaaaatacgtaaacaaattcaaaacttccaactctaatttaatagaagaccaagatatttcattccatattttagagctcctaaaggtgatagaagatgaaatagaaattcattctgaagaagagccagaacctccaaatcaagaaatcgatatcccagaaaaaaaatatggtgaaatggagtcatctattcttccggaacaatctctttgggagtatgtatggggagatgttccagtttcatatgaagaattggaacaagagctttatgtgacaaaaaacaaaatgtataaagaagatttggacagacagttcgactactcaagggaagagttgaatggacaagatgaggacaaagaacccaaaagaggcctatgctcaaagaagccaagttcttcaggaatgtcattattagacactcttttatcctcggatgctttcaaacgtggagaagctattctacatagttatcaacgaaaacattccccttcagggaaaaagatgaataaattttctaggaaatctaggctattttag

SEQ ID NO: 2536 - DNA, 1806 bp, Cryptosporidium hominis
atgagagaaaaaaataagtccagggaaggattaaaatggatttgtatggatattgagaaaaactttgataattacgttgagaaggcagaaaacttgggaaaatttgatacgattatagacaaagggtttttggatgcttatttatcagacagtgcatctgagaatggactttcttcacgaaaaaaatcaactgattttttgaattcatccattaatcttttagctccaaatggaaggtatattttgattactctaggccaggagtatgtagctaaagctttaagtatggggttatataataaaggtattgaggttattgttgaacctttagttcgaattaaagattcaaagtttcttccatattatattgagattatcaataaaagtgattctcagaattttgagaagtcatttttcagattcagaggatctgggactgaggaaatttgtagtgctgaaggtcagtgtatttggactttagcaaaaagacttaaggagctttctgctatgttttggaataacaaatatattggtgattttatgccaggagaaataaaggaataccagctcaatataaaggaatccaagaatagcctttttatcactgtatatgatacaatgagcaaagaaaagaaaagaaagcttacagtaggtcttcttgtacctttaggagaggaacaggattggctttattctacaagaaaaggatttgaagaaatttgtagtcaagccaagtgtaagagattaattgtgatttcaagattctattcagattcagaagaagctttgaaagtgagtgaacaggaaatcctggatgaaatttcgaataatatctctcctttagctttaaaaggttctaacagattccctattctaactgtaggtggagacaagaatctagagaaaaaatgtatttatagctgctattcaaagtactctaaggaaatacttgtttatgatattcaagagtctgggattgagaagagacaaatgattttcaggtcaagcccaagacttattcagtctgaagtagtaattcgaagaaatgtttcgaaaacaattgaaattgactatttaagtggactttcaaattactatgtaggagttatattggtttcaagtcttattttggatactaaaaatcaagacaaaacgagaaacgctctcattttaggcttaggaggaggaattttagcttcaatattgagaaagttttattcaaagcctaaactccatatttctgcagttgaaattgatgagaatgtaatgaatgtagcgaaaaattactttggattttccgaaagtgaaaccaaagttattattggagatgcactggactatgttaataacaattatttagagattaaagactctttggattatattattgtagatattaactctggaaatgtgaatgattctcttatgtgtccaggagtagagtttctttctaaagggtttatagagaagctgattgtttctttaacaaaagatggttgcattgtttataacgtttcatgcagagactctaatagaagagaagagctttttaatgaatttagagatttgttgaataaaatggaagagaaaactaattccaaaagaatgattcttcaggcagtgaagacaggagatgatgagattaatgaactatggataatcaaaagagaaacaaatgataatatcgaaaaagttagaaactttataatagaaaatgaattatttataagtactcaggaaaatacatctttagagacatatgataaaaaggatctctggattaagaggttctcaaatcttaagtag

SEQ ID NO: 2537 - DNA, 651 bp, Cryptosporidium hominis
atggactatgaaaacagaggaggccacaaaacgggtagcggagctctggcgagctcccaggatattgcaattgagaggagagagagacttaggaggcttgctctagagtccatagatctttctaaggatccttactatatgaagaaccaccttggacaagttgaatgcagactttgttccacaattcacacaaacgagggatcgtatttgtctcatactcaaggaaggaaacaccaaacaaatctggcatatagagcatccaaagagaaaaatttgaaggctgttgtgaaacctcaggctgaaaatacagagcaagctaagccgagggctccaaggataggacaaccaaaatataaagtctccaagcatagagaagggtcaactggtactaactgtgtatattgtaaattctattttcaagagattcttgaggatcatgttcctggttacagaatcatgtcttgttgggagcaaaaggttgaaaaacctaacccaaaataccaatacttgtttgtgggagctgaaccttataatactattggaataagaattccaaatatagagctaattaagcaaagaactcaaacatattgggatgaagagagaaaaatatatcatattcaattatacctttcaagtagtaaacaatga

SEQ ID NO: 2538 - DNA, 966 bp, Cryptosporidium hominis
atgttcaatgagatttggattagacagcatatgttcaataattccaaattaatctactcaactggtaggaacctcaaagatttcctccttgcagcaaagcaattcaatcttcttaggcctgactatgcaatttgcggggtgggaacagaaatatatgaatttccaaataaagaaatgaatcttgagatattttgtcaaaggttatcgaatactataggaagaaatgtaacaaaagaggaattattctccttgttgagattccaggacatgggggagcgtgttgaaagcaaggagggagacgaggagaaagtgaccaaagatgtcaatcccatgttcccaaaatggtgcaaaagcaggttatttgcttggcctgtggataagtggttggaaatcataagaaaaacattcaacagagatgaattgaaaaaagaaattcaagaaaatctgaacaagatcggactagaatattacattaatggaaacaactttcatgatccatttcgtctatcagtatccatcaaaacagaatatgctttgaaagtgtatgaggaaatacaaataaacaaaaaaagctataggttcgccattagcggacaaggagcatggaaatatttagatgtgcttcctgataaaggtggaaagcacctatctataatatttctccaagatgagattctagggaattctatccctttggaaaggtttctggtgtgcggagactctggaaatgacgctcatatgtttacaatcgagagatgcaaaaactgttgtgtcggaaatgctcaacaggatctcaaggatttcttattaggaggttgcctagtgaacagtgatgagcctgagtcaagaaaagtcttgagtagtcagagtgagctcctatgtagaattatggcttgccagaatctgaagcctccaaaaaaagtaagttttactccaaaaatgtcattttgtatttcactcaattga

SEQ ID NO: 2539 - DNA, 783 bp, Cryptosporidium hominis
atggaatcagagcccgtaatcaaccaagtattggaggagataaagcagtcaattattctaattaatgaatctcttggatcggaaaagtatgatatatcctcactttctaatctttctctctctacaatcctggatatttgtgatgttagaattgttgacgagcttccgccaatacaaactagaaccgaagatctattagtaattccttatgaaaattcccaagaaaacctttctatatctcaaattcataatagatcatctagttacattattgtaacctctccaaaccccgtctctacacagaatgaagctattggaggtgcgtcttggacctattatgatgactgtgaatccacaagtgaaggaagctttttaactgaagatgaagacgatgatggaacttctgactctgaggtagatatgagtgatctcgatcgaagtttcaagaatagttcaggcattaatttagaaaagagtgatgatctcttacacaaaggtggcaattgtaatagttttattgagaaatttgggcgcaaccatctcaatgactcttcaaataatgaacactttaaagaagtattccctatttcttttagaaccaacattcccttgctttgcgaatcatttgtggataatcaagaaaactctatgtcaatcccaattgactcaacaaatatttttaaaagacagctcgtaaaagaaattaacgaagaagaaagaaacttcaagatggttaagtacgactcccaattaccaattggaagagaccaagttttctattag

SEQ ID NO: 2540 - DNA, 2094 bp, Cryptosporidium hominis
atggaaattaagaaaataacacaaatgcagcaggatgagatttttcaagagaatttggaactatttttaaggaactgtgagttgaacagagaggtgggatggagggaggttgaaaacacggatttactagtccgtttgaatgattataaagagaatcagaagagtttggagctttttataaagaagctaaaagaagatgagattgactcatgcttgggagaaatttcggcaaaaagtcagcttaaagagtctcagaagatagtgagaagcttagaaaaatacaacgaatatttaaaggctatgctacgtaagtatatgaatgctggttgcaaaataaataaaatattgaatggggaaaagataacttcggaaggatcattagaaaatgaatctgaagacgaattcagggaaaatttgaagaaatgcctgaacatactggaactgctttcgatggatattgaggagcaagccaagtataaagacaagtataaagcattgaagacagaaaacaaagatttaaaaggtagaattgagaatttgactagggttaagccaagcaaaaaggtgagaatggaggtttctctgactataattgaaccatttgagcttgatgaagaattaatcaaagatacccaaatagttgaggatgtttttgagcagataaaaaacgaccctgtggataaaagtctggaggaagaagacattggtaacaaagaaattgatattagttatgaagttgaatgtttgaattacctaataaaacaacataagaaggaaaattttgagcttaagcaaaaaattttcgagtatgaattcaatgataacaaacttgacgtagaagcactaatagagtcaaaacttatggataagcaaagggaactagatgagttggaagaagagtactcaaattgggtaattagacttcagggagagaattctgagctaagaaaagtaataaaaatccaagaaaagaaacaatcagaatttattgataactttaccaaaaaaagccaagagaaagcaaaagaaatgcaaaatatgcagttaaaattggtagagaattacgaggagaggcttagagaaaagaatgaagagttgaggaagctaagaggagaaaatatacaaggagaaaaggacagtatagaaatagagtctctaaacaaaataattaagagtctcgaggaaaaattagtttctatttccagtgagaagcatcgtttatcattagaacttgaaaaaacaactaaagatctcaaagataccgataagagactagttttgagtgaagaagaaataaagaaaagagaaaaagaatttgattctctaaaagctgagcaggaaaaaatccttgaacaatattatcatgaaaagaagttacaccaaaagttcgaacaagatgctcactcactaaaaaaggagctcgataatgtactcagtgatatgtacaagaatcaaaagaaaactagatctggaattgttggcgattccattgatagcgacaaaatttcttcaattgaagctgttattaagcattgcaaagaacttgaaggtaaagttgaagaattaggttgggaattagatcaacttaaaagtgggaaatctgtcacttatacaaattcaagtcataataatgcggaaattgaaactctatttgatcaggtacaaagcctcaagaaagaacgtgaacaactcaagaaagacattaggcagagagattgggccaaagtcgaagttgaaattcttcataagcatattaccgaggaaattgatcaactcaagagggataacactcgactaatgcttgaaaatctcagattaagagattctggcggagtccagatttctcaaaggcagaatctcttgaattcaaacaatgaaaatattcaagccaatagtacgagatcatccatttcgggtgacaagcaggaattaccaaagaaaggttctgaaacgaacccttcaaatcctgaagaaactaatcataataattcaaatgtttctgtttctagaaacagtattcaatctatacttaatctaaaggctcctagaaggcctagtttactagttcaacaaaggaactactccgaaaaatag

SEQ ID NO: 2541 - DNA, 753 bp, Cryptosporidium hominis
atggagataatcagaaatataattaacatatatcttaaaaagttcttgcagcttgaggatcttaagtgggacatcaaccaaggactacaagttgaccatgttagggcaaactcacagagtatcaataaacaattcgaaaaaaaaggtattcccattcaaatatataatggaactttagattcaataaagattacttactctcctacaaacggaacatttcaaatacatataaaagaaattaatgctcaaatcaagcctagggtactttctactgtcggaaaaaagatccagcaaggaattgttaacattattctggatgaagaccccattgaatttattgattcctactcatacatcagagatctacccatatcatacctagaacaagcaagtaaaaaatcagaatcatctattgctgatcccgaccttattccagaccctcccaggtttcccactgctgccttgaaaatcaaacagcatacagattacccgcccaaatattacccgccacttcatttcagtatatataagccaaaagttacaaagatgcctgcaacatcaacaccactcatatttcaaaatcgttaccaggagcatcatctaccatctagtccactggtgtatgggccaaggaatcaaagtgttcctattttacaagatctccacagccagtttcagcccagttatataacaaataataaccgcgaaaatggacatgttagaacacttagggaaagcggtttttgcatatag

SEQ ID NO: 2542 - DNA, 1023 bp, Cryptosporidium hominis
atggaggataattcgggactaatcaatgagaaggactttatgctcaaaagtcggttagaggtgaagttgaatgatttggaaaagagacatttagagactaaggagagggaagcacaaactgttggattcctcgagagaaaattgagacaagtagaattagaacataagactgagttaaagctaagaagacagttaagatatgaagtaaataatttaagaaagaagcttctagaaacataccagctatatagtaatacattagaacacaatgagctgatgaggagcgaaattgacaggttaaaaggagatagttttaaaagtaagtgtaaacaagtagatttggcagtttcaagacaggttgagattgagataaacgaattatttcagaatgattgctactttaataatgaaaatagtagattcgaaaaaaagaacaggttaaatttgagaggtttgaatgaatttgacttgaaagaaagtaagctttccatgagttttgatgcgagaaatggaaggcattcctttaatagaggtttaccttcaagaaagaattcattttttggtattaacaggacagctgagaggatcaagatcccaagtgatggtagaactctggggaaagccatttcaggtaacgaaagttctagggatttaaatctcaaatcagaaagagcaaaagattggttaaatcagattgaggaactttataaacctttagagtacccaaaactttgtaatagaacgtacaagaatgagttagactcgttctctggtattgggatagttgataattctctaaacatgggagaagattcattttcagatgaagaatattactcaggggaatacgatatatcagagaatactgaagatgttattacaaacacaggatttataatagaccaaataaatcaacaagataaggagctttctacacttttaaacaaaactttcatcagtgcaaacaaaaatagaactgcctcaaaaaacaagttgaggagttcgagaagtggtagaaagtaa

SEQ ID NO: 2543 - DNA, 1107 bp, Cryptosporidium hominis
atgtctaatgaaattaaagagctaaaagaatgtaagcaaagtttatcttattcagaagttgttgatatttataaaagatttggtgatcttataaactgttttgttactcattttgactttaatagagtaaagatattttctcaaaggagaagcattgcaaagtactcctaccatatattgatatgtattatcaatattattgaagataagtcatttcagcttgataaagaaagtttagtaaaaagttgtcagatatgtttgaattattactttccatcaaaagcaatcaaacaaatggaatccaactcaaataaatcagaattcgatctaaatagcagttctcagaggtttgatttaaatagaagccaggatttatgtagtactcctcctagaagttccgtctctatggatatttcaagctttcttcctaacccaagtccatttaatttatctttaatatcaccaggatcttcaagtatttcaattcaccaacaacctattacaagatataactcttcagaaaattgtctctctgaatatacaaatttacatattcaaaataatcaagaagaaccttttagttgtgaatcagagttttttccaaatgaatttcagttgccaatgccaattgaggaagcaaaaagaagactcagagaaaagctattgagaaaagaaatatctgatatgaagaaacaaaaaaataaggaacctgactaccaatctgactatagcaatttaagttctcctttaaaaagtaaatctcttttacattcttggggaagtgagcaaagcgataagtctgaattacatattgaagatcttactggcgcatctagtgaaaatccatacaaaagcaataaagttgtcaatatcaaacataatctacaaacccaatcagacttttgggaatctacaaaagttgctgctcaattagctgaaacattacccgaacctcacaggactcgtagaatcagaaaagaaatctatcaacaaagtatagaaagatctgttgaacttttaaagagcttagggatttgtaggaacttcagaccatcagtccttacaaagacgatgatacatactgtagaatgtataatagattactga

SEQ ID NO: 2544 - DNA, 657 bp, Cryptosporidium hominis
atgtcaaatctaatagtattcaatgctggaggagcaaccactggatttaaacaagttcctataccattatttattggcgaacttcaatatgaaggactcaaagcaaaaaaggatatttgggtatcttcaactattgttaaaaaacacttccctgttaggaaaaaattattcgagactttttcatattataatgtgactgatgaaatgttgaataaaattaccccctttaaggttctggaaaatgtaacaaaccaatttattcactatcaaggagatcagttcaaacaagtaattcaacgttcaacttttcatttatgtcctagaggatttggaagaacttcttttcgactatatgaatcagtccaattaggaactattccaatatatatttgggacgatgtaaattggattccatatgggaatttaatggagagacttggaatagttatccacatctctcagattgaggatttattcgatattttgaactcactcagtaaagatgaattaaaattcaaatttgaacagattaagaaattcaaacattggtttacttatctgggaatcacaaactatatattaaaagtaattaaaagacttcctcccgatattattttaaaacaaaatatagaaagtaagtatttagcattatattaa

SEQ ID NO: 2545 - DNA, 281 bp, Cryptosporidium hominis
atgggaccatgggtagaagatggagtcttttgcaattggattacacaatattcaataaaacaaatcaaagtatgtaatgaatctgaacctattcctccagtttacatcccaatattttggacttcaattcatagaaataaggttgagcttgatttaaagaaagaatggaaaaaagaagctcaggatgtattaaattcacttaaaaatgaaacaatgtactttactgtactacaggtaagctttaaaatatttggtattattccaaatgttcaatcattttc

SEQ ID NO: 2546 - DNA, 1266 bp, Cryptosporidium hominis
atgaacctacataataatttaacaagtggtaaaacagtaaagttccaattacttgcctttggattgtcaatattaatattcatgggaggaactttttatatgttaataaattcaagcagaaaccttgagaatggaaaacagggaatttttctcgagttagaagagaaagatataacaaatcaaaaaagcttggacgaattagataagctaaatgactcaatgctcagaatttcacttaagttgtcagaaagcaaagatatgtttgataccattggtgcttcaattaataaaattgccaaatatgtagaagcaaatgaaaagaatatgacagcaaaagaatttattattaaagaagagtcaaagaatggctttgttttggattcagttttgtttccatgtaaatatagttttgatggcccgatatatatattacttactactaccccaaaaagaattgataacttgggtaagtatttggacttattacataaacagacttatgggattaaggaagtaattttatccattccatacatttttgaaaggacaggagaagagtatccaccaattccgggttatttgcaagataaaagcagatttcctttgctgagaattttaaggggaaaagactacggcccagcaacaaaatttctattaccaatagagattgggaatattccagaagattcaggactggtaatattggatgatgatacaagatattcaagacatctagtttgtgattatatttatatacacgaaaaatttccagaagcagctttgggtagaagaggacaggcttttcacgataaatgcgatccaacatatagaacagatagaactcacagagtaagtcacgatcaaaagagtgcaaattttgttattagaagcgtagatcttctgagtggagttggaacatattttattcaaaaaaagttcattagtaaggatattttaactctaaagaataattgtcctacagaaactatcaatcatatgttctttactgatgatattttgatttcaggttatcttgcatataagaacatttcaaggattgcattttcagatgagctttcaatagaagatttgaatagaccatatttgttaggatctggtcctggagctctttgggatattaataaggaaacctttcataatgacaatagtacagcagcatttggtttatattggggatgtaggaacaaagatacaatagtaagcaagcacggagagatactttgtaggtggagaaacgaagtttga

SEQ ID NO: 2547 - DNA, 4212 bp, Cryptosporidium hominis
atgccaaagagaactaaggctttaaatagagaccctgaggggtttgaaatcccggagaagctacgtaatactcccagcccagatgcagatccaaatcacaaagaaaactggacaacttcaaattaccagttatcaaaacggaacttctcaaagacacaacttcaaaccagatgtagacttttcaaaacaataagatctgctgttgaaaatccaaaacagtcaaaaacaatcaccaattcagtattcaaccaaataagaaaaggactattagaacgtccaaatcactcatcattcatctcaagtcttaaggaaattataagactgattcttgaaggcggtggaatcccaagcgtgtttttgcaatcaatttcagattggacaggatcagattcttctgagaaatgccttgaaaacttaattattgatcttcaagataataatacttcaatactccaatattacccaattaagcccaagaaaccttctgatctttacttttgtgaaatatttactgatttctttcttggaattggtgatgtattatgcaaaagtatagtgaaagatataaatcttgaatcaattgcaattacatgtagatggattaaatccacagcgaatgcatcaatcagacctctaagacattcaggatgtgttgctctgaatggaatcttaagaagcctaatattaacaaagtttgaactgttagagaagctttctagatttaagatccagtttgaaaatgagtcaccaggtactggagctaaggaaagtctggaagaagagctttccaaaactagcaaattatgtgaaaggcttgattctattattaaagatgttgtctttgattcttggagctcaagagtacaagatgtgagtccagaaatacgcaataactgtctttgtactctttctgaaagcattctacagccccatatggccagtatagtttgtgaagctgaaattccttcaatgcttattagtctccttccagaagaactgaattcaaatcgtatccaaattctccgttcaattttgatttgcattgagactaaggacattcttaataaatgtagcgtaattttgacagatagtccttttctaagaagtctcagaaatttggtagcacttgcctcaaagcttccttcggatcctgaagtattatcatgtggagaactggcaattcgagttttaataggtcttcttaaaaacgaacttcttcaagaggagtttgttgatgagattgtggatttactttggctcggaccatcatcaccggtgattagttcccttcttgctgagtttgtagactctgctctttttgaaggtgggatttcccatgaaaatattgaggcacgagaactcattgagcttgcatgtcaccaaattgaaaataaaaaggttaaaagtttgataaacttggaagaacttaaaactcttgaaccaggcagaatcagatcagatcttcaaactttcctggagtttattcacgaatttggaagagatttggtagtccttactcatagatgtgttaatgctttttggtccaaagctccttgtgttagagattcaaaattccttgtggaaatgcttctagcaacagaatgctcgtcaagctcgcaacttgagcctttaggtgaggaaatgaggaaagttttgttattagttttacatgcaaatgtttctcgaattgaagatttattattcatagaacctgaaggtacttcaagcttattatattcaaaggctgaatctatattaactagattcagagcgtttgtagcaatttctgtgattcttgaatatatggaacctcttattcttcttcatgaacagaatactgattatcttacaatattactttcaacattctcaacatgtataagtttgtattgcaaaataatacaagataaggaaaatttaaattttatcccatctggaatgagacatttccctattaaaaagctcattgctcttattcaaagccatagcgactcaagagtaattgatggaatttgtatgactttttctccaattgccagcttagattgtaaaaatcttcaatttaatgaaaattctttaatagatattcaatcggatgttgaatctcttaataaaaagctcttggacactttctttgcgtctggaagagagttcctggcaaatactgatgggcttttgtactcgaatgtagcagaaaacacgtccaattcaaagaaatcgaagaaatcttcaaaaaagagtgaaaatgcacaaaattctgcattaaatacgatgtgtaactttagaaaagcttttggagttgtgaaataccttactaccagtaatatatatttgtcaagccaatatagagatagtttatcaacattgaaatcttcggaaatgtccccagaacagggatcaggtgttccaaaaacctttgaaattctttttgaggttctagaaagaactgaaagaattattcaactgaatcttgaccaaattctctcacaccaatgtactcaactttatagtcttactctcgatatgcttactacaggttatgcccaccttgttcaagatcttttgcaaggagtagatgttgactctattgaaaataacgaaatagacaatgaggatgaccaagtaagtgaaaataattaccttactttaagtaatcttaaagaatccacaattgaaatatataaggcagttagacataagttgagcagcatattgcttgagtctctgagaaataatatcaaacataaatcaacagataaccaatgtctcaatttaattagcctcctttctttatgttcttttcttgtaattacgggacttcagggaacaattgaaaacaacttacgagacccagatgcagattgtgagttaaagtgggctctctcagattctgaattggcattaattacaaaggaattaatttactggacttgtacaaaccgtgataaaaatgtgaataaggattttaaaatttcaagcctttcatcttctttgattgaaggatttagtgctattttaaacttttctgataaagataagccatattatttgctttatccaagttgtagaatctttgagccgctggataatttaaaagatgaagcctttgtcacaactcctgagactttgggaatttataagaacaaaatcagtgattttcttggtcatccattttctcctggttgtattcttgcaataatatcaatttcatctcagtataaaaccactctacaggtctttactccgattcttatgaattatctgacagacattgaagatgttatgattaataattattatcttgaaagccttcattcaaatttaggatctgaaactaacaaagaaaagcttgcttttgcgaataattttattgaatctgcactattaaaagaagaccaagagtgtttgggagtatttacttgtatcttgacttgtataattatttcctatatccaagataatcatacaagagctcaaaggcttagtaagaaactactcccaacattctcatccagatttggatggagaagagtagaagaaataattaaatctaacatctcagatttatcaaggtcaattcttgaatgcttgcgattttctctctttggagagatatctattccggtatttagagatatcatttccagggatgaacttattgagaaaggtattaaaactaagggaattattaaattatttttggacttcctcatgactcaaaacgctccaggaggaggaaaaaccgtgattaattcactttctgctcccgagattcaaaggattctggaacaggctaagtctctttgtggaattgatgaaaacaactcttctggtggtagtagactttcggtaatgttaaataaggagttacttgataatgatataatgaatttcttggatattatttcaggcagatctgagaagagaatttccaataaaaatcagatatccagcaaaaagtcaaccagagattctgaaaatcattcaataagtacctcaatagaaaatagcattgttgatccttcaaaatccaaaaataataggtcaaaaagaaaaaggccttctagagcttcaacatcaaaagttatgtacttggaagatgatgatgacgaggaagatgatattgatttcgatgaagaagatgatgtagttgaagattccaacttatctgagaatgagcctgagatcgagactttaaatgaccaagaatga

SEQ ID NO: 2548 - DNA, 4404 bp, Cryptosporidium hominis
atgataatagagaacttgcttgctgatggcctttgtgagtctactacaccagataatctttctgaactctctgagcaggttttggaggcatgggttatggttagtatttcagccaaaaactttgtaagtgacattaataaagtattagatggatatttgtataattcgaagatttatgaaaaagttgagacttatcgggataatatttttaatggattccaatcaattccaaaatctccagaaagcaaattacagcttgaaagattggtttcaacgctggaaaccccggaaataactgaggctttagaatgtatatatagaaatggtctttcaatacaaatcttagaaagctttttaggttattctctggattacataatctcaaaagagatcacatttttttggactactttgcttttacttggtgaaacagatacaagagactcaagaatgacaagtaatgatacaaattctgtagatgggagttttgttgaaaataaagattattctaaggatggtaagactcttattccaatggatagagatattttatcttttcatagttgtttgatttttggattggtaagattactttggaatattgttttcattctatatggagcaacttctttggttaatattccaaatatggagaggagtagctttatatatgattgcctttcgcaaaaagatcaagtatttcctaataatcttggtgaatgcccacttcgtagagtgatttatggttttatgacaaagattcgtttattattgatagaaagtattccttcagactttgacttagtattggagaaatatatatttggaataatcacttttctttctgagaagatacttaatagtgatgaattttcgatcaaaaatgatataaatcctataataatgagagaatatttgttaaaagttttaattaatgattcttgtgggaatacaaaaaaaagaatggagatttgtaagtcaagattagagaatcttcagcatatatatgaacacaaagcatccagagtattgagtttgaatggttcatttccatcgaatttggattttgagactttagaggtattattaagtttgattggttgctcaaattctaatgagaaatgcatagatcagttgaattcaagttttagtgataatagatatattggagaggaaagtgtaagacatagaaatattgaagatcaagataattgggataacaagaggattcaggaaattcttagagtaatttctcaaggcccaattatggaggatttatataaaaataatggagagaattcacttgaagaactttcaagaattcatacaacactattggacgagctgatttggttagttttttgctctatagagcaagagaaagaatatgtgcgtaataagagtagtcaaataactttgatgactagaattggagatcttccagttttaatgaaattggtgggatttgaacatttgtggaaaaaaagagtggtttacttgttaaaaatacaatcagtaaatgctgtgttatttttagaaggaagaaagacagaggaaagtaatttgagaatatactcgaaatatgttcatgaatttatgggaccaatattaatgggtctattagatggagggtttggatatattaaatctcaggattttgaacttgtagatcaagagaatgacaagagtgaaagttctggaatggctaattttcaagaaaataataatatttatatgattgggaaagaatgtgagccaatgaatagtgatttgggatttcagatgatatttgaggagttttacatggaatacaattggagtcttaaaagaagagttatagacctaattatggaatttccaaggagtaaaagttcaattctagacctttatattacaatgaattactttccaagcagcaatatattaagagatgtttggttttcggagatttcaagagagatgttaaattacgtgaatgggaaattacttcatttacatgttgatacctctataattgtaggattttatgtcaaatcgataatatttctgctaatgttagatttcccaaataaccggatggataaaactttgatcagttttggtgatgctttgaggcagagaggagatacaacactttgtatagttagttggatgccattaatgcttgagaattgttctccagcattgagtgattctgagattataatgccaataagttgttcagatgagggcgtatatcctcagttttcaatttccaatccaaactatagaaatgagtgtagaggtttgtttgaaaagtcgtttgatcagattcaagaatactctcattgttttcatattccccagatcaagttagttttgagttggatttctcgtatttatggaagtaacttaactcttctatatgattatatctataatttggcttcaagagtgataggaagtggacaagaattgggttttgaatcaaattctgtggatggtacagaaaaatgtagtctgattgatgaaaatacttgggaaattgatgagagacgcttccagaaggatgaatcagtttatgaaatgataaagctgacaattggtggaaggagtggtgaaaatttgctaaaaggaggttcaggaagctcgaaatttgggagtaaagatgagcaacaattattgaccaactgtagtataattctacaggatataaacagctcaatattagataataaggaatatagtaaatttagagaaagatctttgcttaatgcggaatccaagccaactgtgacaggatttacaatttcaagaaattactggtcagaaggcgtaattaatatggagataagagatgacacctttcctttagctccagtattggaagatgagattaaagagtacaggcaattctttgaaagagaacatccaggaagaactttcaattgtttttgtggatatggaattggtttagttgacttaactgcaattgatgggacagtgaaaagcaacatagctttgaatttccttcaaataagtatttacgactatatatcaagcaaacatccagaagatgatttggattatccagaaggtgaatcatcaaaagacggattcctggattctgataaacttttaagttcaaattctattttgaattggtttacaatcagccctaaggctacagatagatcttctgatcgtattagcaaagcattaacagacaaggaggaagttaaggtcacatttatggatattttgaatcattttaggttggatgaacagactattcgttggagtattgaaaatatgttatcaagggggattattcaaatagttactaaagaggaaggacttgagtgctttgatattccacaaacctttagcaacataaagcttacaagagaggcaggcggagaagatgaaaaagagcaaggacgagaaatgtctgtagctcggacagatgaaagttttagcttaataaagacaacagaagaaggttatggttctaatattaatgatatgacggttatgttggactttaataatatgcttaataataggaacagtaatgcctcattgactggactaaatcgtcaaagtagttctcttaaaaaaaacttcactatttcaagcttaatggagactccaaagaggacttctcatgaaaatctaggagaagcatccagtgagagagaaagtaggaggggagaagagggaacggccctcgatggtcgatatttgtcaactagacgtagtgaaattgagaatcaggatgatatgcaagagggtgaatatgacgagggtgaagaagaggacgaggatttgaatttgaacttcccaacaggaataatcactacaaccatttccttcaaacctaaagatttagcgcaggataccaggaaccaaggtccaactgcaagccgcgatggaacttcctactcaaaaaaaggagaaaacaatcctgggagttctgctggcggaggaagtcttcctccaatgattgctttttcggagacatatttggagaagtactgttactttacaacgccttctgtactagaccagcaagataatggattagactcctcttcacctagcaattccaaatctaacaaagacagagaaaacgctaactatgatattattaaagaatgcgagctgctcattagagctacactccaattaaacggtgcaatggccccagctatgctatttgcaagagttagagcagcaattgcaagtcaaggtgaggacaagttctcccaaaaagactctgacgatcatcagggctctaaaatatctacaaatactgacacacaatatactttgacatggccacagcatgtacaagctataaacaacatggttgaccgaggagaagtatacaacaaaggtggaagattgttcttagaaaagtaa

SEQ ID NO: 2549 - DNA, 2817 bp, Cryptosporidium hominis
atgagtttcgaagaaagaatttcaagtgaaaatggaggaatcgagattttgggaggtgcaaatcttgtatgtggggtaacagattctagccgtggcttagtttctgtctcagacttgagtccaaatctctctggaataaaagttcagtttggagatccctcccctatttgtggaattacggggcaggatgctttgggtggcttccaatctatcaaccaaaagaccaaaagctctgagataggaacaactttaaatgaatcttttctagtttcaatttcggagctcagatacattgttttgatatgtatccgatggagacttcaaaatagctctgagctgtcttcaaatgtaagtacaatcttgggaatcggaactgaaagttcaatagttccagtagactccccttcaacatgtggtgaggagtctataactccttccaaggagtacctagtatctaatatctttctctacagatcctgtattagcgattcccatagagtggagctagaatttcaggttgttagagatatcttgaggcttatagatccaacagtcgagtctggaggccgcaatttctctggaaggcttgtcaatagtgccaacagaaacattatcaaggaacttgctggagggttggattcccaggaggctaatgaaatgagaaatgctgagagtgtcttgagttctcaattccttctgagcaagcttccatttcccaattatgggacttttcttggtaaggagactgctgagtacacaataggtgatataatcaacactacggaacatccaactggacttaatctggccaatgttgccagtactccctctatattgggagttcttctcaagtactttgatgtttcctggccgagtcatatatttgaaagtcttcttaagagtgatgtggttggaggcggatttcaacaagaagacaatattagttcaactgtcaaggattctggagacgtttctctttccttggggtcttttacgcacgttttaggcttatgtaagccttgtgtttttgtcaataagaccaataagaagtgtagaaacggtgtgcattgttgtttctgccattttcagcataaagagaggaagagaggcaagaggtataagtcttctgctaactgctcctcgacatctaattcctgtaataattctggggctggaacaggagtatgtttgacttcctcttcagggcatccgagccattccggagcaaacaattctggaggtattgcaaataattttgaagaacttggaggaggtattgggaatacctcaggatttggagtcgcatcaaatggggccggtatactaaatgttgagggcttctccaaacaggatatatcagctttagctgaagattgtctgtgtgtttcctcaatatctccagcatctataagagggccccacaacatgtttggatctaatcgctctgaactgtctcaaggagcagtggggcttagttctattcagcctacaggtatgacggcgccttcaggatcacaatgtctaccagatgtactcttctctcactatggatcccaacagctccagaggtaccctttgaaagctaatcagggcgctaacaaccctctaacatctttccaaacatcggctaggagcaattctgtctttggaaaatcgtcttgccctacgggaagtgaacagcaacagcaaataccagttagatatcttgtacctcctccacctccacctccttccaagacatcaggccctcttcaaatatttcagaatgaaaagaatatcaatttccgagataactcaaaccctgttgcaacatcgacttcggcagggtttaaccaactcgggacgaattatcagaagggtagctctgacaagcattcaatgaggattcctggattagtattggattcatgcccattccaaagctcccaaggagcttctcagtcctttaatgactcactttttggagattttactggttataataagttgatcaatgaggcttcggagatgaataactggatatcagctaataacccggagaactcgtctaatgctataaatcaaaactcaaaggtatatggctgctttcagtggctcgatcagccagaaattggtgaatccatagtcgatgcctggggagtaggaaatacctttgagtcatttataaaggggaatggtgccaataccagccctcaaaacttgaatcaatgtctttatgattctcattcattttctaaagctgctcaagattggacctttgcatcatctatcatcaagaattcttcaataaacgcttccaatagtgcttcagagtcatcttttactgttaataatcataacaacctagtaaatccaaattctgcgtcttctctacagatctccaccagccagccctcttcccagaagctaagagagtctattatcggttccccattacacctggaggctagcagcattaatttccatgaccaggctcaaactcaatctcaagcccaggttcagagtagtcaggctttacctgaacttgctgagggagtcccaaatagtcataatgactactttttgagctcgcctagtttatttaattctaatgctacaacctcttcactcccatcatctctttcagataacaataatatcaacaacggctctttcattatgccgagtggaagtgtcattcctccatttttaagaggtagccagggagctggagtttcttccgaatactctgactgttctcctttatcctttttaacaggaggaggaggagcaactaactttgggatggatttctgtttccttaattcatggaagtag

SEQ ID NO: 2550 - DNA, 741 bp, Cryptosporidium hominis
atggaatcattttttgcaactaattcaagaaagtcccagttcagtggaaacttttttaattcatcagatttgacttcaattcagcaaacccacttgttaaaaatgtattcctctattattgctggttcatttatgacagtatttggggtgactgcatttattaatggaatgttaagaatcaactcatttgttggtcttttggttggaattggtgtcacattctatttgacagcatcatcatctaataagagctctatttccattaaacgtttagcagcctatttgttactatgctttgtaattggtaatggacttggacctttgatcctatttagtaactttgttaatcctgttatcattcccacagctcttgcaaccacatgtattatctttatttcgctatcttttggagttttattcactaagaaaagactttctctatatactacttcttttattttcacaactattgcatatcttggacttgtatcattctttaatatcttcacaagatccaaatttgttgattcacttttatcctatgcttttgttatggtttactcattttatatttactacgatacccaaaagactcttgaagctattgcatatggtgagagagatttccttcttcactccattcagctttacctcgatgctgtcaacctctttactaagattgtagtcattctaatcagaaaacaacaagaagaggaggaaaaacgtagaaagagagaatag

SEQ ID NO: 2551 - DNA, 1131 bp, Cryptosporidium hominis
atgtcatctaatagttgtactgaaactatccccaaatacattttgaaaggaagtgaagaaccattgaaaagatcaaagttaactttagaggaaagacacaaattatgtttatcagttgctgaagaatgtattcaagaagcagaattgttggaattattaaagagaaaagaacatccaatttgttatgatggatttgaaccttcaggaagaatgcatattgctcaatgtatattaaagactattaatgtaaataagttaactgaatgtggatgcgtttttgtattctacgtagcagattggtttgctctactcaataataagatgggcggtgatcttgaaaaaatcaagattgttggtgaatatttcgttcacatatggaaggctgcaggaatggatatgacaaatgtaagatttgtttgggcatctgattttattaatggggaagattctaatgagtattggttaagagtttttgatatttctagaaagtttaacattactagaattaaaagatgttgccaaattatgggaagacaagaaaatgatgaacaaccatgtgcttcagtattttatccatgcatgcaatgcgctgatatattccaactcaaggcagatatttgccagttaggtatggatcaaagaaaagttaacatgcttgctagagaatactgtgacgtagctggaatcaaacaaaaacctgtaatcctttcccataagatgcttcctgggttgcttgaaggacaagaaaaaatgtcaaagtctgacacttcttctgcaatatttgttgaagatactcctgaagctattgttaaaaaaattaaaaaggctttctgtcctccaggcattattgaaggaaatccatgcattgaatatattaatactctagtattccccaaattcggtcatttccatgtttctagaaaagaagagtatggtggtgacatcacctttaccaataaagaagatttccataaggcttatcttagtggcgatcttcaccctggtgatttgaaaaaaggtctttctgacgctttgaaccttatgttacaaccaattcgtgaccattttaatactgaccctagggccaaagagcttttacagcttgttcagtcattcaaagtcaccaagtaa

SEQ ID NO: 2552 - DNA, 888 bp, Cryptosporidium hominis
atgcaaaagtcattgtctatacataagcataagatggtgctaaagttattattaatatcacttttgggattattaaatattattgtgtgggccaatggagaagaacgagaaccattttgtttggagatttacgacaataaaaatgatgaaaggcatcttccatactatttcttgaacgagttcccaatctgtaaagagcatgaaagacgaacttgctgtaaaaaaagtcattctgaagcaatttcaagacttttttcaacattagtagcaagatcatccctttctaccagatgttcaaacttttaccaaaagtctttatgttcatactgtgatgcagatataggtgttggaaaaaaagttatacagaaatccccaatcctttgtcaatcttactgtaacctatggtatgatgcttgctacgaagattactttgataatatacaaaactcctatatacgaaatattgaagatatatcttttattcgattaaatcttattccatgtacggattcatcagctatttgttctcctttacatgcaattacattagaccctacagagttttgttccttaaatgggttctccactcatcaagattttcattcgtcatcagggcctgtaagtctcactgagtacaatacagaatgttttaatggtattccggcagcttcggttcttaaacctggaattagacaaaagacccaaagttacaaatataaaagatcgcagtatagtaaaaagtcaaaggctaaaaacaaattttatcaaattattcaggatcatattaacgttttcttggaaaacattaaggttcctttacccgttattgtctttatttctatcatttcgatttggattattaaccaagtcataaacttttttatttag

SEQ ID NO: 2553 - DNA, 783 bp, Cryptosporidium hominis
atgaaagatattaaaaaagtcgctgaaaccattaaattattggttgcatatagggaaaaaagtgtgagaatatttggggatggacttgacttaagagctccaattcagccattatttccaaccaaagctgagaacatttctggaacagagaattctatatccagatcaagcttagaatcaaagaccattacaactgatgctgctgatttgttgaatgagcttgcagcaatgcactacgaatgggcattggataactatgcaaaggtaagaactagagaccatcaagaacaacagaaaaaatgctcagctatccaaaaggaggaaatagcagctccgagcccatatttgagctacttatctagccaatacgatggaattgacagtccaatcgtgggtgagatacttgaaaataagcatggatatattgtaatggaatgtattctactactacttaaccaaaacaattctattgagtatggtacagagcattttaaaaagtatgcaagtttaatgcttcttttaagtgatatacttagatgcatgaagagacaaaaatctttgcattgcgatacaatggacttccatgtactagtggatattttattcagggaaatggttatcatgagagactctggttttgcactattcgagtacgtttcatgcctaaatatagttatcaaatgtattgcttcaacaaaggaaaagtatagatggggtgaggctacttcccttctttcagttacagaatctcttattgaagggtttggggtttcatctcaatga

SEQ ID NO: 2554 - DNA, 2241 bp, Cryptosporidium hominis
atgacaagtaataataatgtagtaccggttagtgcctccctttatgtgggtgatttggatgcagatgttactgagacaatgttatatgaaatatttaacagtgttgcagttgtatcatcagtacgtatttgtagagacgctcttacaagaagaagcttgggttatgcttatgtcaattacaatagtgtagcagatgctgagagagctctagatactcttaatttcacatgcatccgtggccgtccatgcagaattatgtggtgcttacgcgacccagcatccagaagaaacaatgatggaaatgtattcgtaaagaatttggataagtcgattgataataagacactattcgatacttttagtctatttggaaatattatgtcatgtaaaatagctaccgatgttgagggtaagtctttgggatatggtttcatccatttcgaacatgcagacagtgctaaagaggccatttctaggctaaatggggctgtattgggagatcgcccaatttatgttggaaagtttcagaagaaggctgaacgtttttctgaaaaagataagacattcactaatgtctatgttaaacatattcctaagagttggactgaagatcttctatacaagatatttggggtatatggtaaaattagctcattggtcctgcaatccgactctaaaggtagaccttttggttttgtgaactttgaaaaccccgattctgctaaggctgcagttgctgccttacacaatgctttagttactccagtaggagttgagttggactctacagcagagacctcagctgataacgaagccggagctgattctgagacatcatccaaacaagaatctggagaagcttccaataaaaaacaaactgcatctagcgaaacatcaaaggattcctcaggaacatcaaacgaggaatttgcacagaatgaggatggatcagctgacaagaatgtttcagctgatgtacaaccaaatagactatatgtttctagagcacaaaaaaagaatgaacgtcaggtggtcttgaagtctcaacacgaagctgtaaaggagagccaccaaagataccaaggtgtaaatctttatgtaaaaaatttggcagattcaatcaatgaggaggacctccgttctatgtttgaaccatttggaacagtatcttctgtaagcattaagactgatgaatcaggtgtctcaagaggatttgggtttgtttcattcctctcccctgatgaagctacaaaggctattactgagatgcaccttaagcttgtgcgcggaaagccactatatgtaggccttcacgaacgtaaagaacaaagagcactacgtcttcagcagcgtattagagggggtgcagttcctccagttttaagacccggagcaattcccccaggccctccaggagtacatggagctcccatgcaatttggtgtaccaccacaaatgtactttattcctggaaatccaaatgttgcagcaactgctatgccacatggaagagcgatggttacaggaggtttccctaatcaaaatgcaatgaataatccatggagaccgaatccaacaagaatgccatacactgcaggaggcgtgcctcctcagatgacaggcggtcctcaaatgacagcctataatggcaatgttatccaacaaaatggagtatctccaaacggagctgctaatgctactgggtctgtccaaaatggagtcaccggtaatgcagttccaggagttcaaggtgctcaaaataacagaaccggaggaaataaccagagaattcataatagacatgttcaaggtaatggccaaggaggaagaccgggctcccatggtcatcaagttcagcaaatgcaaaagcaaggattcaaatttccacaaaacgttaagggatctgaaatgcagcgcgtggatatgatgcaaaatagacaaatggatccatcaaacggcgcacttgttcagaatccattaatccctcaaccagatgttcctttaactgctgctaccttggcagctgcatcccctagtatgcagaaacaattacttggagagagacttttcccaattattgcccaattccaaccagaattggcaggaaagatcaccgggatgatgcttgaaatggataacaatgaattattagaacttttgagttctgatattgaaatcaaaaacaaggtagatgaggccatggtcgtacttgaacgtgctcagcaacaaattagcacgtaa

SEQ ID NO: 2555 - DNA, 1284 bp, Cryptosporidium hominis
atgagtcagggagtaattttggaaatgattccaagagtagaacaaacagaaaatgtaatcgaagaaaaacctattgaaagtaatgatgctgacttagcaaaactaagtaataaaatctttggtaatgaaatggctaatgttccactagttttcgatgaattcccagtgacaaagttgttactcagcttttttgtaatactatttatatgttttggagtgattgacatgattctaggctttattaggcttggattaatgtcatttattatttcaatgtttgtgttatttttcagatgtggagaaagaaatcgtcagcatagttccatttttgtactttttattgtagcattgacctcatctctaagttggaattccatatcaaattatatattgagaaatgaaggaacactttttgaagagaaaatatacccactattgattctcgagttttcatcatcactatttttaacactttggctaatgctaatagctctttctggttattctgttaagaatcagcagaatatttatatcgataatcaattgtacagaacaaacacaaatttacgttttacagcattatccgcttttaactggtatctaatttcaatgggatttgaattttcagttcttgtgttatatttattggaaggattatacatagtttcaatcattccatttataagtttgctagtttcaatgttttatgtaattagcaaatccaaacgtattttacaatattcagaaatctttctaccgtttgttatgttggcatacgtaatacttagaatgatttatgaatgggtagctcctgatgactattcatctatgattggagcctatttggtaactattatggtctttaaacaggttgtcggtctttcaatcttatttatcccaagcgttaactattatgacatgattaatgataatggttcatataatgtcactattgttgtttcttttaagattcatcaaaataaacaagaaaatgctgttaagagtgcagatattattgatatttcacccacaaacagagtaattgctgaaaatcccgagtctgaaaatagggaagaggaggctattacagtaattcaagtctcttctaacgaagatccggaaggattgattaaatccgttcaaaatgatcaaattgagttaaatagagaagcatttgacttagaaacacaaaaaagtcactctgcagtagaggatgatgcagaagcaaatattccatacgatgatgagtctttaaaaattgaaataaatagtaaattaaattaa

SEQ ID NO: 2556 - DNA, 729 bp, Cryptosporidium hominis
atgaatagaattcggaatgcagtaagattgaggaggaaagagtctcaagagactacaggaaagaagagtgaaggagaaataaattttcaatcggaaaatagtaagggtttaaatattgtggggaaggaaaattcgggtgaaattggaattcctgaaattttgagttatttccctgagctatatgttgatagctcgaacggattttccgctaatggaggaggagttggacaaatgatttgtggaacaatatcatccttcttcgaggatacttggaacagagcaatgtgtgaaatgaaacaggtcaaatcaagaaatatttataatttatcatctgatttaagtcttggtattcatttgaaaagagaatggcatcgtttgtggcttgtaagaagctttttggcattcgcatgggagagttatcttgaagacctgatgattgaaaatgataagtttcctaaagaatatttgaacctccctagttatggcactaatttggagggaattggtaagatttcccttggtgagattctttgtattgtaagtagcagcaaattgacctattctgaaaaaagtactatttcaatcccattttctacaattcaaggcaagatgataattaaaaaatcactaagttttaattataatcttcattggaagacccctactcctaatacagttgctaaatttcgtgttcttgcagatcagaaaagctaccaagacaaatactag

SEQ ID NO: 2557 - DNA, 864 bp, Cryptosporidium hominis
atggataataagaatttaaataccccttttaagattttagtaaagttttcaagaagtagcgtgacaagttcaaaaataactttagtagctttagacaaagaagattcaggaaatacagaagaaatagttgaatggaaaggagtgtcttttggagaagctcattcaattgctttggatacaaatggacttgtttgggtatggggccagaacaatctcaaacaattaacgggaattccagaaatacttgagacagaaataatgatttctaataatataatttcttcagattattataaaaaactatgttctcaagtcattttcccaacccccttggtatctacagaaaaagtagtggtttttgcttccaggaagattaacatgatcttctcaggaagtaatacttgctgtgctattgatgagcaaggaaaaccttggatatggggattaagtttttcaggaatagatcatcataacgttaattcaatattttcaaggaagaatacttctggttctactgaagataaaaatcttattgaatttgagtttcctgttcgggttttcagaaatattactccagattatgattcaattagaacagtaagatttggaaagggaaataacaatatttcaatggtcagcagactaggaagatgctatctttggcttgaaaacaaagatttagttactgatcaaatgaagtatttgaataatcataactgttttattctggaagacttacaaagtattagtttcagaaataaccatttaaaaaattctcgtcatcattcaattcttgacgtagctttactttcagattcaattatctttttaaccaagaaaactaacaaagacaaaaacaattaa

SEQ ID NO: 2558 - DNA, 1305 bp, Cryptosporidium hominis
atggaagagtttcaccgtattccgatagtaatagtggaagatgaagatgagttagaacggatagtgaatgaaggcaagaacaaattagaggtacgagatgaagatgaggagaaaaagtcacgtatagatccaaaggatttggcaaatcgaatgaaggagaagggtggacaatgttacaaagaaaaaaagtttgatgaagctttagggttttatttgaaagcattggggattttggaattggaacagagcttgaaagaaaatgaagaagattttgagttgttgatgggagaaattgtactaaggagtaattgtatagcttgttatgtagagaaaaaagattttgaaagagcagtttctgagtctagaaagttactgaaatatattaacgaggaaggagacttttatttaaaaaaaaatggagaattaccaaccttgtgggtgaatattgaaaacaaaacaagatatagactatctatatctttgtataaattatttggatgtggtgatgttttctctgatgaaagctcaaaatcttctattaacgaatcttttgaaatgattcaaacagttttagactactaccaacattggttaaaggtatcaccacctcacgagattactgttttgtactctaaagtaaaaagagttatagaatctcagaattatgaaacaaaagaagttaattcatcactcgaaaatctggatttcagagacaaagaagttcaatctcaaactgagaaacaagatgaagaagagatatctacaaaacaaaacgaatcacactatctaacatcctacataacatgctttttagaagagtactttgaagaatctggctcttatccaaaatctattaaatctccaatccaaattgtagacaaaatgaactgtaacaattcaatagaattccttcgtatatggcaaaacatctatcgaaacgaccagtttattgattactacttattttttagtcatatattcacaaatttggataaaatatataacaagacagaaatggaagtcaatatattggaaaaaattcttgaaaggatatccgttattctcgatgaattgttaaagaatgcttttcaatcaaaacctaaagagaaacttgtttcacacatctttaaaattattcagaatttgggaaaaacaaagagatttgactttgttgtattaatgcttaatgaaaactttcaaattttaaataagatggttcagttcgaaaattatttaagtaataatcttctacaagaaattaaacatttccaagaaaatcaaacttccaaaggaatccgaatataa

SEQ ID NO: 2559 - DNA, 3075 bp, Cryptosporidium hominis
atgaaagtaaaccgattattttcgcctataggcatttttattgccattttacttgtcaatactttcggtccaagttactacatgggactcgtagatgctgctgttgcttccaagggaggtgttaattttttctctattctctcgaggttggtgtcattgaagaactacatgaaacgtcttcaccagaataaggcaagacatccaaataataaaaatatcacttcagaaatgttaagggttcaaagcgaaatcaaggaacttgagaaagaagcagagaaagagtttggaggctctcaagcaaatacacttttaaataacgcagaattacgtctttctggaatggatccaaatgatccaatctctgaaccaaaaactgatccaaaaggctcaactgtaccatcccaaactccagttcaagcaacaaaagttgtggtttcacagccacccactcaaacaataagctcagtcgcggtctcaactccaactccaactatatcagctccagctgtaccagtcccagatccagctgtaccaaccccagttccagcaacaagagttgtggtttcacagccacccactcaaacaataagctcagtcgcggtctcaactccaactccaactatatcagctccagctgtaccagtcccagctccagctgtaccaaccccagctcaagcaacaagagttgtggttccacagccagacactcaaacagcaacttcagttgtagtcccaactccagaaatgttaatctcaactccagctgtaccagtcccagatccaactgtaccaaccccagctcaaactccagatattgaagttggttctcaagatcaagaaggtgaagctgtgactactccagaatatccaggatctttggacattccagaagaaactggtccaggagattctccaaaatatgagactccaggttcaccatattctccagctcaaacaccagatcaatttccatttggcagtttctcagataattggaagtcagaatttgttggtaccaaacgatctgattttcttaaatttggagttgatgggtctgaatatgaatcagatcctgctgctaaagcagccttttctaggtatattcaggctacttccaatggagtctctgattttagctcttccttaaggaatttattggaatgtaaaatcatctctgagagacacattattttcttgcaggctttcattcatcatttctcagccttatcaaatattcaactgcaacctgaattatattgtttgttattcacaaactcaatgaggccaagcattttctcgtttgtctcaaatttgaggaattatttgagcaacaaaagatatacatttgatgaaggacatttagctcgatcagtgaacattggattgaattatttagcaacgaggacattcacaaggaaagaccttacagttacaggagttaagaagcttgttaaagaaaatagagaattggcattagaatgtgatgctgataatgtcatatttgctacttctttattgcttttaacaaacatttattcagataatcttggaatgagctcccacatcaatttggccgatatttgtagtatactcaaaggataccaagacttagaatcaagagtacgtgaagttgtttctctcttttacagagcaggtgctgttgacagaaactcattattcgatttgtcaatcttggttaaagaatctttggaatcagcatacagagctctttcaattccattctcagattacttcttagacactgacaaaaaaactctccagagtcttacaccaatgagcactactatcaatgttgatgaaattattaaaccaatcgatcatgatgatgtgattagaacttctgatagatatatttctggtaaagttccaattccagagattccaggtccaccaagtcgtcgtggaagcggtcctatttcagatagagtcattccaatttcaactgatgagatctttaaaccattaagaacttccaaagattatcaaccatttaaaaggggtagtctattacatccacctaccccagagaatctccctgataaagcttcaggcagaggatttgtaaaatctttacaagttcatatgaaaccaagagattatgagactgaatttatatatggaagctcagggtttgttagtcctcagttaacttactttaagagagtctcagaacgtgaatataatcatgataagaaaattaaacaagccaaagaagaacaaaaacgtcttgaaaagaagagagaacagagaatgacacgtggatacaaggacttgagaggagttaaagaattagatggtggtgacgaaagtgtttcagaattaccagatatttctgaagagccttctccacttccagaatttgaagagccagaaagaattgctccatccaaatttgaaactaaattacataagcttgttccaaagagtagcagtatttacactcaaccatcacaaagattccattcaatgccattagcatataccactttgaaaccaacgaagggaatgcttagtactgagagtagattgaattccgatttaagctctgaattagagttggatgaagcttcagaaggaacaattggtcttccttctcaaaaaggagatgatactgcggaaaaatctcatgaaggagatgtttctatttctgatgaattttcaaatctatcgatttcaaagtctgaaaaaactcttacaactgaagttgctgctagagaattattaataaagtgcccagatttatctagatcacaaaagaaaagagctcttagcttgtttagagttctcaaatacctatataaaggacatactactggttggtatataactgcattctgtagagctgtgtactttgcagagaaggatgtatgcatttctagaggagtaaaatctttaaatattaaagaaatggcatctgagtgtttcaatgctttaaatagctctccattcattaaaagaaatgcagaactttcaaatctaagtcgtcaagtatgttattcatattacaagaagagagcagccactgtttgtttggggcaatttcaaactgaatga

SEQ ID NO: 2560 - DNA, 423 bp, Cryptosporidium hominis
atggcaagttctttattggaaaatgatattattagtcaaaatattggaaatggtctcatttcaaagaaaaagagtaaaaaaaaactaaacaagttctcaaaatcaagtaatagtgaactagaaaagcaacaaaatgataaaaaagaatactatccaacaaaaaatgtcatgatggaaagcgaaaatgatgatctaacagatgaagaatttgaggaatatgaggaatacgaggaagatatgagtaactttgattatttaaaaatcttcaaaattcccttaatattatttattctttcattaattagtgttttatttgtagatttattcggaaaagactatcttgggaatgaattagagaatggaatatataatatgattgatcctaattatgggtcttttatttggaatctttcaggtaagtaa

SEQ ID NO: 2561 - DNA, 1800 bp, Cryptosporidium hominis
atgattttcttattgacctgtatatatttatttggcattactttgctagaattcaaggtcaatgcacagaatatattggatgattgtgtaaaggctgggttggcaagctacaaacgacaaaatgtatttcaaaagtttaggttaagacttgatgtgtcggataatatttcaaaatatgaaaatttgttgaaaaactataatactttggatgagaatatttcttttattgatgaggaatatcttcaagacatttcaagatttttatttgacaggaatgaaattttgatcgattatttttgggactcaatgatggattctctgcctcctacttggcatgtatatggaataaggcctatacaagcttcaattataaggactaggttcatggaatcttgtgtaagtaatatatatagtttatataaagaaggtaagatagagaagtttcatactgtaattccgaaccttaaggatgcaaggtatcttacttcaggtaaggtgaatgaaatctgccgaaatatcaaaggaaagattgagaattttggttttgagataccacctgtaattaaaacaattgggagatcaaatttaccagtatactacagatgttcagaaatccaaagtgacgaactagctgacgttactatctttattctagacaagaagattccaaagttcaatattccaaagcaaaaaatttgtgaaatagtgaatgtaattatcagagaaccagcttcattccataactcttgtcttggagttttgtcttttggcttgaggggatatcttcccattggcaatgaaactagagatagcttggactttgcctgtaaaattatggataatattagaaaatatacaagattattttccaaagagccgatacaaatgcctaacaaaaacattaaagacatcattgttgaaagtttattgagaatttatcctaacattgagttaactggtataggaatggagattgttgaacaaatgaagattagtgaatacagattcatagaaagttgtacgaacttttcggaaactttatttgcgttgcaaggttttaaaatcattgaaaaacaagtttctaaacaaaaaagcgtggagacaaatggttcatctgatgaacagaaggaagaagaggataaggagattgataataatattgctcatccatttgaggaggatcctagagatctcaggaagaaacttttactagcttgttctgggattcatatgcatttatttgaaattaaaccaaaaggagtatcatttacaaaattaataaactcgaggattattgttcaagaagatttttcaaaggtttcaaagtctaagctactttatcttgacttgtgcgacaataaaaatgcaatgattttgggtaagcatagtattacccaagatactttggctgagattattctctcagccattttacactcctctagcaagtcaatgagctctatagccctttataatggatttgttaaggaatatatttgttcaatttctggagaaatcattggttcattgagaaataattttgaaacattcccaaaattcgaagaaactgcctttatgaacagttgtagacaaattatttctgaagaggcttttccaagacaaaaagaaaaatcaatgaattttatgctcaaaaaatccattatcaaactttgtagtattgttgtcaattcctttatccaaatttctcagttactaaactcaaattcaagcctcgataacatcaaaggccaggatgatgacgaattaacctctagtgagtatttaagcgaagagatctaa

SEQ ID NO: 2562 - DNA, 1953 bp, Cryptosporidium hominis
atgaataagaagacttatgttttgggagcaattgggtgtattatccttgctgttgggggagttcttagctctgagactgatttatatgggtctgaaattttaggttctgctggtgaaaaatcttcaatgtttccaagtaatgaagagtcaacatcagcttctggagaagatctcgcaggtatttctagtgactcagaagtaacatcttctttgggatctggtattgaaggttccaatttggatatgagtaaatcacaatcacaaggtgatttgagtacttccgtaggaggaattgctccccattctgattttgttggtggagatgttagtgaaggtcctagatcatcatcagcatcttccattcaaccagatattactgttgaaccatcaacttctcaacaaagatctattggatttgttgataaatcaactgatgatgatatttctaagcctgaagagaggtcttcaaggatggaatttgttattacaagaaatgcagaaatagcaattgaaaaccttttcccatctttagattctgccaatattcttacagttagtgatatctccaagtatccaagtgttgaacttaatgatgagaaggtattggaaagtcaacttaataagaaaattaattattataaggttgagcttccaatgacccacgatacaatttctggactctctactagtgatcctagagttgaaattggagtaaaatccaagtttgaattgttagttgatgaaaatcagccacgtatggaacgtattctaaggttcttagactcaaatcctgttgatttagctggtcaagataaattcgatttagctacaatattattctctgtagttgcttatggagaatgtattaaaagattgaatggaatcaactccgctttagatgttcttgagatttgtaaccagctttccaaagaagatgtccttacaattcaaccagaagatctaccaaagaatgtacttaaagagaagattgaactatttaagcttactggaactgttatatccattcctttacctctatttactgaagcttcaaacttgaagtggaggcatgtttcaaactctaatggaatttaccaagtatataacagcggagcaattgatggttttgctcattttgatttcctttacaaaaagctctacgatattattaataccattcattatccaggattccaatttatcgatgatgttagagtagatttgtattatggtatgaaaggaattagacttcaccttggaaacggtgaacaaaacagaagagtcaaaaagaatatttcaaatatcatggaattttatgatgattggtataaaggaccaaaatccaagagattatgttcacagaattactataattctttattggctgtgggaccaatatatgatgctgttcacgaaatgaccaagattcttaaatctatacaagatgaaatggttgccaatcccagtgttgttgaagaggaatttaatggaatcccaagacaatcactttttaatatacattttaacgaaagaaaattctttactaataatgttgttccaatatttaccaatattaacgatgcagttaaagcaggcaatgtcaagccaattagatctgaaatccttcgtattcttgcaattcttgaagaaattgaattcaattctaaggaagttatcaaagttcttcaagatcttaacaaatgtattaaaacttccggacataactttaattatgagctcgggtatattaagcgcgactattacaaacttgttaaggctgtcaggaaaatccatccgagacatcccttccctcttccttccagtccattatacattaaagggaaaaagttcggaatcaagaatcttttcagaaagaatgctgctagagccaaactcggatactatcgagaaattaatcctttcaataagtccgagaaaatttcgaagaagtaa

SEQ ID NO: 2563 - DNA, 4293 bp, Cryptosporidium hominis
atgaatccaaactgttctatattgggaaatgttctttataatgactcctcagtattaaaaacaattacaggaaaattcttcccattcaataaaaatagacaatctcttgatatttccacactaaaatataatgaattaacggtattcagtgaattcattccatcaaataatgaagaattagcatcaataacagttaaacttgaagatacttgtgttgatttttggaaatactcaattcaagaaagtcaatttgatttaattttagtattggattgttctcaaaatctccatttattttctttgaaaagtgtttctattcctcattccaagcatgattgtccttatatctcatataaaattccaaattcctttagtgcatttccaacaagtaacaatacaataattaaggcccataatattaaagaaaatgaaccaaatatattcagcaaccagcttttaataaaaaatgagttttcaatttcactctccaagaataagacaattccaaaaattaactttattagaccttatgaatacagtaaaaaatttgtcaactccttccctataatctttgaaaagctaataccagaatattgtattgcaatagacaatgatactggatatattattgtttgtatttcttcttattcttttcttattgttccaagtctaaaagtaaacaaaaatggtattattgaacaattggagttgaaaattcagactgataatctcttccattttgactcgcttaaatacaaacttgaatgtatttcattttctaaaacatgcaaaaactacacaaaaatccaaccaattgtattttgcctctttagtgacttaaaaaaccaaattctatatggaaaaactttcttttttgactggaataacttacttaaaaatcaaattaatcccagggataattatcaaaaaccaatatctgaaactaatctgattccattaataaactcttcatccacgtcattttctccccaaatatatcacatgcgcattttttgcacacatataccggtaatccacatgaaatcaatacacgtaagtgtggggaggtctataaatgacaaatcaataccggtgcttgcatgtgcaagtacatgtggatataagtctggttttattaattctgggtgtatatgtagatttagaaacttgttgttaatatttaatcatgaaaagaatgaattaaaattaattttatgtgaattagatgctgaagaatttaatgaggaaattttgacagtaaatttaaatgaatattatcaagagaaaatttatattgatttaagagatgtcgtaatcattgaagaaaatgttaatgaacaaagaattaagtttctcatttcttcaaaatgtatggaaatgtttatattaaatcttcagtttcaagataataagatgaaagaatttgatataataaagctacaaatcaattctccaagttttgaattatcagatatttcaagtatttctccatacttgtattataatgaagaatgtctcattgtaaaaagtattatagtaagctcaacttttggtgtaattaaaatgataacttttccaaattttaaacaaaaatttatttttgctccaaaaactcttgaaattttgaaaatggaaaaggctattatggctccaaattattttgataataaatttatattagcagccaaaagatatcaatgttactttgatcaaattaaaggtggatattattttcaatatgactttgttttaagatatatatttttaaattcattaaagatttccactatagcccaatttgattctttaaaaaaaggagtatttgaaatttttattatacctatcgaaaaaaacaggtatttggttgtttattcaaagttccttgaaagccaaattgatttacttataaagcaagaatccattcctgaaaataaatattatttaaaaaaaattcaaattagtggttttttaataactggtcattcaactattttatgtgttaaaatatgtcataatttaatgctacaagttacagaatctcgtattttattataccagggaatttctgaacaagttaaagcttttgaaaatcaaaatcatattgatcattttcaaccgaatataaaagatttatgggaatatcctgatttaattatgtatgctaaaatggctgatgataatcacttaatgattattactcaagggcacaaattaattcagttaaaaattgagtcttttcaactttttcattttgatattaaagatgaattaacttatatccctattatttcatcatttgaatccaaaaaattaatattaaataattcttctcatgtaatactaactctaattggagatcctcatggccaaatatttgcaaatttatcattaatacaaaatcctttaaaaaatattaaatctagcttcaacctgaataattttcttgattctgaggttggaatgatcacttctattgaatttgacaataattttcatgataatatatatattacaacaagttttggattcttatgtatttttagtttaattcagtttacacaagatttatttcaagagaagtttcaaacaaatcaaaccaaatacaaaaaaattataataaatttaaaatctcatatttcttgtcaggaagtctttaatttgaaagttattggaactcaaagaaaatacatttttaataacaatcaaatatggaaaaatcgtattattttaggatcaatgactgattatttatatacagaattgcttgagacaaacgaaaaagttctcaaaattctccatattaaaagattaaaatttcctatttattctattattacccaatttactgaaaattaccaagattatgatcatctttactttttatctcttcaaggtcacgaaaatcaacatattaagctagttaatgtggaattaaataaacttcaaagttgcgacaaagttttgcctttgaagagtactcgtcataaagttgaaaatatgatttatctaaaagaaaactcttggattgttattaatattgagaattggagtccaggctcacactcaaataaatgtcccacaagaatcacctcgcagctttttctatttgattcagatgctaatttatgtggatccaaaacttactctattaatgataatgattcaaacttcgaagaaaatttcagattcaaaatatttccaaacaatggaaaagatagcttttttcaggtttttaaccgtggtgaaaatcaaaattttataccaaatactatttttcaacttatttcagttcacagtaattctactaatactcacaaatttcataaagatccttttattgtctcgggaagctattctttccagggagttgaatcaggccttatttacagatctccatctgatcacaaaaagttctttttttttcttgttgagaaaaactttgatgctgacaaagctttggagctcgtttctacaagagttataagctgtttggatatttcaaaaattaaaagaaattatgattctattaataccgatattaccacctattctcagtcaattgatcacattattgctttcgggaacaaattaaagttgaaagttgcagacttttctatttcttttcccaacatgctcatccataatgttacctttcaaaatcatgcaagaattattggaattgatctattggaatcaatttcagacttatctaaaaaacaactcatttttcatcgaatttatttcgatttaggaacatatccagatcgtaaactcactcaagtcaagtatcaggataattttgatcacttttaccatctagattttcctattctagataataaaatagttaaagacaagcaaattcaaatttataaaggggtctcaaatcaaatttctctattaagatatgaaaattctctgaatcaagattctaaactattttttattggactacaaattatattaaattatatgtataaacgaagaaacaatgaaataatttctgcatttcctgcaattattacaaatctactttttgggatattcgatattgttttttccaacaaaattaaaattaactcaacaaaaagtatttcttctaactctggtgccttcttttccaaaaaaaaagttaataaacttgataaaaaacaatttgaaaatggaataataaatactaaaatttccttatatcaaatttcatatctttattttcaagtatgctctaaatgtattaaatggaaggttttaatggtattaagttgtttggtacaatctaattacaacatttaa

SEQ ID NO: 2564 - DNA, 237 bp, Cryptosporidium hominis
atgggtaagggtggaaatgcttgtaagagaaatcaatgtagagaaagaaaggttgctaatggtgctaaggagagtaaatctcagcttaaagtaaatgctgaggcaatgagtttgaagtgtcagatctgcttacaaccttttatgaaagttcagactgggccgttacttaaacaacattgggaagccaaacatccaaagaagacttttcaagaatgttttccagggatagaactttga

SEQ ID NO: 2565 - DNA, 417 bp, Cryptosporidium hominis
atggattttactccaaataaaataaaatcagaaagtaataatgaagtaagaattattcatgtaaataatttagaatccaaaattcccatagaggatgaatatttgatttattctaatttaccaattgaagaaacaattaaatcgttcaaagaacttgaagaaagtaatccaaatccaaaggatatattcccaataatgattgttggaacaagagttacaaatgaaactgtatcaattgcatcagttatagtatcttacctcagaaaaatgcaaattaccgcaacacttatatttactcttaaccaaatagggcttgataataacataataagtcccactgaaaatgaagatatcttcaaattacttcatccatcaaattcacaaattgctcaaatgattagttttaactttccttag

SEQ ID NO: 2566 - DNA, 1815 bp, Cryptosporidium hominis
atgacaacttccttaattaataagaatagaactccaacaagagcaagaggagaaagagtatataaaccaggtggaaaaaaagaatggagagtggttttttggactcatgaatcaacgaaacctagtagaagacaatgttcttttagtgaagctaaatatggtaaagaagcagcatctttactttctagagcagttcttgactatatcgatgtaaaaggtgtagtaccagatgatcttcatgatcctccaattttagatccagccaaaaaagaattaatcgaatattatagtgcacttcatgaaagtagaaaagctttacaaaagaagaataaaccaaaaaatagtggcaattctaataataaaaatatatctgaaccaagtattgttccattatacactttagctcaaacacaatctcctactatgagtaatatatcatgtacatctcctcaacaaccaattaaattaactaaaactgagaaatattcagatctcaataatcttagagaacaatttcaaaccgaatcacagtctaactttggaatcttaaataatagtaatcataactcaccaaatgaatccagaattctatcaccattatcaattatcacaaattctggtgggaatagtagtggtaataatggagaaataggagtaggggtaggaggaggaggaggagtgagaggagaaggaatcgaaaatggaatctcaatcactgaagaatctacaacaaagaatgagccagaagctagtatttctggtacaaatagtaatcacataaagaaaaactcaagtaataattttcttaacaatattcaaataccacctattccaaatatcacttcatctactgattttaataatgaaagtgaaaatggaattaacaataatagtcgtctgaaaaagcaattttcttctgatatcgatggattcaacgcaatgattaatcgtgtaatttctagtataaatgagcataacccatttttaagtggaacaggagcagcaggaacaatgggattagcagggatgggtggaataggaggaattgggggaacaggaggaattggaggaacaggaggaacaggaggaacaggaggaacaggaggaacaggaggaatagcaggaacaggtctaggaggggtaggaatgggaacccactttactctcatggggtccatcttcccaaatcaattaccacctggaatacaaaatcatgtgccaacaacccactttaattcaactagtagtccttcctcttctttcccagatttactctctccaaattgcaacggactttttgggccagatttgaacaattttttgaatcaaactttccaccaaattgcctttcaaaaccaattcaattttctcaatcatcttgggtatttaaaccatttagctggattaactatcactggagttggcgggaacattattacaggacatcccaacttcatgacgggttctcttatccacaattttcctctatttcaaaaccaagacacctctttaactgcaaataataatactgatatcggaaattcatctcaaagaaacatgtttatgaatggaacatttaatgaaaatgaaggaggagaaagtttgaatggttttttaatttcaggtaatcatgaaagtaattcaaagacaactaataatttagattcaactggttcttctactttaatttccgcaactctttctcaacaagaaggaggtgattctttttctctttctccaaattcaaagataaacaaaggaatggttgtatcagtccagacttcatcagatctttctaccccattattagcttaa

SEQ ID NO: 2567 - DNA, 246 bp, Cryptosporidium hominis
atgtttaaaactaaaagagaaaatataatttacaagccctaccagttttttctaatcgaaaaactctatggttattattactgccattctctttttaactatctctccctatttccttctatttctcatcccttcaccctctcttctcttcttcccctctctccccccttttcgtttatatatattgcatgctttggcgggaagacgcatgcaattctaatttattcttttcaaataaatatataa

SEQ ID NO: 2568 - DNA, 351 bp, Cryptosporidium hominis
atgctcaatgttgagggaggcgatattgatgaagatataaattatagtaattatcaaagagaaatatattcaaatgagctaaaaaaaaaaattggactaaataataataatagtaataataacaatagcgacgattattattattatgatgggaatgatactatacaagaaagttattatagaaatgatgacaataatggaatgaacaagaataatgatgaatatgaattaaatgataatgaaatatccttggaaatgtattctaaagaacttgatataataagtttaagtaaaggaatagttgagaatatttggtatgttgaattagaaagaatgggagaagttgtttgg

SEQ ID NO: 2569 - DNA, 983 bp, Cryptosporidium hominis
  misc_feature (26)..(26): n is a, c, g, or t
  misc_feature (54)..(54): n is a, c, g, or t
atgaaaaaagagggtgggggggggcngcggggggaaggggcgggagggagaggnccatcaccactaataccttcatcatcatcatcgccatctccatctccatcgccattaccatcacaaaaaaattcatgtattcttagtcaatgcagtagtattagtaatggtagtcttctgggagttttaggagactattataaagttgaaagatataatactttggcaaatgaaagaaaagttaataattccaaaattgttgttagagatgaaaaaatacttaaaaaaaatagtaagaatattgttaataatataccatcatctcatcgtaatattgttggtgtaaatgaatccaatgatcaattaaagtccatgtttagtattaaatcttcagaaagaaaagaatcaaataataaagtaaaagaaaatgctttaattcaagaatttaaaaggaatagtggatcattagtaaataataaaagaccattatttagtgaagaattatctccaattacttgtatgaataatacttgttcgaatattaaaggagcaataaatatattaggtattacagggaaaatatttatggatgtattatttcaattagttaatgcctttgatttagatgatagagaaattccaaattataataaaaacaaatttgaaaatatgccacatttcccagtatcttcaatagaaataccacctgatactattatacttcaatgttttgattgtggattaatttactatacagatttaccattaaataagcaacaacttggtactattggtattttagatccaaaacctgtagaatttggtaagggagattctgatgaaataatatatgggatttcaaatagaaattcaccatattattgttgggggaatttggagccaagagatttatcaccaaatcaaatagaattcttaagaaagattgatcttagaaaacaaaatagattttctcatcaagatcttgtatg

SEQ ID NO: 2570 - DNA, 3873 bp, Cryptosporidium hominis
atgtctccacgggccttaaaaaagggagtacaaatcatggaagctgagaatgttccgaatatctcatcaaatgtttgctctgaaaacttaaaaagtagtaactttgagaatccgaacaaaaaccaatctataactcaagttagagccttatcccaagaatctgaacttgaagttagtgtaaacttctccgaaaatcccataacaaccttcagctatgttccagaacaagattcttgtcaaaatcattcaaatttctcctctaaaagtttttcaacacttgaaccagaacaaattagatttgcaagtaattcaagttctgctagtcttcctgttatgaggttctcacaagattggtctggttcagctattaatagaagtcctgacggaaatcagcctgtcataccatcactaacagcaaaaaagatcaggcaaatcttaatggcttctagaagatcaaattcattccaactaaaatctgaaactggcggagttacttccaatcaacaaagtaaacataactcagctcaatctatgaaatccattgatactacttcagaaaactctccttcatttaaaagctttggtgtatcaaatgaaataaaaggaaaaaccagtaatagttctcatgtctttcaaaaccactctaacttgaattcagatgaatacaaccactataattctattgattctcaatatcataaagctcaccaaaagtctggatcttttgcatcctctaacattaaaaggaggtataatatacaccaaggaataagttcagatatcttctgttcacaaccatacatctctcaaggacaatgccacatggatatacttaaagaagaaatacagttaatggaacaacttgaacagggagtattacttttcaataactcaccagaagaaggaatttcttatttaattgaacatcaacttgttgaagatgatcctttatatattgcaaactttattcttcacactgatttcttggataaacgtaaagttggagagcttctaggaggacattcaaatctctctttaagtatactcaataattatgttcacttatttaatactaattctttggaacctgatattgctttaagatatttcttatctagattctttcttccaggagaatcccaaatggtttatagaatcctagagaggttctctgttaattatattagagacaatccaacaactttatatacctcggatcagatccatacactttgttatgctttggttatgttaaatacatccttacataattctcatgtacgaacaaaaatgtccaaacaagaatttattacaatgtgtatgcattcgaatcttccagtaacaagtacccaacttgaaaatatgtacgatagagttgctgaaaatgaacttaaaccattattatctccatctgaaaaagtatatggaagactttctagagatccaaaagtcttaagatctaaacaagtatctcaagttagtccaactcttcttcaaaaaggaacaatctttagaagattctcaaataaaaatagttctcatacaataattgcttggatatcttcagattcaaaattcttctgttggaagaaagttagaagtaaatcaagtcacttattaaatccaagtaattttgttagtaatatgtctcttcaacttagtaaactggttaattataacaagaaacgtctttctagacctttaaataataatagtattaacaataataaagcaatggattcgaatatctttctaagagatgaaaatctgtttgataaccaaagctgtattttaaccagtcattcaagaattacaagtagaatccgtagagcttttggaatggacatttctgatttatcttgtatccttttggatgatattgtggatattaatgtgggagtatcaagtaaaatccatttagatcgaaaatccagtaaaatcctaagaaaaggaaaggtctgttcaacctcatccaaaaataatgcaaaccacttacaaagtgaactagaatccaaatgtttctcactgataactcgctcaggggaatccattaatctctgttcattagattctacttttccatcattattaatatggatcagattcttccatcaaactattcttaaaaatcaagaaaccaaagaagctaaagaagctcaagatggtaatgtaatgacagtttatggaatcccaattatagataagggaattgaaagtgacttattaagagtatggcaccatggaatctttattcaatgggaaaaccactggagcttagattcattcatcaacttatgtaatactgaacttcctaatgcagtttccctctcaaataaggaagttttatcatccaactcaaattcgaattctatttctacattgtttgatttacaccaatataattcatgcgccagcaataatcccacaagtagtattcttcaagaaatagtttctggccaaaaagagaatttgaattctaatactggcagctggaaatcaaaatcaaaaatgtcttccaatccccaaaaaatggcttggattcataataaaaagaataaatataaagcttctgtaccaaaatcaacattttcatggaaaataatgagtatatttagctttctgaagcttaaaaagccaaaatatgcacccccaagtcataatttacataataaatatattaattatcaggcgcccatttctcacctgattcttcatttatgggttaacaatattccttgctcatatagaggaatcttatggaatattgctgtaggaaataatcttcaaattcaagctgccacttttaaccatcttttaagactcagaagtaattttctgacagacctgtcagagtcaatcagcccctcagcatgtgggggaaagcaaacgtgcatgcatgcatgctttgaaggcgggccattgaaagaggcatttttcatacaccttaaaaggtttcacagagatatatcgaatgtatttccagaacttcattcgttctttattggagctggagcagtactaggatacagaatttgggacaaaatgaaatctaaacaaaaggcaaaatatatagaacagaaacaaatggctaatgaacaatcagattctacatttatgacagttccttcaccattaggcgggctctctccaatttcccaatctcatattaataggaaaattctggaagatgatgaagattcagaacttgagagtgtgttattattttttaatgacaatccaagtatatatagaatagaccagagtactaagattttggttgaatgttttatattgtataggcctgatataggttatgttgaggggatgagtcatattgcaatgattcttttgttatttaatattaatttgatggaagcatttaaaacctttactaaccttttgcataacagctttttcttagatatgtttatgcttaatcatagaaatgtcaaaatgagattggatttctttgatatgttatttaaagaattaatgccttctttggcttatcattttgatttattaagtattacatcagacacatacttaatttcatggttgacttctttattttcaacatgtattccaatacaagttattccaaaggtttgggattctctttttctttttggagaaccatatgcattccaagttgctcttggtgttcttaagtaccatgagcataagctgattatgacatcatttgaaggatgtatatccatccttcatagtattccatctaccttcgactttagaagattcaatcgtactcttgagcagtttaatggaactatttctcatagatttgggctctggcttgctgcacaaaggctttctgagcaaaaaacagaactactagaagagctattttaa

SEQ ID NO: 2571 - DNA, 1458 bp, Cryptosporidium hominis
atgatttctgtggagggggataatagtataattaagcaattaaataactgtttgagttgtctcttgagagggtttaaatgccaagatgtattgataagaatcacaaatgagtatttaatgctttattcatttccatttggtggattttcttcgtgtttccaatttaactttgatggtagattgtttgataaatttgaaactggggatattgtagaatttgaacgattatataaagtagactcactgattaaatgctttaacaatactcagtggtttaaagccactagattcatttttgagattaatggaaatgatgatgatactttaagggttactttacatggtaaaattggagtaattagaaagcattgtgtatacccagttattggacataaagatagaattcttcttcatgaaacaattttctggaaaagaagacatggattaaggatatcttctggtcttcttaaggatatatttggatatatggaaattaaggaatcaaagataacactctcaatttcatcccaagaatctttaatttcaattaaagttcaaccgattggtatttctggatatgatatgccaatcacaggatcttcaattggaacaggaaataccagtggaaatagtgtttcaaataattcaacttatcaagatatccaaattaaaaaagaacagattgataccttaagcttatgtgaaagtattctggaaaacagcaattttaccttcaattctagagagttcaaaattgctattgctttagcagaaaattgtcagcttcctgtattcattactctaagagctcccggatctcctttaattatttctattggccaaagagccattattgaccagatgtgcgtttcagaccttggaaatgacattataccctttgagtaccattgggaaaaacctctttttaattccaagctgtttgaaattgatcacgagtttatcgaaaagacccaaatcattactggattctcagctgtctttctcttatccacttctattgacccagaatcgcctccagatcttgttacttcttttaattctcccatagaagaccatgacccggaccaagatcaggataaggatcaagactaccatgcccctatggtcattagccaaatgtcagaacctagaaattacactcccgtatcctctaaaaatatctcagatatcaaaaaagactattctcccacctcttctaaagcaatccgggaagctcctcctgaggaatgctccctcaagaaggaagttgaagtatttgattgctctttttccaaacttgatcaatttaacctcgacagcatcttccaaaagttcggaattgaaaaccaagacagctctaaagacccagaaaattctaacaattactccaaaattgacattccaacaaaagatcaaggagtcaaaagcttcgattggatttcttccctgctgtggtaa

SEQ ID NO: 2572 - DNA, 2508 bp, Cryptosporidium hominis
atggagactgaaaataaagttgaggtgattgactttgagattgagaaaggaaatgataatggagatacaaaagaaatggaacaacttctggccctggacgactttaaaaagttgattggactattagaaagagcaaaggagtcaagcctaaggaggttggatagaactttattactaatagaagaaaattttgagcaagtgagtaaaaggctcgatcaagacgatctatcatacctggattatcgcatgtgtgatgtggatcttcctgaaatggaggttgatccaactgaagaagaaattaacaatactgtgaattgttttttgagcaaattaatagaaacaggaaagatccagcttagacagctaaagagagagctgagcgaagtgaaggaagtcacggaaaatatcctagtttcagaggtaaatgaagaagaaaataaacaaatctttgaaagccctaaaccaaaaaaggtcaaggatgaaagcgggtttgtagcgagcatgaaacgtctctgggaaaacaagacaccaaagctttcctcaatttggaggagaaatgaagagagtaagaacctgattgttaatagacttggagtgtccagattggataagttggatattgtggacggctttttgtctaaagacgatgatacagaaaagaaggatggagttagtctggatatagaaatggaaagtattgtggaagctgaagctgatgttgaggttgatcctgagactgaatttggggttgagacagaaatcgaaggcagtggtgagacagaggtagatgtagatatggagcaaaatatagaaacagaaacggaagtgatgacatctgccagaaataatacatccttcaagtcgatttctaacgaggacgtaatttctccaaaacctccaaacgccattttgtctatgggaggatcatctccgcttcagagcccacctttgttagttctcactccttctactcccatcccgattgttccaactacaatatctcaacaggctcaaggaggagaagcaaggaactccattgcaaaggttcaagtagaggaaacctctgcgagaacagaaattctaaggacttcagtagttattggttcgggtgagatcgaaagccacacaacagaaggaaaagagagagtctcaaagtctacgacaaatgctaacgaggattcccctttacctccaaggccaatcagaagacaaacaagtgagaagatgcaggaaaaaggagaaaatagggttgaggaagttgagggaggagagcagactccaattctaaagggaggattggagggaactcccatagataaaaatatagaagaggtgggagagaatgattttgttcgaccagagagaattagccatgtaaaaaaaagtggattgaggtccattctccaccactctgccaacaggattcctttggaacagacaatggcttcctctggatttggaacaggagccggaggaggagctggagcaactgcaggagctggagcaactgcaggagctggagaaaacaataatactgctaatagaggaagtacaaatactatcagacaaagtagaggatccacagctgctaataacttggtgaagactccaatcaacaagggattctgcgaaatggaaacagaagggaaggacaaacttagaattggagaaagcccgtgtagaaggtaccataaacgcctgaaactacttcctcctgtaaatccagatgaatgttatatgctaacagacagtgaagatgaacaacagaactgtggagtaggaggaaatggaggtggagaacttaagatcactaaagctcaaaagaaaataccactctgggcaagaagcatgaattggatcccaaaaatgaaggaacaaagaaatgtagatccattcagtatctttggagactcttgtatgttcatggacctcgaggatgtattccaaagaccttggtatatctccaccatcgctagagataacagaatcaagtcgtggcaaaatgatcggctcacctctctcaactggagtgaagactctcttacttctgacgaactcagacaatacaagatgagaatgaacctctacattgataaatccaatgaagtctatgtcacagaaccttgcttcactccttccccaaatcctcttgctaatggcgcatggaaccatataaacaaacagagaatcaacagtggaggcaccacagtcattcgaaaagctctaaatctatccatccataggcttaacaatagcatctccaataaacccaactcctctattccttccgctcatctagctcccccatcctcttcagtctcatcttccaaacttgtcgaagctaccttaaaccatctacaagcagacaaaaattcctccatttccaatattgaaaacaataatatcgcaaacttcctctccaaaccaattaattcatccaaagactgccccaatctcgcacatcaacacaacaatcacattatcggtaattcatccttccttcagtaa

SEQ ID NO: 2573 - DNA, 2478 bp, Cryptosporidium hominis
atgattaaagaaagaatgaaaatacaagccatgtttttcttaaatatcatcagaattatatttattatacattttttcactttaatacacggtaccgaattcaaatttgatcatgatcaagaatttgaccaatttgaaaagttatatagagaaaaaaaatatgagaaactatatagagaattaaaagaatgcgaatttaaagactccagatgcgcacaaatattgggagaaatgtatttcataggattgcatgtcgatcaagatattattacagcaatatcatactggaaattatcttcagattatggaaattctgaaggtcaattttgcatgggtatggtttacacgctttttccgttcttggactcacttgagtgcatcactaatagtcatgttggcgccaaacactcaaaaattacattggacaattttctagaaaatgataatccgataccatgtgatttttatccatattcaaaagatgacgctccaaaattcttaaaaaagtataagtctctaataattaattattctttcaatgatcaagattacgaaaaagatgcaaatgttataggaaaagtgtcaaaatctatacagctttctaatctatatttatatttttcttcactttctggtcatactggagcacagttagccttaggatttagatatgagcatggacttggagtacctagatcatgtgaagctgcaatatctaactacattgagacagcaaaaacttcagtttcatttaaaaaacaaggattttcagaaaaagaacaactaatacgtctttcaattccggactgggagccaatgaaaaagctttttaatccaacagaaaataggaatcgtgaagatctagctataaatttggcagaatctggaagcattacaatccaactagctttagctaaaagatatctattgggagtagatggatttaaacaagacactactaaagcttataaatatctaagaaaaattgctgataaagctaaatcaatggttggagttgtattagatattccttctacacttatttatggcgaagctattgggttacttggttacatgcatgcattaggtctcggtacctctccagatctaaaaactgcgtctgaatatttttcaatttcagcctttatatataacgatccaggaggccataatggtatgggatatgtttattttcatggatgtgaaggatttgagaggaattttagattagcttttcaccactttaatgaaagtgcttttcatttatttgctgatgcacaatataatttggcgtctctttatcttaccggactgggtacccctcaatcatattcagatgcaatttcttggtatacaagagcttatgagcagggacaccttccatctgcatatgcactttcacagttaaatttgaatgggcttggtataaatagagattgtaatacagctttgggatttcttagagagattatacaaagatcaaattggacaaataatttgatttcaattaccaataaattttcaagatccaaaagtaaagatgaaaagaatcaaatgattctcagtacaatgaaacttgcaattacaggatatgcaccatctatatctaacttagcctctttattagatcaaaatcttagaagtaataaacattttgaatgggtatcgtccataattggaatccctcttccagatttttcatttaagccaaatagagtcgagtactggtttaagttattatcagccaaagttatcccaaaaatccttttaaagttttttcctgatcttgaaaatattaatttagatacttataatataggtaacgaaaatgatgaaaaaggtatcgaaaatattaataaatggtatttaccacaaatgtttttagaattttcaatatataatgagaatgttgattcaattataagatatggagattactcatactatggaaaaggagtcgaacttagatataaactttctccaaaactcttagagaattcttctaattctaactggattaggcctttagagctcgaaattgtttctatggaatctccaaattatttggcagcattcgatctttataagattgtctcaaatagcataataacttctagatggatgatttctcctatttcagaagcctcctttaatttagcatttatggctcaattcggaataggaattgtgcaagatcttcatcttgcagaaaagtattataaaaagatggtagaaactgggagtatcaatagaataagcaatggtattggagatcttcttatttattttacgaaaatccatagaagtcttaatctaactattaattctttaaataagatttcatatcaagacctaaaggccaatgggaatttcttcctcatcctcaaattaggtcacctcttacttttcctgttaattctcaaactactcgtctatatttatactaaatggacaaaaactagagaaaattcttcttaa

SEQ ID NO: 2574 - DNA, 198 bp, Cryptosporidium hominis
atgacttttgcaagaccaattgttagtgtttttccatcaaacgactctacaaaggctacttccagtattcctttaccaacagtctttgtttctccattaagacatgatcttgttcgttatgttttcaccaacatgtcaaagaacaagagacaagcttatggtgtttccaccaaagcaggtaagttcttgaagatttaa

SEQ ID NO: 2575 - DNA, 639 bp, Cryptosporidium hominis
atgaaacgtattgagtcttcaatggctattagatgtggtaagggtaagatgagaaatagaagaagagtctgcgctgtaggaccattagttatttatgctgaagataatggtattgttaaggccatgagaaatatcaagggtgttgatacatgctctgttgagcgtcttaatctcttgagacttgctccaggaggtacatttggtcgtcttacaatcttcacaaagggtgccattaagagactccaggagatctatggtagctatactcatggctcatcttcaaaggttggatacacattgccacgtccagcaatgactaacgctgatattacccgtatcatcaactccactgaagttcaatctgtattaagaccattacgtggattcagatgcatgggtagtatgggtagatccaagactaagaagaataacttgacaaatctcacaaagagagcatgcttgaacccagcatacaccagcctcagaaagagtgcaagattagcccaaatcccaggtactagactccatgcaattaaacaacgccaaaaggcagcaaaccgtgctctaaagaagtcaatcaaacagaaatctgatacagctcttgctgctaaggccttatctggtcataaccaaaattaa

SEQ ID NO: 2576 - DNA, 1161 bp, Cryptosporidium hominis
atgaaaaataatacatattttggagtaaaaaaaaattttaaagaaattaaagatttgatatccgactatatgaatgaaacgagcagattatcaagtgaagaggaggattataaaagtcaattgaagcttattgaggatgatattgttgaattatcatctaggttgattacacatgaagaggaactcaaagaaaaggtgggaatgaagataaattgtgataggaatttaagtaatgtaataaaaaagaatgaggagttatcacatgaattaatgataaaacagttaaatactgtagcattagaatcttgttcaaaaatgagaaggaaagaaattataaatttagaggatacattaaaagagctggaggataatacaagatgtatacttggaatgatgtcaatggagaatactgcaatattgtcagtaagaacagagtatgctcaaattaacgaacaaaagaaaaagatggcaaaaagtttagaaactgagagagataaactgattcgagcaggaaaggatacaaaaataaagattgaacaattgaataagaaaatattaattaataaaaagcaaatattgcaattgaaaagtgaggaaagcaagaaaattgaaataatagaaaagttaaatgagcaattaatcagtataaaaggaaagaatacaattgaggattcaaatttgaataagatccagtcaacaatgaatgtaataaaaagtcagttatctggactagatgaaaaaattcgagtaataaagtacttgtgggaaacaaaaagagatttcaatattcatgaggtatttgatgatgaggaaattattatggaagccaataataaactaaatgataatcattttaatatatcagtttatataagagaaaatggagagttgatgataacaaaaaatagtttgatagatgaaattgagataataaaacaaaagttatcagaacaagatttgaattcaaataaaatacaagagattcaagttgaaattaatgaaaagattagcaaagctagaatgcttaattctgagttacttaagaaacagagagagttaagtaatacagaagatcaaattttagagagtaaacaaagattactcaaaataaagaatattttgaaaaatatatccaagaaaagatacgaagaagaaaggtaa

SEQ ID NO: 2577 - DNA, 1443 bp, Cryptosporidium hominis
atggatcgttcagcattttcaattttggcttcaggtacatcatttacaaacggaagaaaatctagagagctttgggagaagatatctcgtgagaaagcaagattggaagaatatggcaattccgtagagaattttgaaaaagaagataaagaaagtaaaggagaaacgatagtaaatgaggaatatattattgataagaggaattcaatgaatatagcagtagatggagacaataagactatgccattactaacatttaaagaaataaaggaatctggaaatctcccagattgggttttggataatataatgaacatatcgaaataccaaaagccaacaccaatccagtctcaggtaatccctctgttattttctggagttgatttacttgtacaatctccaacaggttcaggaaaaactttatgttatattcttccaatacttggcagattaaaaaatgataaagtatactgtgcaaacttgattttaagtccaacaagagagttagcacagcaaatagttcgcgagattaagataattttagatatccatggcaaaaagtatcgttgcagatatattagtggcaagattgataaagctcaagaaagtaatacaaagaggttagatatagcggtttcaactccatatcgtttagcagatatttgtcgtaataatataattaatttgcaaggatgctcaatgattgttttagatgaagttgataagttattggatatgggttttgctcctcaaattgatgaaatactatcacattcaaatattccaaagggtggaaaggttcagattgcagcattttctgcaacattacctcaaattgtaataaatttagcagattctataatgaaatctccagtgaaagtaacacttggccatagattagctgcttcaagtaccatcattcaagagcttgtttgtgttacaaaagatgatgcaaaaattgaatcattaagacaacttattaagcaaggcaaaataatgcttcctactcttgtattcacaaacagcaaggatgatgctcaaagactctttaagaaacttatgtatgataacttgattgtggaagctatacattctgatatgccaaaagtaaagagagataacattattcagaggtttaggactggtaagatttggatattaatttgtactgatttaatggctagaggagttgattttaagaacgtttcttgcgtagttaactatgatttccctcattctccaagtaattatattcatagagtggggcgttgtggccgtgctggaagaactggatatgcaataaccttctttactttaaaagatattccaaaaattaagtccattgcaaaggttataaagtcttctggcgcagatgtaccttcttggatgctcaaagttaagctcaacaatatcaaaaagtcacattttaagaaaaaaatttaa

SEQ ID NO: 2578 - DNA, 612 bp, Cryptosporidium hominis
atgaatcctgagtacgactacttattcaaactacttttaataggagatagtggtgtaggtaaatcatgcctacttttacgatttgctgatgacacctatactgacagttatatttcaacaattggggttgatttcaagataagaacaataagtttggagaataagacagtaaagttacagatttgggatactgcaggacaagaaaggtttagaacaattacttctagttattatagaggggcacatggaatcattattgtctatgatgttacagatagggattcttttgataatgttaaacaatggatccaagagattgatagatacgcaatggagaatgttaataaattgttagtaggtaataagtgcgatcttgtgagcaagagagtggtaacatcagacgagggaagagaacttgcagattctcatggaataaaatttatagaaacttctgctaaaaacgcttataatgttgaacaagcattccatacaatggctggagagatcaagaagagagttcaagtgaatagtcagaatacaaggggctctgcacagcaaggtcccaagttagcaggagctcagccaattagacaaggtggatgctgttcataa

SEQ ID NO: 2579 - DNA, 1629 bp, Cryptosporidium hominis
atgaagggtaaggacgtattatctacggattcggagactgaagatcacttctcaaacgagggattttcagattctgatttacaatctgaggaaggagaggagataaatgacgaatttgtaacaaaatttgttcaagaaagggatgatgaagatgaaattgccataaatattaagaaaggtgatgacaatactattggcccatttggattaagagttactggtgaagatttggaaacaataaaatcaagagtagaatcaatagtcgagtatttggactcaaaaggtccaggtaaagccactatagaatataaaggcttaaactcaaaaaaagcatccagaagtgaattgatggataaattagcggatgatatatcaatcctatatggatataatactgagcttacaaactacatattaaacttgttttctccaaaagaagctttagatttctttgaggccaatgaaaataagagacctttaacaattagaaccaatatgcttaagagtagaagaagagatttggcacagaaattgatttctagaggagcaaacgtagatcctacaggtgaatggaccaaggttggacttacaatatattctagtagtgttccaattggtgcaactccagagtatcttgctggacattatatgattcaaagcgcttctagtcttattccagttatggcattagcccctcaaccaggagagaagattcttgatatggcagcagctcctggtggtaaaacaacttatattggacaattaatgaagaactctggcatattatatgcaaatgatttaagaaaggacagatgtaccggtttgattgctaatcttcatagaatgggtattaataatagtattgtagttaatatggatggtaaggagttagggtcattccttccaaaacttgatagagtactacttgatgctccatgcaccggtcttggaattattgcaagggatccatctgttaaggtaaagagaagcattaaagagctggctcaacattctttgttgcaaaaggaactccttaaagctgctgttgatatggtggatgctaatagcaaaacaggcgggtatattgtttattctacttgttctatttctattgaggaaaatgagatggttgttgattatattttaagaactcgtcatgttaagttggttcctttaggagttgaaattggatcaaatggtatctccaagtttagggagcatagatttaatcctacaatttccacatatactagaagaatataccctcatctcaataatatggatggcttcttcgttgctaagcttaaaaagatttcgaatgatattcctaaacaaattaaaaaagacagaaacaaatcaaatagctacatcaagacttggggcaaagaaaaatggactaatgatcttatacacaagattgatccagtatctgactctgattattctaagcaagaacaaatcaaaaatacttcaggagattctaaaattcttaacaccatttcacctattaaaaagtcaaagaataaacccggtaagagagacagaatgctttctcgttctcttaaacagaattctgataaatcaggctcacaacccttgcagaaaaagcccaatgtcaaagtaaactag

SEQ ID NO: 2580 - DNA, 868 bp, Cryptosporidium hominis
atgagtgtattcaaaatgagtttcttgacaatatctttgatatttatagtattaataggatttgttcaaggtaacgaaaatagggaaaagtatctggaaaagactacaattaatagactacctcataaaactaaatattttttaggatacgagttggagatagaagtagataataatttgaccaataaagatgataagtttattccaaatgaacttttgggattattacagattcctttacttgacgatttgttagtagtttcaacacaaggaatgtggagaacaattaactggggagagcctcctgttgatatttatactacaggttcaatattaaatctggggttttcagatgcaagcttagtttcagaagagttatggtcatccatattaactagagtttcttcgataatgtgtaattctttgacagtctttagtaattcattagatagagaaaagagttgtactcaaattaagaaaggtactggtttaaacagacaaatatgtaataactatgacgatactttatgtatggataatttgaattgctggagaaagttacttccttgtacaactttagacttttcaagtaaaataggatcttatggcatactcaagaatatatcattggattcttttgtaaaagcatcatacaaatcaataggattagagctcaagaaaagaggaaaaaaagcatatttcaggatcttctttaatatagttttgaaaggaaaacctttatatacaatagaaaaggaacaaaacaagactttatggtcactgattgatcttgaagaaccagattacaaggattttatttgttcaggtgttgtagagtccaagattagttatttttttaatagtatac

SEQ ID NO: 2581 - DNA, 678 bp, Cryptosporidium hominis
atgtcagatgttaatgaaaatacgctcaagattattaaagcagcaaataggtctcttcagcttcatcaagataggctaggaaaaacaaaaatagtagagaataaggagaactctcaatttaagagccaaaataaaatagaacttggagatgaaaagtccccaagattaaagactaagcgagtaaatacaacaaaagagatagaaatagtaacaaagaagcatcatgacgaggaatcaatagaaaaaactcaagagaaagtcagagaacttgaaggtcagatctccaaaatactggaatattcatcagtacttgaagaaactttaaaaaaaaatattgaccaaacaaacaaaatcaataagaaccattgctgttgcaatcagcagacccacagtaggaaacttgacaaattaatgattgctgatatagtaaaagatgttgtttactcactaaatagaaagaaaatacaaccccaagtcaaaccctacattattcccactaaaacacaatcaaaaattaattctaatctatcaattcacacatcaactgtggaatatctttcaagcttcatcctagaactatgtattgatgacattctaacctctttagacacttccatacacaatttttctgtcaaacttgtaaaaggaaagtattttgaaactgagaccatcccataa

SEQ ID NO: 2582 - DNA, 774 bp, Cryptosporidium hominis
atgagttctgaaagaaaacactgcattcatgtaatagcagccaagaagtttctacaaagttttttaaagctccctgaggaagctctaagagaggactttgatatatgctataataatcaatgcaattcccaaaataagtctaaaattgaatactttgggatcccaagaaaagaatgtgaaataccacacgaatttgttggtattggacttaatactggagaaaatgtcccttttgaaatgaaaaaagttactaaaatgaagaatccaacaaacagtaatcagattgataagttattgggtgatattggtgagcctacatatagagaaattgcagttcatcaggaagattctagaaaggtaattagagagatttttactttgtcccatgagatagaaaaggatttaagagataatattactcatagatctcgatcaatagctttttgtccagaatctgagtttaataataacgaaaatgagtacaatctaaattctgttgaagtatctaataatagtagtagatccaaaatactcaattggtttagagatcagaaaccaatttgggatgaagaagactattttgtgaagagtgaattgtttaggtcaaccccagactggaaaagacttgagacttataaagacctaattagctgtgaatggggatctgcaaaggttttgatgattattcaattctggcagacttctttaacatttacagacaggatagttaataatagagattcttctattataggagtaggtggaaggaaatga

SEQ ID NO: 2583 - DNA, 1011 bp, Cryptosporidium hominis
atgaagtgggacacaaatgaaaagagttggaaaataccaatagatcaattcacaaaagtaattagtacatgtagaggaagtctagagttttacttttctagcatatttgaccatatagtatttaaacaagcacaagaaatgattaagaatccaaactttcaaaataaaagaaaagaatatggattaaataattcaattaagaagaagagactgacagtattagaatcagatgaagaagaaacaataagaagtagccaaaggattagatatgatgaagatgatgatgaagaaaacatcgatttaggaagaaacgaacaagctttaattctaagctgtcttgggaaagatgaccatgataatagaagacttgaggcaaaaatattaaatatgattagaaatatgaagactcctaaacatattgataagattgaatttgtactttggcctagacattacaaagactgggaatctatttcatttctagtattatcaaaagatttcataatgaatgtttaccatccaaaactacttttatctattgtaagcaatgtaatgattgtctcagaaggaatgattgattatttaacaaagaagaatacttggcctgataattcatttgaaaccaaattcgaacttgtcaagggacttccttctttggaatctaggctctacattagtgaagggatattttgtaaaacaaaactatttattgttggaccaccaggaaataatcatttcaaattatgtactcgtttagctactttaggaaatgcttcgtttgtacaagatccattattagcggactatataataatttgtgatgaatcagacccaaatgctttgaaaattaagaaatcagtacctaaaaaacaagcaagtaaagtacaaaacacacatggagagactcattcaattcaggtgactccaaaatgggtatatgatgtagttttagattttaccattattaagccaacttccaagcggaatcataaagcctggatgattgagtaa

SEQ ID NO: 2584 - DNA, 948 bp, Cryptosporidium hominis
atgtcagggtttcaatcaaatatacgtagtatgttgggtaatttgcatggatttggaggtttaatggcacaagatccagatgctccgataccagatacatcagaacaagtatatatatcatcattggctttattaaagatgttgaaacatggaagagcaggtgttccaatggaggtaatgggacttttgttgggagaattcattgatgattattcagtacgtgtagttgatgtattttcaatgcctcaatcaggaaatagtgtcagcgtagaagcagtagatccagtttatcagacagatatgttagaaatgttaaaaagagttggaagatcagagttagttgtaggatggtatcactcacatccaggttttggatgctggttttcaggcacagatgtaagtactcagcaaagttttgagcagttaaatcccagagcagtgggtattgttgttgatcctattcaatctgtgaaggggaaagttgtgattgattgctttagattaattagtcctcactcagtaattgcaggtcaggagcctagacagacaacttcaaatatagggcatctccaaaaaccttcaataacagctctagttcatggccttaatagaaattactactctattgctatcagatacagaaagaaccttctggaacagaaaatgcttttgaacctccacaagcctacatggagtgagccattaagatgtgaaaaagaggagaattttaacgaaaggaccaattcaatgatcaagaggatttgtgaaactagcaagcaatatcacgaatctaccaaacttggattatcaaaaacttcggaagaattcgaattagaaaatgttggtaagatcgatgctaagaaaaggttgaatgctgatgttgaaacagtcttaactgataatattctccagattcttaaatcaaacatcgcttcttccgcattttag

SEQ ID NO: 2585 - DNA, 3093 bp, Cryptosporidium hominis
atgtcaacaagaggagttttgcaaaagtataacatgaagtcattgaaagaacaaaagattgacacaacattatcggggaaacaaaagactgaatgtaaagtaaaaagcagcagcaaatttacaggcgaagtattgataacaagtaagaatatatctagcccaacacagagtctggaaaagagtgattcactacctgtttcatcaagtgataattctaggattgaaagtagtgttccaactgcagcaaatagtccaacttcatattcaagttcaatggcttcaattccagatgagcgaggcgatatttacgaagccttggatagagttccagatgatggaaaaattctggaccatgatttacatcttttaaataaggctttacatcctgaaccatttggtgttcttgggtaccaaaagtttggtgatgatggtcaatacgaatattatgtcgttagagcatgggtcaggaacgctagaagaattcagataaaagcaattgactattcattttcttctattggtactaacaatacgcctgttgaaatggaacaaagatatattgatggtaatccaagttggatgtttgagaaagcttttaaaacacttaaggaaaagatacctacttgtagaactcacttttgtggatatgacgagaatttggagaattctaatattgaaaataagagaattggaaaccaaagcaataaggatgattattcaaccgataagttttcagatgttgggtctgaagctaataataaagtaaacaaaaatacgattgtttctaagaaaaaagaaattactgccgattgtaattcgattatggaaaaaacatattctaatgttattgtaaatactctgaataaatcgaaaactaatttggtttcgaacaaggaatcgcataaaggaaatgaaatgcctaagcttgaattgaaccaatcaaacttgatgtcttcaaatattccgagaaataaaaatattagaagtgaagcatgcagttcagatgaagcttgtaattgttatgtgcatgacaacattaactctcaagagtgtgtgagaaaattatattacgaattgcttgttgaatacaatggggatgattctggtaaagtctatgctattagagatacctattcgtttggattactactatcaaatggtgatatggagcttttccaatctggtagttgttggcatgtcgacaatattctaggttcccatattattgaatacaatggagtaaaaggggtaaggttctcagtttgggccccccatgccaaatatgttcgtgttgttggagactggaattcttgggatggaagagtaaatcccatgcgatttcgtcatggtgttggaatctgggagttgtttattccgcatctaggcccaggggagaagtatggatatgaaatacactctcagtcaaacgatgtgtttgttaaaattgatccatattcacaagaatatgaggttcctccacgatatgcttccatcattagtgcttgtgacgattcatacaaagatgagactgaccgttttcgctgggaggatcaagaatggataaagagaagagaacaattgggttccaaaggtgagatgagaaggcaaccaatgtcaatttacgaggttcatcttccaagttggatgaggagagaaaatggagactacttgggatatagagagattgcagagagacttgttgaacacgttaaaaaccttaactttactcacgttgagttcctccctcttgctcaacatccatttgaaggaagctggggatatcaagtaactggacaatatgctccatatagtcgtttaggtactcctgatgattttaaatacttggttaacgagcttcacaaggccaagattggagtctttattgactttgttcctgctcatttttgcaaggatgcttggggattggtatattatgatggaactccgacttacgaatatggtgatccaagagaaggtgaacacaagcagtggggaactgctgtattcaactttagaagaaatgaagttcgttcatttttgcttggagctgcttaccattggttgcgtcgttaccatattgatgggctaagaattgatgctgttagctcaatgttatacagaaattacttaagaccaaatggtgagtggatccccaatgagtttggaggagatgcaaatcttgaagctgttagcctcctacaagagcttaactgggttattcataaagaattccccggtgttttcactatggctgaggaaagtactgcttggcagggagttacacacaaggacggagggcttgggtttgatgctaaatgggacttgggatggatgaatgatactctaagttatttgtacactccccctgataataaaagcagtaagcataataagcttacatttagagggctttacatgtctcatgaacattgggttttgccattaagccacgatgaagtcgttaatggaaagggaagtttacttgataagtgtggattcactggagcgccttatatggatagaattaggacattaaaaacgctatttggatatcaggttggaatgcctggccgtcctttgcttttccaaggggctgaaattgctcaaggtagagagtggaaagagaatagatccgttgattggcatgaaggagaggaggacgtgagaaaaaaagtctgtattttcctaagtgatttattagctgtttacaagaataacgtcagtctccatgctggagatgatgaatcctggaatttccaatgggtagattgtgaaaactctcaagattgtattattgcttttcttagaaagtacaaagaatggtataacgatgtagtggtcatttgtaactttagctcaagacgatacaatcattatccaattggagttcctcatggaaaggagtggcttgtcatgcttaattcggatgattggaagtatggaggagcaatgtttggtcctggaaacaactccactgttcatgcttcccacggagggagagttggctgggattattgtctctggattgacatacccgagttctcttgtatgtatttaaagcctttatttaatccaaatgaaaatgattcataa

SEQ ID NO: 2586 - DNA, 5610 bp, Cryptosporidium hominis
atgtcgacgatcagaacaaggattaaagttggagataaggagcttttgattccagaaaatgtgaatcttagtaaggaaaatgtagtcaatgtctttaaaaggcgaaatattgaagcagttgagttctctgcaatgggaaaggatgaaattgctagatctgctcatatggaagttttgcatagagagatttatagaccaatgacaaatataccacttcaagggggggttttagattcaagattaggagctcatagggctgatgctcagtgttccagttgtggaggaactttaaagacttgtggaggccattggggttatattgatctacaacaacctgtctttcatgttggttattttaagcatttatatggagttttgtgttgtatctgtaagagttgtggagcttttctccttaaaggagaggagaaacgtcaacatcttgccaagctaaaacagtcatattctattgctcattcttatagattacaatttagaaagcttgttgagagatgtaagaaagtcaaaacatgtccaagatgtatgtctcagcaaggtcaactaaggagaacaattagaccaactttagaccagtttatgaagttaactcatactattaaagttgatggtaaagaatatgttgaggatttaactccaatttttgttcaaacacttttagaaagagttccatatcaagatttggatattcttgaaacttttaaacctggaaatctactcatttcacgccttcctgtcccacctaattgtattagaccatcagttactatgggagaatctgggagtaatgaggacgacttaacagtaattctgtctgaaattactgatttgaataatattatcaagtctcaaatgaaatcaggatttcaaacttttcagttacttgggaattgggaatttcttcagcttcaatgcaccagactaattaatgctgatgctccaggagttaatcaactcttagctagtaagaatatcccaaaagctggaagaggagtatgtcagaggcttaaaggtaaagaaggacgtttcagaggaaatttgagtggtaaaagagttgattttagtggaaggactgttatttctcctgaccctaatattgaagttgatgaagttgtagtacctatgatcattgcaaagaaattgacttatcccgaaagagttaatgctattaatattgactctttaagagaagctgttctaaatggacatgatatttggccaggagcatgctatgtttataagagtaatggaagcaaatctagtcttagatatgctaatagaagagttgtatcagagcgtcttgagattggagatattgtagaaagacatatgaaaactggagatatcgtcttattcaatagacaaccaagtttacatagacttagtattatgtctcacaaagttgtagttatgccatggagaacttttagattcaatgaatgtgcttgtgctccttataatgcagatttcgatggagatgaaatgaatcttcatcttcctcagaatgaactagcaagatcagaatccaaacatttgatgggacttatgaataacttagtaactccaagaaacggagaacctttgatagcagcaactcaagattttcttttaggaatgtatgtactaacaggaagagatatattcttaacaagagatcagttttctcaatactgttgtcacttttcaaatggacaaataccaatggagttacctcctccaacaattctaaagcctgtagagctttggacaggaaaacaggtatttaatatgatattaagaccaaactcaaatgaaaatgagagaatagacgtttcatttgaattaaaagaaagagactatgactcaaaatcagatctcaaagatctttgtcctaatgaaggttatgtagtggtgagacattctgaacttttagcaggagcaataggaaagaaagtacttggaggaggatctaaggaaggactctttttctatatattacttgaaaacaatgcaaaaaagagctcagaatgtatgggacgtatttctagatttgtctcacggtatttagctaataaaggaatgacaattggaatcgatgatgttactccaaatgctgaacttcttgtagcaaagaagaatctattagaagatgggtatcaaagagttcaagatgagattaattcatacgaaaaggggaaactaactcctcatcctggtctttctcttgaagatactttagaacttaaagtaaaaaagattctagacgatattagaaatgaagcaggtaaagcttctcatattagtctccctccttctaacaaacctcttcttatgtatctatcaggagcaaaaggtcaactaattaatatagctcaaatggttgcctgtgtagggcaacaaaatgttgctggacaaagaattcaaaatggctttaccaatagaactcttcctcatttcaagatgaattgtgttgatggaagaagtagaggatttgtaggtaatagttttttttcaggattacaacctgatgaattttttttccatacaatgtcagggagagagggactagttgatacagctgttaagacagctgaaacaggatatatgcaaagaagacttgtgaaagcattagaagatctttgtatcaaatatgatcaaacagtaagaacaagtgatggacagattattcaattcatatatggagatgatggacttaatccaatgcttatggaagaaaagttagaacttgttaactttggaaagcttttcaaacatatttactcacaaactaaagtccattccaacttttacttcctatttaacaattatctcaactttttagaaaatcaacccttgaagaatgatttaaatatttcagaaaaccccaaacaatcaaattccaaaagatccaaaagaaaatcaacaaatacttgtgattcaaacttcattatggaagaaacaaaaaacgaccaaaatattcacagatttaaacttctcccaccctcaaatgaagttgttaaccaccttattttgctttttgaaaactatctatctaatggttcatgtgaacttttaaataatcctttggcgccggcgggaacaaatgatgcacatgcatgcactataaataccgtcgatactggtgattttaaaaaagagctaatatttgatgaaatagataatttattggttcagatagaaaaaaaatatgaggaagaggaaagaaggattaaaaaagagaagggagaggaggagagaagaagagcaaagaaaaagatgggagaaggtgtaattagatcaaagcttaaaagaatggtagatataaaggaagaagaggaggataaagaggagaatttggggaaagaggagcaaatgataaaacaagaggagaatattggtgttaaggtagaacaattggaggagcagaaactagaagattttcagttttcttattattgtagtcaaaatattagccagatcatatttgatccaaagtactttgaaaatgagtccaaggagattccgaaatcagtaatggataaattgacgactttgaagatttggtatacaaagaatggattaaagtggtgtaggaataacgagacatgtatttgtatgagaaatagtgtattagctcactatttgatctacaattacttgccaattatggatacaaatgtacctctaattccttttgagatgttgaaatggatggaattcttgattaggatgacaagagagcttgttccaagctctcttttagtccatcaaaagatttcaattttagagtcaccaactcaccaagaaaagactcataaattgaatatattctcaaataatatgaggaagtttttgatttcccatattgagaggatttcaaagtatagaaaagctcaaggagaaaaggagggactcaaattagaagattacatgcaaattattgaagatttctataatgattccagattagactccgagtggtttatgaaaatccttcgacatgatccaaatgtttacagaattgcatctttaggaagatctaaggaacttagtgaattctccaggtatatccgaagattctattctgtaattattcctgatagtgataacatagagacagaattaggagaaaaagaacaggaagaagagagccttggaggaaggaagagaagtatagaaataggctctttcactaatgctgtaaactcttcaaagaggagaattattgatgatgaaggagaatttggaatctcctcatctacttgctcttcaaaattcaagtctataagatataatcctgaatatgctattactattagacaattgtatgaattcattaaagcgagttggagcaagtacatgaaagcaatcacagaaccaggtgaagctgttggagcaattgctgctcaatctattggagagccaggaactcaaatgactttaaaaactttccactttgcaggagttgctagcatgaatgttactttgggagtaccaagaattaaagaaatcattaatgctgctacgaagattcttacccctattattgaagctaagcttgaaaatgattcagactttaattatgcccaaatagttaaaggatctattgtaaaaacactcctaaacgaagtagtttctgatattgaagagctttattcaccaaatggagtctttattaacataaatcttaatgaagaaaccattaaaggccattatcttgatattaacgcatacactgtaagagattctatcgttagtcacggacctatctcaaagatcaaacttaaattagaagatattcaagttcttgatctttggaaactttcaattcttattggcggtggaatttcacaaattggatcttcatctaataatattaacggtaccggtaccgttaatgcatcaaataccggtatgggaaatacaatgaatgtttatttccagacacaattactcaaaaaaggtttacaaaatgttgtagttagtggtatacctgggataaaaagaagtgtaattagacaggatgataaggaagatccaatcactggagagaagagaaagtgttatagtcttgcagtagaaggatatggacttttaaaattaatgggtatcaatggtataattggtacaacaacagtatcaaatcatgtaatggaggtaagagaagtacttggaattgaagcagcaagaaaagtaattattcaagaagtacagaaatgtatggatgcttatagtatggatattgatctaaggcatatacagttactagctgacatcatgacttttagaggagacgtcttgggtatttctagatttggtattcaaaagatgcgtacttcaacacttatgttggcatcatttgaggagacaaatgagcatttatttgaagcagcttttcagaatagagttgatccagtatttggtgttagtgaatgtgttataatgggtaagcctataaaaattggtaccggatcttttgatatcctttataactccccttcaaatatacaaaaaagtaaattatttctgaatggaagcaagaaagattcagttggaaggctttcacagtttttaagtagtataaaaaaacagactctgtccagagaccattgttaa

SEQ ID NO: 2587 - DNA, 525 bp, Cryptosporidium hominis
  misc_feature (497)..(497): n is a, c, g, or t
atgtttaagaagagaaatgttagcaaagaacagattagaaagattcaaaatgataatttcgaggaaaaccaaccaaaaacacttgaggaaagaacttttcaaaggtccttaaatacagatattgatgaaattaagaaaagaaacttactaaaaaaggattcagatcttgtaaaagacccagattttgaaaaagatgaaaaacttgatgaacttgttactatcttttcccataaaaataatcgaaagtttagtcatgataatatcgtaaataactatgacttagacctacatgacccaaatcctcctaagaaagaaacttctaagagtatctattcagagaagaaatatgatactttagaatccagaaatccaaatattaaacttactttgatgattgattaccagcatgatatttgtaaagattttaaagaaactggatactgtggttttggagatacatgcaaattccttcatgataggagcgacttaaaagtagntggaaacttgataaagaatggcaaatag

SEQ ID NO: 2588 - DNA, 615 bp, Cryptosporidium hominis
atggaagttttgattcgtaagactagtaaatataagaagtttcttgcaatcaaagacccttctaaacagatttatggtccaaagatgcttgaaaagatgagaaatatgtgttcaaggtttgaggatatagatgagatatttgaggaacaattaaatccaatttacgaaagtgtagaggctgagtataataggaagttgttggaaatggatcaggaagaaaggaggagaaaagaagaagagtttaagagaaaagttcagcaaggcattcaagagacttatcttgaagaaaaaaggcgattagagaagctaaaggagaaacaagaggaagagaaacgaaggaaagaagctttggaacgtttaaatcaagaggagaaagaaagattggaaaaaatgaacagaaatatagagataatgagtaattttattaaagaattggagactggagaagttttgaatgagtttagagatactcaagtttatttaaaattggaaatttacgaatttaagataatagggattggaatattgttattattgagacaaaaattagatttaaaggagttttatacttgtattggattagtttcagatcttcttgtatctatattaaagtaa

SEQ ID NO: 2589 - DNA, 3111 bp, Cryptosporidium hominis
atgaaattcagtaaaaaacttcagcattatgtaaatcaacagtatatccaacattacttatcttataaggatcttaaaaaagcaataaagcttataactggatcagatacttcaagttatactattaatgaggtaacaaataactttggaaatattaaagctttagcaggatccatatataggccagcagaaagtagatttatggatctattaaaccatgaattagataagattaactcatttagtagtattatgtatactgacataaaagattctcttgaacaaattcaaggatatatagatcaaattagcagagatttaggtataataaataactccagtaatgttaataataataaccaaaatgactccgatagctcattttttcaatctggcatgagtaaagaactcttggatgacttaatttcgcctttaattgaacaacttgaacgtagaagtggtgaaataatatttttagaaagttaccaacaactgaattatacgggttttagaaaaattaccaaaaaatacgataagatgaataagtcaacttcttcttcttggtatctcgcaagacttgcaagagaatcatttatgaatataaatctggacttacttcttgaaagtctttcaaactgctattcaaagattgaaatgctaaaaagtgcttttctgatgaaagaagaatctttaaactgtgataaaacatcagaaagtgatatatcaacacatccgccttttgaacttcattcaaaacatcttattttagctgaagatgtaatgaaggttaaagtactattagcaaaaatagttcctctagtttcaataggtctattgaatgtagaggatggaatgagtaacaaaccttgtttatcttctccaataaataataatacaaattctcaaaagacagcttcaacagaaaatgtatcttctttaacattgcaaacctcaacagtatcttatttgtactttgataatagagaattcagtgaataccatagaattcgtgaaataaggtccagattctcttgtaactctcaagtgaatcaagtagaggaaaattcatctggaaggattcaagcatactcagatgagaagattgttccaaaaaaatacttggattatacatttagattaagatggtatggagaaaatgaaggaagtccagaccaatggcttaatttggattggatacatccaatggaaccaagttgttcaaatactgagtggcatgaaccaaagaataataataactttgttagtcaagcaacaaatactagtcaaatgagtcaaggaggaggaaaaagaacgttttcttttgaaggatcaaaggccttagtaagtagtaaaactttattgatccaacaaaaagatgtttttcatatccttaagacttacggggatttcagacgtgaaagtaagaatccatcactatcttttaactttgatttgaatacatatttaaatgaaaccagaagaaatctttcacaagaccaaataatgttgcttaattgctttatagattttatccaatttagaaaactaggaccattttcacatctttggttccatagaacaacttttgcaaatccaaaaagaaatatatgtgtccatattgataataacttgaagattatgcctgaaattgactcggaattattaatagatgaacattcccaaagaaacaattcgtcattgaataatttacctgctcaaagtgaaaggaaaatgagttctgaaacaaatagaagcaattgtgaaattgtaaatactgaactaggaacaaactccatcttcaatatgaggccttcaatattatataatacttacattgtttgcccccaaactgaagcattagtatcagaaaatatgaaaattgtttctcatggaatcttaagtgtaagtctctcccaagattctggaaatttatccagcactaattctaaccccagagaaatacttaaagatattcttggtcttgcttctgtttcagaagttaacggattttcaaatcttgaaacttgtactgctcttttattcagtaataatttacttcaagttccacattggttcaattttatggctatagaatctgaaagccaacaagaaattacaaataatatcaaagattctaactctgaaccccaaactgtacgaagtctaaacagatctgcttctttaaacaaggaattgattggagtcaaacaacttcaatctcttgaacacgaaaaatcttctttcaataattctttaccaaaaattgatgttcttcatactggaaaaaatgcaagaattcttcacgatcaagaagtcactgctcaaagagaagccagcattcttactaatgaaattcaaactaattccctttcttctttaaatagtacccatactctttcaaatattcatcaacttaaaaatcgaccaattaaaaaaaatgaaattaaacgcgaactcacacaatcccagccgcacacactgcatgtgccacttcttggcaatgacgtggattccggtattgtacatgcgcatgagcagacttttccacatgcactggcgcgcatgttcaggtcaattttttgcatgtgtagagaaggatcagcaaatcatggtattaataatattcaaaaaaagtgtgtatcttctgctgttagagttgaaccgaagacattttttgctaatgagagaacattacttcagtggatgaatatgtcagttttattggctactatttctgtttctttacttagttttggaacacaagttggccgtatatgtggtttaattatggctcctgttgctattttctttattgcctattcttattatatttacttaaaaagaaatagagctttggaaactaaagagccaatttcttataatgataagtttggtccaactttgttagttatgtgtttgattatttctctaacatcagttttgctcttaaatattattgttggtggtcataaacaacatttcaaagatattcatgaatattatagagaagattacaaccactattaccagaataaccagaatgaaaatcaattattacttcaaaattataataatcaatctatttcaaatggtaaatacttgtatcattag

SEQ ID NO: 2590 - DNA, 414 bp, Cryptosporidium hominis
atgtccatcgtaagctttaagaataagccaaaaaaggcaatcattaagaagagaacaaaaaagttcaccagattccaatctgatcgcttcttaagagtcaagccaaactggagaaaaccaaaaggtattgattgtcgtgtacgtagaaaattcaagggtaattatttaatgccaaagattggttatggtagtgatgccaagacacgtaagatgcttccaaatggtttgtataaatttactgtatcaaatccccaggaagttcatatgcttttaatgcataacaagactttctgtgttgagattgcatctggagtaagcagtcgtaaaagaagagagattttggagagagctgagcaattgaacttaaaggttttgaacaagaatgccagactcgcaattgaggaggacgaataa

SEQ ID NO: 2591 - DNA, 405 bp, Cryptosporidium hominis
atggaatatataatgaaatcaagcgagttgaaaaccaatctttggttagaaaggtcttggattattcattttagtggatctaatagactagaacaatgttttatgatccaaaaactttgtttagataggattagaaagttcaaaacaaagtataatcattattttaaggaatgcccagagaaaatggaagaattgatgaccaaaaatgaacttaaaaagattgaaactctattttccttgaagatggattcaaatttagatcctaataactatattggacaaaattatttggtatggattaaagatctcgaacagatagatcttggaataagaaatttaagtaacagatactctattctaattaaaaggtatgttttaataagaataatagaaaggaagtcttga

SEQ ID NO: 2592 - DNA, 273 bp, Cryptosporidium hominis
atgaaagatactgaaatatgtgaagaatgtatgaatttagaagagtttcataaagtttgctgcactttgtgtggaagagttaaatgttcaaattgcaacataagtaatacagttgaatataaaatatacgataaattaatatgtgaggagtgcatatctaaatatatcttgagacaaataatatactcaggaagagttagatgtcaaggatcaaataaatttgaatttaaaaaaggctttagaggagcaatttcaaatcatttcaaagtgtaa

SEQ ID NO: 2593 - DNA, 1383 bp, Cryptosporidium hominis
atgatggaggataaaggggattcccaagtggaggttttcttttggacgaagattaaagatccaagacttcaggctcctgaaggatcctttatgatagattcaaaatctggaagagcggaactttcagaattactaaataccttattagaaacagaaaacaggattgcttttgattttattatagatgaagtgtttttgagaggtactatttatgattatatgagacagaatgagaaaacaagtgaatcaaaacttaaaatagagtatcttaaaacccttggaaaaccgtcaataaagattttagataaacaaaaggattggattaggagcatcacatatggaatagagacagataatcccatggtagtagcaggattctacgatggaaggattagattttatgatacaatttcacataaaaaagataagaaagtcaaattggacgaagatgataatattagagacaataaaagtcaaacatttgaatttaatgtaaatgaattattaccagaaggagattctacttctgtttttagagtccaatctcaacaactaaatgattccgagttttccaaagtttgggcctcaacaatgagcggttctattataggtttaagctattcatcaaagagacaagaatgcattttgaaaagtgttaagctcagagccagtattgctcctatagaagctctttgtactgtaaaaggatgcgattcaataatatcagcaggagatgcaaatggtaatgttttagtattttgtgaggagtccacagataatggtactttaaataatatagagaatacaaataacttaaattgtactgctaagatcaaaatccattcttctaatgttacagatatactatctttgggagataatttgatttcctcaagtttggatggtaatattaaggtgtctaaagtttcattaggagaagctgtttgcgggtggaatattaaatttccaacattctctttatctactcaaaattccatggtaggaaatgtaatttgtacttctcatgatgatggtaaagttcgaatttgggatttaagggcaggagcaaccagccaaatagaccttaaagcaaaaaaagatatgggtttagtgtcttttgatagaaatactcgttttgtccataggagcagacttcttgctcataaggaagttgttccacaagctgtttggagtccatatagtgaatatatgatagggtcagtttcacatgacatggatttgaaaatcctggatataaggtcaccaaatttaccacttcaagcagcaaaaactgactcaaaattacttagcctctgttggatgaatgaacataccatttatacgggaggttcaacaggagaacttatagtttgttcattttag

SEQ ID NO: 2594 - DNA, 1290 bp, Cryptosporidium hominis
atgagtgataacgatacaaacgttaaacagtggaaagtcagaagactaatagcgacactggaagctgctagaggaaatggtacttctatgatttctttggttattaaaccaaaggatgaaatatccagaatttcaaaaatgcttgccgatgagtatggtacagcttctaatattaagagtagagtaaatagactttcagttttatcagcaattacaagtactcaacaacgtctaaaattatataatagaactcctcaaaatggattagtagtttattgtggaactttaattactgaagatgggaaggaaaagaaagtaaatattgactttgagccatttaaacctattaatacgtctctttatttatgtgataataagttccatgttgacgctcttaaagagttactggagactgatgataaatttggatttattattgttgatggtaatggtgccttgtatggtgttgtacaaggtagttcgagagaagtcttgcttagatttaatgtggatttaccaaaaaagcacggtcgtggtggtcaatcagctttacgttttgctcgtctgagaatggaaaagcgtcacaattatttgagaaaagttgctgaaactgcaactactatgtttattactaacgaccaagttaatgttgcggctttgatattagcaggaagtgctgattttaaaaatgagctagctcaaagtgatatttttgatcaaagactagcaagcaagatcctaaagattgttgatgtttcatatggaggtgataatggttttaatcaagccattgagctatcttctgatgcactccaaaatgttaaatttgttcaggagaagaaacttatcactaaattctttgatgaagttgcacaggatactggaaagtatgtttacggaattaatgaaacccttcaagctttagaaatgggtgcaattgaattgttgattgtatgggaaaacttagaaactaaaaggatggttgttaagaacccatctactggcgaagaaaaagtattcttaaatagcccaactgaacagcatgatgaatccaaattcaaggatccagaaactggagcagaacttgatgttattgaaatacttcctttgactgaatggcttgtaaatacatatcaaaattacggagctcaattggaatttgttacaaataagtctcaagaaggaaatcaattccaaaaaggatttggtggttttggtggtattttgagatacaaagtagacttccaagattatgctgtggttgaggatgacttggatgaatttatttaa

SEQ ID NO: 2595 - DNA, 3540 bp, Cryptosporidium hominis
atggcaagtatgaacttaaagaatgagctattaaagaatgttaattattctaatccaacagaggaggtgattgtggaaagattcaactataaattctattctcaactaataatcaggatgatatacttatgtacatggatgattgtggataataattatgagtcctataaatcgttatctgatttatttgctgagaaaatactaaatggactttttggaatatctaatgatgaaggtgggaatcatacatcttcatacaagttcagccaaggaaatgatcaatttgataggtttaaaagttcactgactgatgattatgtcttggaacactatacaaagtttgtatgtattatttggtcaataatttcctcaatggatccagagtcaatttataagagttacattaaaattcttgaaagggaatctttatcgtattatcagctttatattttactagtttttcttattgaaagttctgactggtttattcatcatggctatttccagcatattaatttattaaagatattaagacaggtagaattaatgacttgtttatcgtcagcatatttacaggtaaaagatgaaaataaggaaaaaacatctcaaataaactcttcagacttacacttgaagattttattggtttgcttgattcagaaatcgataacagtagaaatatcaaaagaagtacctttagagtgttataagaagaaacatccaacaattttaaagaccaatcacaatgatttggatattccacagataaggatatacaaatttaataataaatctaatcaaagagatgcgtacattaatggaggaaggtcgatgataagcacctcatacttcctttcatgccgaatattgccgtatttatggtcattttatgaaagttacccaacttataaagatatttatacgagattattacaatcttctacacaacttacaacttatttggacaatttatgcgtaaatctatatgaaacgaagaattggcaaaaaatgatgaacaatttcaataatgtacatttagaatcttcagttgaaatatatgataacagactaataccttataatcaatatattgttttagagtatatttgggaatattttattaatggaaatacgatgattttaattgaaaaatacatctcagcattgatattttcaatatatagctcaaaaaaagtgggattctttgaagtctggttattattatctttatggaagaggtatccagctaggatatatagacatatgatgaagactagtagcacttggattgttccatttttaatggatcatctaattcactattctattttggttaaaaacaattatatcggaatttcttcaccaaagaatgatttaatccgcgtttttaataacattgagttggaaaatacattttcattcttgttgtatcattaccatccacaatattatcatgatagaatgagtggtaaatatttctggtataatgcaagtagtgagcaaggttatttgaataagattaattctcataatactgagattaaaggattagtgatgaattgcagatacactcagggaaatcatcaattagtattacagttccacgattatttacattatattggccattcacttccatttccagtggtaatttacttattaagtaatcaattttcatcagaaaaaaagaagttcatgtcaaattcacatcattttcacaattatttccatcatagtctatatacaagcactttaattgtttggagttgtgttaggtcgttattattatctcaagaatctgaatgggagttattgttactacaatatatggaaattattaaaagtaacaaaagaaataaccagttggtactaactggcttgttagatatggcattaaaaagcacaaggttctctcaaatattgtgtatatacaccaacaatcctaattcaccaataatgaatatatttcaaaaaagtttatttaaagagtgtgactttttattaacttgcaaaagcatgaaaagttctgaggaaaatattgaaaggaatgaagatcaaaatatgaatgggaaatatgaaaaaagaaatagttcagaaattcatggaaaaggtgttataaatcgtctaagaacagttcaggatagtatggagggattgaacttgagaatgtcaagtgtctcttccttgattaataaatgttttgatactatttcagagacttcagaaaacttgaatagatctagtctaaatatattacaatttgaaaataaaaaacattctttggcaaatgttcagttttccttcttttatatactttgtcagcttggtgagatggcaaagtataggaatagaaaagaaggaggattaggtttacctatagaagaagatgataacccttcagctttaataggaagattaaattcaaaagagattgcacaattaaagtcagaaattgctcaagatttattagcaaagattgaaaacgtgatacagaggaaggaatacaaaaatgttccatttttgaatacaaacatgttaaaatcgtccgaaaacaaaacaaaacttttatcaataaagaagattaacaagcttaaaatacttcaaagtgctaagaatattccatatttactttcactacaactaacagatcataattcagataaccaagacacattagtagatatttcaaaaatagaacctgaacaagactatgaaatgaccattaatttgattgtgaaatgtaatgatgattgccgtcaggatgtaataactatgcaatacatacatgtttttcaaaagatttttgaattgtataatattcctgtatggctatacccatatagaattctaccgatgatgttcaaggatattaataattcagtaatatatggagggataattgagttcattgaggacagcatttctctacatgagattcatgaacttcattctgaaggtggactcaaagcctattatgaatctacttttggtggtaagaatagtcatattaaaaaattagaaaatgataacaacgttagttatgaacaagctagatacaattttatctcaagtttggcaggatattctatagcttgttatgtcttgcagatcaaagatagacataatggaaatattttaataacaaagaatgggcatataatacacattgactatggatttatttttgatatttctccaggaaataatttacattttgaaagagcagcttttaaggtaactcaggagatgttagatttcatggatgatcaggtggacttatttgatgatctttgtttgtctggctttttagctgtaagagaacatgcagatttattgctatctttaacacagatgttgataaatagtggtattccatgttttcgtggtgaaacaatcaagaaacttaaggagagattactactaaacttttcgcaacaacaggcatcaaatatattctcaaagaagattcactcagctcataatcacattacgactaaaggatatgaccttgtacagtttatccaacagggaattaagtaa

SEQ ID NO: 2596 - DNA, 2448 bp, Cryptosporidium hominis
atgatagactcgagccaacagcagaatggtttaccttccacattttttggtcagtctgggatagggtataaaatatgtgatcgacttggagcaggaagcgcttcggtggttttcagatgtaaatctgtgggaagagttagagaagatggaataatggtacctattgatgaggaatattttgctgtgaaaattattgatatgaagtcgatatatttgactccagattttatggataaaaagaacaggctattagaagaagcaatgatattgcacaaattaagacatccaaatattgtaagtttggttgatttttctgattctggtgatacattttacttggttatggatttagttgaagggggagagcttttttacaagattgtagaacatggttcactctcagaatcaagtgcaagatttatattaaaacaagttgttgtagctttgatatatatgcatcaaaaggagataattcaccgtgatttgaaacctgagaacattttgattgaaaagtcatatcctggggagtattttgtaattaaagtagcagattttggagttgcaaagtttttaaggcaaggatatacacaagcaagaactttggttggtacaccacaatattgggctcctgaggtgttaagcgcttctaatagtggagaatcttatggtactgaggctgatttatggtctttaggggtcttattttatgtaatgcttggtggagcttttccatttgatgaaagaaaaggcaatttagatcgtttaattagagaaggaaattatcatttcagatatcctcgatttaagagggtgagtgagcaagctaagcaattgattaggagactgttaacagttgatccaagtcagaggatgactctttctgagttaaaaaatgatccttggatgaaaattaagtgtgaaaatgaaccaaatatggcagatatacaagataatattgactctcctcttcccgaaagacatgaaattgtactatttaaatcaatggaagatgctaataatacaacttttagcaaagctattactaaaaaagagactataaagatgattgagacagctgagaatggtaaaggtttttcaattcaaaataaatctatcaactcatcgaaaacatcatcaattatggacattaatagcttgttagatcttcaattaagtgttgcatataaactacatggaatttatattgcttttagacataattcagcaatttgtagagtcattcagcaacatattcacaagtggagaatactacaacaaagatcttatatagcaattgggaagtttaaacaaacttgtgaatctgtattggatgaacttcctgattttttattagcagttaacacaaatgagccaaagcttgcaattgagttgttatcgcatgtcaaaagtttagtagatgtaacacaaaatgatgttgaagatattcaaagctcttacaacaattttttatttgaattatccaattttgtggaatctgtgagagatattaaaagaattacagagacaagtgttaatgctattccatatgaagccaataaggaaacatacgaaactgaagtaagagatcaatcatcatctttaacaggaggtggtagttcttcaataaatttggatagaaataaagaaggattatatgattctcgagcaaggagtgattttgattcttcttcaatggatataagttcaaatggctttaacacaaatgaaagtgtgggtttttcaagatccggatcaaattttatgagtaattcaaacggtattggtaatggaattaaaagtgaatttgatccaagtatatttattggttataattcagcaagggatagagtaataagaaagattacagatatattcttaaattcagagattaatgctttatttgataatttagagaatgaagatccaagttcaaagattacagatataggtggagaagggaaggttgctactatggggggggtaccggctgaggaatttaacagtaataatttatcatcagatttatcaatacaggttcatggaaagtctcaatttaatcaaaattcatcatatattactacttctttggcaagtacaagagacttacttttagatttcttgtttcttcctgctagtatatgtaatgttcctccaacaggagttgaatccctactgcaggaaggagtggattttgatcttccaatcttatcaaattttgaaataacaccagaaaaacttaatagcttgggaagagattatgaaggtggaggaggaggaggaggttcttctgggggtggttctgttgaagatatggcgaatgttaatatgtataaaattgacagagttcatactaatagcaatgtttcagaattctcatctaaatctggagcaaagaaaataaattctacagaaaaaatagattctccaatgacaaccagaagagtgtaa

SEQ ID NO: 2597 - DNA, 618 bp, Cryptosporidium hominis
atgatatcaaaaaaacccataattatcccagaactactgaaggaacttgtttacaaggaaattgaaaatagtaacatactcaaagatagaacttcagaacgaagtaaacttgctcaaaaatgttatctagcctctttaaagctcattaaatctcatatagtttctggagtaaaagaattaaattttggaaatcctcttgaagatgcgcatgagttacttttaagcaaaggaagatcaactcaagtacacaaactcaatagactatatgataaactttcaaacctatgtcttgcaattcctgaactgaataattcttcacccagaaatcaaaccagtagctttcaagataaaatacttagactcctacttccattattcgataccggatcacgagacaagtatgatcaagaaaatattggtaattcaatttccaatctaaaagaagctggagacttgaataattctattagtcctgttttaagtagattcaaagattctaataatatatattcagcttcatcaccatcaataggaaataatgaatttgcaattcaaaccagaaacagctcaaaagatcactctatcacttctgtatataataataatgggagatcatga

SEQ ID NO: 2598 - DNA, 2181 bp, Cryptosporidium hominis
atggataaaaaaaataccggatcagtaacacaaagcgtgggaggaaataaaatgaacgagttagagtttacatcattaccagcagtggtagtagtggaaagtttaggagtagattcatttttaccaatatcatgtgaatttcctgaatcattattaccaataaatggggtaccgataattaattatataattgagatgctgcttaagaatggtgtaactgagatatatttattggcgtattctcataaggatttgttaatagatcacattgaaggattaaaatcatcaaataaaaagttaagatcactaaatattcagattattcagcttggagtacattgtaattcaattggagatgcattaagagatttagattgtcaagtagatatcagggacgactttgttttaatacaagggggtttgctttgtgtggctgatataaaggaagtagttcaaattcacaaaaagaagagaagtagtcaggtaccaaatttatcaatgacaatgatatttatggaaagcccaccattaagtacattaagaacaaagaagaatgagaatttggtgatctatgatcaggtatcgaatgaattggttcattggggtaaatttgatgatgattactgttccagattgtcaatgaagactttaatgaggaactcgagttcatcttattatggtacaagtaaatgcatcattagatacgatttattggatataggacttgcaatatgttctcctcaattgcttaagactttttgtgagacttttgattttactgatctatttaatgattttgtacaaagtgcattaagctctgatattaaacaggatgtaatagatgtttcaataatgtctcagtatgctgtcaagatcacagactttaggacatatcatgtagcacaacaacatgtatgtgaaggatgggcattcccaatggtaccggattattgtagtatatcaggacagaatgtacaaaggtaccaaggatttagtgtatttttgggagataatgtaaatataagtccaagttctgagattggatcaatagttactatagggaaatcaacaaagattggaaataattgtaagatctcagattcttttattggtgagaattgtgtgattggagacaattgcatcattaaaggatgttcaatattagataataccgttattgagaataacgttgaattggattcaagttttatttcgagtaatgctaagattatgagtaatgtaatagtgaatccatgttgtttaataggatctgggattattattcaagagaattcaaaaattgaatcttttagtagggtatcgagatatatttcaagatctatattacttgagaatctaaaaaataagtctcaaaaaggttttgaacaagatgaaaatgaattaagaagtaatagtaactctccaagtatgaattctagacgatttaaacttttagatgagacagatttatctttattagataatatgacaaaagatggagcgatattgaatggcgtgatttggcctgaagataagttagctaagctggaaaatcacgagatcacaaatgaggatgtactttctaatattgttttatttgattcatctagaaacagagagactgtttgtagtagtgattcagaaagctctgatgatgaagattttgatggagaaattattagaagaggtaggaaaggtattcaaggaggtaccggagggttgaataagattaataatggagaagaggaggatgaggatgatgaagaggaagatgaagattcacgggaattttttgaggagtctgtactacttataaaatctggacttgaaaatccggtacatatgtctaataagatcttagagttgaaaggattaagatttgcattctttaaagatgatcttgatattttagatacatgtataatgatggcattggatctacttggtaaaaactcaaaggagtttctggtggaagagaaagggtttaataacaataataatagtactagtacaagaatagatttggatagatttcgatcattttgtgagaagaaaggcattttagagctggtatcggctttcaataggtctgaggatgaagcctttactggcttaatttgttcaaagttgttagaatttgctttaaaaaggatttccctcttccttttggatctctcttag

SEQ ID NO: 2599 - DNA, 792 bp, Cryptosporidium hominis
atgaccgaaaattgcgtatttatcagaaacttatccccacttgcaaataaaaagtcggtacttaatatattcaatgaacttgaggatgaaattactgatattgaattccataattatccagaaagtgaccaaagattctgccaaatctcatttaaatcttcaaatggtgtcacaaaaagtattggatttaatggttcaacgttacttggggtacctatgtcaataacggtactaccaccaatacaaattcaaaaatctgagcaaaaaagaattgtctcaaatagagaaatatctgtaaaaaatttaccaaattctttgtcagacttgagaattacatccatttttcagaaatatggacaaattgttagtattaagagacaagatcccaatagtaactccaattccattataatagaatttcaaaatgaaagctctgctgcagatcttatagaaaaacgatatcttactttagaaagtggtgaaaaaattgagatttcttccgactttgaaatccagaaatatatttcatcaaatccagagactaattctaatcttcatgatattaatgataccttattaaatctagaaagtattcctgttcctcttgcatatcaacagatcaagaaacttgaatgggatagtaaattatcaaagatctattccattaagaagaagattgaagagagacttttgaatactttaaataacgaccttaaactccagtctggttttaaccaggactctcatcagccccagatctcccactccttctccttcccctcctccatctga

SEQ ID NO: 2600 - DNA, 407 bp, Cryptosporidium hominis
atgaaaaatgtaccttttatagaaactttagctatagtggataaggtaggaagtgaggaaaagattgattacaaagataatacaaaaagagaatcatacttttattcaaatactttgagaaatgtgaataaaggatgtgaaattctggaaaagatgaatataaactggaatagaccagatgatatgttagctgaaatgcttaaaacagaccaacatatgaagaaaattaagatggatttacttaaacaggagcagaaaataaaggctgttgaacttaaaaaacaaaaatatgttgagaaaaagttcactaagaagatccaggtagagaaaaagaagctcagaaagcaagaaaccaagaagaatttgagggaaattgagaattggaaaaagagtgatcataaaaatag

SEQ ID NO: 2601 - DNA, 2304 bp, Cryptosporidium hominis
atgcaagtagaaaattcatcaccaaatcaatataaaaccaattgcgaaacaaatatgacaagcgaacaaactaagaagcgtccttctgatgtagcaaaggaagaacaatcaaagaaagtctgtactgaaacatctggtgacgttacaactacgactacaactacaactacaacaggaatttgtgattctgcatcttcagtttcagtttctggtaacattaaatcttacagtaaggttacttttacagctccagagactactactgctggtgctgctagtgttactagctctactaacactactgaaactactaccagaactactactggtgctactgctggtagtactactactactaccaccactaccactactggtgctactggtaccactactgatactaatactaccaccactaccactactactggtactactggtactactggtactagcactactggtactactgatacttctggttttacaactggcgctactactacaactacatttaagaaaactgcaacaacaggtactcaaaaacaaggtgagaataatacagtaactaacacttcaacagtaaatacagaaacggttttcgattctggtatgaagattcaaaagactgttaataagaccagtactgaagatgtaacaagtacaacaatgaaagtgaaaactacaaagactattactacccaagaagtaaagccttctagtgaaggtgccaaaaaaagtacatcaaatatgactgtttctgctaccacttgtaaagcaggaactgttcagtctgaagcagttacgagtcaggcttgttactttgatacaacagataatacaatgacttttgtttatcaagcaccaacaaaaactgaaactactacaacaatgactgaaacattcagcaatggttcaattacctctagacaaatagatattgaagtatcaaaagaaacaactgacacatctgtggcaaataatggttattctggagtcaatagtaaacagacaaaatgccaggaaacaatgaaaggtacaggatatgaaacatccattcaaggccaagaccaagcaagaaaacaattacagaaacaaaaacaaattgtacagaacaatcagcaggctggtcaagatttcaacggtgctcaggtttactttggagcagttcaaacacctagtcaaacaacttatggtaaatttggtgtaaaatatgaaacaaatcagagtggaaagacacaaatcaaaattactgaaacttaccaaactgatggtacttatacttcaaagaaggaacaaacaaatactgacggaacaaagtgtgttactactactagtactactgctgtacaaactggaactacagaaaaaagttacaaaggaactgttacaagagaaacttattctgttgatggaaagcagacatcaaagactgaagagacatttgaccagacaatttcaacaaatactcaatcaggtgaaactgttacaaaaacaaccacaagatttgcatcaggtaatgtagatggtgtaactacaagaacagaaacttttgtcactaaagctgatggatcaacagttactactgttgatcaagttttccaagattgtagtaagatgactactactactactgttccttctacttttactactcaaactactgccggtcaagctactacttctcaaactactacttctcaaactactgcttcccaaactactgcttctcagagtaccgccagccaagctaccacttttcaaactactcaaactactactggtcaagctactactggtcaaactactactggccaagttgctactgttcaagctactgctggtcaagctaccactactcaaactaataaaactaccactaccgattcatctactaatgataatgtctccatggatatttcaggatatgttagtgatttatcattaaagaatgttacaactggcacaaaaactggagaaactacaagaacagcaacagtaactattgtaaccacagacaaagattcaaaggttacatacaaagaagagtatatggcacaaattgattcaagctatacttctactactactactaatactgctactaccactgctactgctacaactaccactaaaactgctactaatacctctactactaccactactaataacagcgcccaaggtgtaacaacagattctcaaagggcagtgactcaatcggattcaaagtccaaagtacaagatcaactaaagacccaaactactactcagtttcaagatcaaaatgtatcaggaaactaa

SEQ ID NO: 2602 - DNA, 732 bp, Cryptosporidium hominis
atgggtggtaaacaatcagtcccacaaacatatgaagcattttcaggtaggatgggaaaattcccatcattatcagaagatattttaacaaaacaagaattagaagaaggtgtagtaattttggattctttgaattcaatgagaaaaatgaatagttcaacatttatggatattgagagtgataatacaagatttatgatggctagagcggaagctgatagaatagcagaggctgaagctttaagacttgcaactgagcaatcaattagagtgaatgatgaaggaagcatagtttatcaaagttcctatatttctttaccttcaagaaaggattcaacaatctcaaaacaaccaacacgttctggaactgttttaagtaaacaatctacaaagaatagtttagttgcattggatgagaatttggaagaagaaattttggataatgaaagaaacttagagtatattccttcaaaatcaaatattgattcagaagaaaataggagagaaatatttgagatgattactaataggtgtggagttgtattttctgaatgtaagagttatcctgttgaggaagcaaagaaattgagaaatgatcttagaaattgcgactctgaatatgcaatagataaaacagcagagacttgcggatgtttaggacctaaacatgatcgactaaattgtccaatatgtagaggtatgcatcttgaggatgctccattattatattag

SEQ ID NO: 2603 - DNA, 516 bp, Cryptosporidium hominis
atggtgattgtatttagaggatcagaagtgattgaaaatggtgtattatatcttttatatcaagcttgtcgtatttttaaacaattaggagtggaatatgttactatttttgaaccaaatggaattgttgaaagtaaactaacagttttattgaataatgaagacgaaattcctgctaatttacgttttctttcaagtggtgattcttcaaaagattttttaaataaaatacaaagaattgtagaacaaaagcataattctaatgaaaaagaagttacatatagagagatttatagtatattaaattctggtggtaattggccaaaggctgattgtattttaattctaaggaatatgccttttgatattccaattaatggttttaattcactctttgttattttaaatagacttagagaatatactgcttcattttgtactcgattatttatagttacatcacttggtacttggggtgagattccacctctattggctcagcatgctgaaatatag

SEQ ID NO: 2604 - DNA, 645 bp, Cryptosporidium hominis
atgcttgttaaagatggtgaattaagaaaattaaaggtaccaagatctttatcttataaaaatattacgtcatctataggttatagtttaaagagtgatatattaaaagtgttaaaacaaagaattcaagaaaagtattcaaatttagaaggtcaaaatcgactaaatggatgttttttggaatgtctttttaataatgaaaataataacattttattacaaaacattttaaacttaattaaagaaaacatttttcaaaattataagacaattagtataaataataagcatcttttggattatttatctttgatatgtattcaatggaaaagtcaatataaaatttgtcaaagtcatcaaatcaatttcaatggagactttttattgaatttactaattaaatttggtattctaagaagtgatgcttcagatttacatagtttaatatttactaccccttctatgggtttatttatacaatatcttgaatctggaaatactgttattattaattctttaaaaaggagtaaatataaagaactttttgaagataaattcaatacactaaagcttggtgaatcattacttcctcttggctttcatcttagagatttacatggaactggaattataaaaagaatgtaa

SEQ ID NO: 2605 - DNA, 204 bp, Cryptosporidium hominis
atgttggaagaaaatgataaggacgagaaaatcatagaattcctggaaaattatgaacattcagaaacattaaatacattcttttcattaagaaaagattgtattggtattattgaccctccaatagtattagaacatcaaatattaggaaatgatggaaatagattaccaattcaaggtaagtcaaaaataaatagaatttaa

SEQ ID NO: 2606 - DNA, 600 bp, Cryptosporidium hominis
atggaaagttcacgtaattaccagacaagtgattctttaaacttcttgaataatacaattaacacagcatcagcctctccaatgttatctttaagatatcacccttttgaaaatatttgtggattcacaaacccatattacggagaaaataatggacttacagagctagaacttcaaaagcattcaaaccatatgagatcagttacagatgccatgcattacttctttaaattacatccttctattatcacaaattctccctcttcaccaagaagtcccgtaattgaatcacaatctcctcttgttagtccagcagtctcttctaagaaaaacaggaaggaagtagaaaaattggatgttgatcatccaaatttatgcactactcaatgtagggttatccatcccaatcttgtccacagtgtcaaccaaaggtggcaattaagagttcatctattaaaccagaactctggagtcttaaaagccgctgatctatctcacccttatgttaatgagatcattaatgcaaacgctcctgtcactccaaggatgactagtagacataccagtaggcatattagtagaaaaactactgaaaattga

SEQ ID NO: 2607 - DNA, 1821 bp, Cryptosporidium hominis
atgattcattctactattgaacaaataccacaagtttataataatacatcattttctaataatattgatattggtgtagtaccacagtgttgttggatttggtcaacatatgttttcttaaagattattaaatcattcacattttgccttgaaaatatcaataataatgattatccatttaagaataatcatcatggaaatcttataggatttggattggatgatattggatcaacttctccaaaaattgtgggtagtggtgaacactttggattagtatctaataataataataataagaataatggtataaatcaatcatgtaattcaagattagcaatgaatttgactgtattaattagaaatctattttctcctgaagatcaacaaatgtttgttttaggagaaaaactcagatctcttttatttaattcatttaatctgaaaagtgagtcacaaggatatggagtagtattgatatcttcaatgatgtatcagtattcgagaaatatttctttacataacttgatgatttatacaagacgaagctttacaggtaaagaaagttgtttatcatgtccaaaagatattattgtttctatttgttgccttattttaagaataatatcttgtacatggtctaataacttttctagtattggtgaaagtggaaacaataatgtaactaataataataataacaataataataatggaaataataacaataatagtattaataataataatattaataataataataataataataataataataataataataataacaataataataataataactgtaatattaatacagctatgggtaatactacaaatagtaatgatccacatgtacatgatagaaatccaatagaaggtaatcaatggtgtacttgggaatttacttattcaaatataaaacaaagtgtattgcattttaaaaatgaaatggataatgcaagtaataatgagagagcttcaacaatggttattttacaaagacatggatgttgtacaatgctattatatgaaataattagaagactcagcatagaaagtagagataattttgtgaatatgatgcaaaatgatggtataaattctttgttatatgaattttggattaagaaattctactctataacaaatgtagagatttcaagatcattagaaccattctttatgtggcaaatatctatattaggtaattgtcatactccaactttatcagttcaaatacttttatcatctcaatacttggttccaagtttggatattgctattaaatccttacaatttaatgataaatatctattaagctcagttttagtttatttaacaaaattatcaacagcaatacattcattttcacagatacatggtatttggaatgaacatcttagcagattattgatagtgttattttcagtttaccataactttgagaaaaatacactattacaaatgtgtagattgatatcaacattattggaatactttcctaatagcttttttatggtgcttaatggaatgttttctccagattttaatagaattcatcctgaaattagatttaacccttttcaagatacaaatcaacatcaacaaaatatgatagtgatttgctttaaaagtttaaaaggcggtgccagattaaaacaatttctttcagagatttccaatgttacaaatggtatatgcagtatggatgattgtcttgcgaagtttgagattttattaaattcaaataatggtattaatacgggtgctcctggcagtaataacaacccaataattatttcttaa

SEQ ID NO: 2608 - DNA, 171 bp, Cryptosporidium hominis
gaattttattcaacgaaaaagattctttttcagtgcatttgtcagaaagtttttgatttttttctcggaatttacaagtttggagacaaagaagtagagaattctgaattacttttcatcttaattaatcataaagagacaagagctaaaagagctaaatattgcagataa

SEQ ID NO: 2609 - DNA, 1890 bp, Cryptosporidium hominis
atggagagctcagaagttatttggtgttcaagcagttatattagacctgaaaattcagatttagagagtgaacgtaaatctatcgttacagaatccatattagaaactgaatatagaattgtatctgcaaatgatttagcaggcgttccattatctggaaatgaaaaagtatttgcagagcagcatctatggaatgttcaactaaatccaaatcaaagctcaaaaattgcagaaattcaagaaaatgttactagaacaagttttttaggtacagaagaaaaagatgacaatacagtatttttcaataattggggtaaaattggaaaaattattctttttatttacatatcatttttgtccatgctacatgatattacaggaattgttattcctaactctgtttataaatcagagctatctggcccagagttaaatatagtatcagaaactccaagtattgcatatatatatccatattattggaaatatgtattggagcctattagatatataatatatataatattctactttatttggggtattgaacttactccaaagaaggaatttgataataaagatgaggattatagagaaaagttggtaaaggaagaaggaattacatggatacctcgtacattaaatatagttcatcctattaatggctttaataatactaaatgtgggataagtatttactcaagaccatcagaaagtactattagaacatgcaaaggattacgtactagtacaagggaacatagaataatatgtaatttatctcaatcagaaaagaataataaaagaattcggtttgttgcaatcaggccaataggaaatattatagctattggttattcaaataatgtatcaatatgggaatacagaccttctatattaagtaatgggaatacaggaataaatcaattaaatccaattaatggaggaggattaagatcattaagtgacaatttaaatttaaatggaaaatggaattatatatactctgttgatctttttaaattaaatagtatttcatggtcaaaagatggatcatcattatatattggagatggatcatcaattagagaatttaattacacttattttgttacaaatgattcaaaaaaattgggttattatataaactctgaaaagtttattaataatggctgtgttgttgcaagaggacctactttagcacatgattgtgtttccattgctgtttcaggaatattttcattaattggaacaatttgggagggtggatattttagaatatatgatacatttacttgggaaaacatacaaatttgtcataaatttggattaagatcaaaaacatttattccaaaagtagagtgtgtcgataatcttcttgataaagattcatcaagctttttatttgcagatgatcaaagtatttatgagactttgctgattaatcaagaattaaaagaaattaaaaaatcaaaaacaatcaatgtttcttcagtttctgaatctcagatttctaatggaatcagattaagagaattaccaattcattcaagaaatcgtgaaaaaacgattttgaatttttgtacaactttccaaagagttgcaatagtctataaagaatcaaatatggtctggttatattgttatttaatgtcggctaacactcctagtaaacttatgttgattggagttattcaagattttggaattcctttacaaataagtatgcaaacaatcaatgaatctaaccatcttgtttctggaactatgttatctgttaagtggcagaattctgatagattacatagagagaactcccaaatcattcaaagtgttgatttattacaagcaacaattaaaacatatcctttatttcactatttacaatga

SEQ ID NO: 2610 - DNA, 246 bp, Cryptosporidium hominis
atgattttggatccaacttataatgaaatttcataccttggggcaagcaattattctactcttgagataggtctttgtacaattagaaaccaagttgtatatttatcagcaaatggagacttctttaaagacccaaaaagaattgaagaagggttttcccttgcagaagcttcctgtagtgcaattgttgatgaaattaaagaccacttaacttcagaattcaataccaatttcaatgaatcctaa

SEQ ID NO: 2611 - DNA, 579 bp, Cryptosporidium hominis
atgggtgcacctttggcagttggagctctagttgcaagaatgttgagtatgctttggtcaaaacctttaatcggagtaaatcattgcgttgctcacatagaaatgggaagactcgtaactaaagttgaaaatcctatagtactatatgcatcaggaggaaacactcaaataataggttatgccaacaaaagatacaaaattttaggtgaaactttggatattgcaatcgggaactgcattgatagatttgctagagtcatgaaacttgacaattatcctgcagcaggataccatattgaacaaatggcaaaaaaaggaaagaatttaatttcacttccttatgttgttaaaggcatggatttatcattttccggaattctaacttttggagaagaattaatagcagaaaaacaaaaagaatttaataatgataaacaaaaattacattctttttatcaagatttttgcttttctttgcaagagaccctttttgcaatgttaattgaagttacagaaagagcaatcagtctattaaactcagattcaatcttgctagtcggaggtgttggatgcaattaa

SEQ ID NO: 2612 - DNA, 1620 bp, Cryptosporidium hominis
atgaacaatttatgttggagatgcgaaattagaaagacttcattcaatgttgaaaactttaaatttggttctgaacaagcaattttagcaaactcattatcaactaataacaaagaaaagtgtcacagctgtagagatttattactaattgataatagattaaagtattgtatttcgaagattccaaatgaagttaaaaaagtaaggcgtaaacaatctaataagtttatggcagttcaaaacacacaatcaggcataattaacacttatattatatataaacaagatgatatcaatgatgagttaaaacatcaatcaattaaaggttacttgggtacagtttttaataatgctttaactgcagcagtatctaatgatactggattgaaagttaaagaagcaggaatttccattgaatttactccagaattaaggtttaattctgatcaagagatgtgcttcagtttaaaaaattgtctaagaaacttgttattaagtcaaataacttctgatgaagatatgaatactaatttggatatttctcagaatcgaattcatactttaaaacttaaccaaaatagtgaattatatatcaactttgttttttcaacaaaaattccaccgcatttagaacatgttaatggctttatgttttctatggttgtttcttatacatggaataatgtatacttattgggtcgttacatcaaattttccagaagaatatcccaatcaaaatggggattttcagatggtgataaaaacaaaataactgttgatacctctattgaggagattcttattaattctttgaaagaattaataaattttgggaaattcacattttcttcatcaggtagagaagatgttgatgtgagaatgcttggaaaatatgctaatacactttttgaccgtgatcttaatttaaatgaagaccaaaattatgatcagagtagaaataattatctctcaacggaagtcaagattaaacaatcaataactccaactggaaggccttttgctatagaaattggtaatattttaagccatcattatttattttatccaaaaaacattcaggttatggatttgaaagaaaattccaagtatttttctagagaaaatttcatacaactacttaaagatactataatacagaaatctaattcaagaattgaaatatcagctttaaatttctcagattcttattcggttcaaaaaatgaataaggaagttaatgataggcaaaaatcataccgttgtatttgctatatatctactcctatttatatccatgaatatcacgaaatttcagataaactcaaatttcctattaaccttaatcaaagaactcctgttcgtgttttacatcgaaggccaaatataaatagagatcgtaaaatatatgatctcatgatttctccaattaatgaaaactactttattttggacttattggcacaagctggtacatatatcaaagagttcgtaaatggagatcttggtagaacttctccaagtttgggagacttgattcaagaatccttacctgggaaatgcaataacgaagagaagctaaatgtaataattgttcaattggatgtattgaatatttattaa

SEQ ID NO: 2613 - DNA, 2733 bp, Cryptosporidium hominis
atgaatggggagttaggaagtattagtactgaaaatgattccactgatagattatataactcagtgtataaagggagtgaagaaataaatcttcagtcattagaagctggtaacgatcctctttcaatatacaagcaggtttcatccttgaatgattgttttgaaggtagagataataataacttaaattcacaatatcagaactttgatatggataaaaagtcgttgaataaaactttagaagatctttcattatttgatccatttccaagtacacaaggtagatcagttgaagttaagcctatgctagcttctccaacaatagtaccagagagccgaagtaatatcagtaaccccacaacaaatgttaataaatccagttcaaatttaagaacatccacaagtgtttcaggtttattttcttcttttgcaaacacagtaacgcagaatattagttctcaaatacagaatgcattaagagaaaccacttcgaatatgatagtgagtaatagtaataatcaaaaagctcaggatctatccagatggtcagagatcctttccaagattcataataataaaggtccaatatcaaatacaagtctggaaatttgtgaggctgatgcagagaatataactaaaaatatgagtattatacttcttcctggtgaaaagttgttgttatttagtaaggagtgtggaatttctgctcaaggtctggtaggtcctatttttggatccttcattatgacaaactttagaatcattcttgctcctcttttccaaaagaatattaacaataaagcattgacaatagtaaaaagattttcagtatcttggatgtacaaatcaggctttcttcatattccaattcattcaataactcagattggggttagctctttgatttctggtaatgatcataatggagtacaaacagaaggcagtaatagccatacaattccaggacaatatattggaaataacttgaatctagtaggatcattaggtacaacaattggaggtccaggaattgggcagaatggccaaataaatatgaattccaaaagttgtacttatacattggatatttcaaccaaagatttgagatcgatccaaattttaataataagctctgagcaagacaaaaagctaattcaaaatagtattcaaaatattctgaacgagactttgcataaaaacttgttttcgtatacttttatggagaattttaagagtttaccattattttcttcaattaatgggatttttgagtttgatattttgaaagaatataatagacaaggagttccaatatcatcaggtttaattaatgaaaatacttcaagatttcctttaagattcacaaatgtgaatcaaaactttgagctttgttcttcatacccaagaataattgtagttcctgaaaacatatccgattcacaactaattaaagtagcagcatttagatcaaagggaagaataccaattttaagctggacaaacccagatttaaagtgcactttatggaggtctagtcagccaaaatctgcgtttaaaagatgtattgaggacgagataatgataacaaccatttccagcttttacaaaaataatggagacccaaaagaagaaagaccttttgcaatactggatgctagaccaaaattgaatgcattcgctaacaaggcaacaggagctggatttgagaatattgatcattataccaattgtaaattagagtttttgaatattgaaaatatccataaagttcgtgattcttggaataagttggtttcagtaattcaaaaaacttcatctaatcaagatttgaacgttggtaatgctaattttgagaaagtgatgaatttacttaaccaaggagatatcagttctgttcaagctcaatcattacttgcttctttgaatagaatgaataattcagagaatttaacaggactaaagttgatttcagaaatagattcaacaggctggtatgacttaattagtatgattcttgcatcatcaaataagattgttgatcatttgattaggaaaaagggagttttggtacattgtagtgatggatgggatagaacttcacaactaacagcacttgcaatgctttgtatggacccttattatagaacaattcagggatttctttcacttatagaaaaagaattcatactttctggtcacaaatttcattccagatctggtactcctggaaaagaatcttgtttagaaaacgagtcagagagatctccaatatttatccaatggctagattgtgtttaccaatgctataatcagtttccaacagaattccaatttcatccaaacctattaattattattgctgatcacttaaataatagtttatttgggaattttcattgtgataatgagtatgagagattttgtatagattctagaaattcgacggtttctttatgggatacaataatgtattctattaagaataattctgaaggtaatctggataattgccaagttgaatcccttctttctctaaattcctctataatattccataaagagcttgtaaatcctctttataatcccacacatacacaagtcaggacgcatgctgatgtattaatactagattcttcttcttttggaattactccttggatgcctttttggttcagattcaccccaattaatgcaaagactgtatctaacccacttttatataataactactaa

SEQ ID NO: 2614 - DNA, 828 bp, Cryptosporidium hominis
atgttcaatgattcatctccgcaaggttggtataagaacttacctccaatcacgaggagtatcctcacaataacatttttttcaactttattaataacttttggtatgttgaatccatggtatattctctttgattgggagtacatttttcgcaaggcacaaatttggagattcctcacaagcttcttttttgtgggtccatttagtattggatggattatgagccaatggatgtttacatcattttcgtcaaaattagagaggagtgggtcggttggttcctcatctgggtcttatttgtattttatattgattttaatgacaggaatcaacataataggtactgcttttgattaccccacaggaagaaaaattggaggctcttcattgattttcggtataatttattactggagtaagaaattcccaacttctttggtaagtatttggggattcactttgcaagcttatcagttaccatatgcattgttatttttggatgttttgactggtaactctttgattgacgatttgattggattattagctggacattcttattactatattagagatattatatatgagaataacgcaaataacttcttagccagaactccaaagcattttgacaaatttgttgactattcttctttactgattaagaactatgtctatgacttttcatctttaaatggccatcctaatgtaattaactatccaaattcaaatgtaaatagagccggttcttcttacaattcattttcaggaaactctgctcaacctagagccttttcaggaaggggatttaggctgggttcagattaa

SEQ ID NO: 2615 - DNA, 1269 bp, Cryptosporidium hominis
atggaaataagtattaaggatgattttgagaaggcaaagtctctgattgagacagacttcaaattatcaattccaatattaatcgaattgattaaaaaggacaacttggatgaaatagaagatggaaccaaaattcaagagcaggcaatctatacattaggagaaatatatatgaaacaaggcatggcaaatgaattgaaagagcttattgaaactattagaccaataattggtggactaccaaaagctagagttgcaaagattattcgaaatctaatggacatgatgtcaaaaattccagataccgaaaaactacaagaacaactttgtttggagtgtattgaatggtgcttagaagagaagcgtacattcttgagacacagaattactgctcgtttagcaatggtttatctgaactctagtcaatttgttaaaggtttggactatattgaaaagttgattaaagaagttaaaaaggttgacgataagattctattagtggaagcttatttgatagaaagtaaacttgagtatagaattcgtaacttacccaagtctaaggcagctttgacagcagctagaactaatgcaaactccattcactgtcctcctctcttacaggctgatatagatctgcaatctggcattatacttgctgatgaagaagattttaagacatcattctcgtacttttatgaagctttcgaggcatttaatattgcaaatgatgaaagagccttgcaatcattaaagtatatgttgttatcaaagatcatgtcccaacaaaccaataatttagcttctctactttctggtaaaaataaagttaagttccagatgagagagattgaagccttgagaatggttgcatcttgctgcgaaaatagatctcttagtatgttcgaggatgttttaaagaattatgaaactgagttaagcagtgatatggtcattcacagacatattaataacttgtatgaaagtttgatggagcagaatattttgagaattttggaatcttattcacacattgaaatccctcaacttgctttattcctcaatctttcttccgagagagtttattccaaggttattgaaatgattttaaacaagttgattcagggaaatattgatcaaagaacttcagttcttactatctatgatgagaatcagaattctaatttaaagatccccgaacttatctctacattcgacaatctttcaaatgtcgttgatgttttatatgaaaaagctactaggacagtataa

SEQ ID NO: 2616 - DNA, 750 bp, Cryptosporidium hominis
atgaaattccaaagtgagaaaaatgaggaaaataaagaaagcataaataagtcatcttcagcattgataaactcattaagaaaccaaattaataaagtatcagccttgaataaatttcgcttcataaatagtaataaaaagccacttgaaaatgaagtccaaataagtgatattgcagataaaattcgcaataagatctcaataaataagttaaacaagagtccagggcttgagcatacaaaaaataagtattctgaagaaattggaggcgcttattcaccatttagaaagagaaataagaataatgaaaaatattccttgcaaaataaaatgtcgaattttgaacaaactagatcagaacttgagaatctcttactttataatatcaacaagctccgtcatgagagaattaagctgaaaaactgccaaataaatagaaataatagtcatgatgagaatgaaattctatttccaaatatttatacacctctatcttcaatgaagttcatgaatatccaagaattatttttgtttctttcattgttttatcataattaccaaagagagtggatcttaccattattaaataacttgaaaaatctcgaaatagtcttttttaccccagaaagtacttcatcttcatactcttcaacaataattacaggtagatatactaaaattttaaatgaggaatatttgttttcaagcaatgcaccaatttcaaaactgattttaaatgccgcaaagtaa

SEQ ID NO: 2617 - DNA, 1179 bp, Cryptosporidium hominis
atgccactctttgatgttcctgatgaatcatcagctacaatcttatcaattgattctccaatttgctgtatagatatagatcctacaagaagaggtcgaatattattcggaggatgtgacgataaagcatatgtatcaaatttaccagaaaatcctgtctattctagtgagcagggaactgaaagacttaacttaggttttgaaaaagtatttcaaggtcattcagatacagtttcatgtgcttcttattcaacggatggaaaatattttgcaacaggaggttgtgatggaactataagagtttatggtaatgaagcttcaaatgaaggccaacttatttcaattctggagggtccatctgacgagcttgaattcataaggtggcatccgcgtggaccatgtatatttggaggcggagtagatggaacaggatggctatggatggctcctgatggaagagtattatctgtactttctggtcatggagatagtattacatgcggagattttagtaatgaaggtaaaatagtgtgcacaggatctctagatggaagcgtaattatttggaatccaaaaaatggagaaagtttgcacaaaattacaagaaatagttttgttaataacgcaggtgactcatcttatttagaggaattgggtatagtttcaatgagaagtcacaaaaagaatccgttacttgctgttgggtttactaatggtttattttctctaattcaacctgaaactggcaaagttctaagcttaaacaacagacatcatgattctctagattgtattgaattcattaatcatttagaagatcctctattagctactggagatatgtctggagaattaattgtttggaattatgaatacaatagagaaaattttgtaatgaagaatcaggaattggagcattcaaatggagtcttgcctggtattactagtatatgctggggtggagatagaaacaatactttaattgcaacagggtgtttagatggaactattagattatgggactttagaacaggagaaaatgttaaaattcttaaagggcataaaagtggaatattatccatgaaaatcgtagaatttggttttcaaggaaccaacgtattaagaatggtatctacaggagatgatggaagatgtttgctttgggatgtaagaatgtaa

SEQ ID NO: 2618 - DNA, 510 bp, Cryptosporidium hominis
atgttaaaagaagaaataatggatttgattaataggtcgtctttaacaatatcaacagaaggaattgtagcaccagtaaacgaaataaagaccaatttggatattacaacaaaccttgatgaagttgttgtaggtaatgagaatcttaatctttcaggattaaatagccaaacaggagcaacatcacaatcgccaaagcatttgcaattaagtttatcaagtagaaacataaaacagaaccagacgaatttaaaaagttcacttggaagaaagaatgggtctctcagtgctttattttctcaacaattaggaggtgccattagtaatttaaattcaacaagtaatacatcaattgctacaaccagtttgagcccaataactgtagcagaaacaagtactagcggacttattcattctcctacatctttaataggtaactcgtctcttcccctatcgacaaaacaaaagcttggacaaattcattgcctaatacttgggttagagaagtaa

SEQ ID NO: 2619 - DNA, 2013 bp, Cryptosporidium hominis
atgagaatacaatatatcatattatttttatggattgtgctcttaaagttggcacagaatggtatgttggcaactgatgttgtaaatcaatcaagttctgagtcttcatatgaagaaactgaaggtagcaaagctgaggattcagtatcaacttcagatttaagtaagtctgatgataaaggttttacaaaaaatgaaggttctgttcaaagcacctatgctgatgacgatgatgaaggttctggtgaattaagttctgagggagaagcttcagaatctgagatgaaggatggctcaaaattatcggaaaaaaatagtgaggagattccaataaatcagagtgaaagccagccattaaatagccaaacagaacaaaaacaagatatccagattcaaaatgaagagggcggaggagcatctttatcaggagactttgttttaagtgataaagaaagctcaaaaagatccgaggtcgttccagaggagtcaatagttccagccttatcaggccaaaatcaagttgaaagttcaaaggatgatgatgatgatgatatagtcaaagatgtattacctactgaagatccaaatgtacaaaaggcttcagattctattaaggatggaatttctggaaatgctatcggccatgttgcaccagcaactcttgatgtattgttaggcgtagtacagccaacaagatcttttaccagtgagccacaaaccaggccattgcagacacagtttggaagaaaaagaagcatagatgatggcgaagaacccaaatcatcaaagtatttgccaactccaacatgttctgatgttatagaaaagtttgagtggaataaagatttaattggtacctcatctcaggcagcttttaaaataatattcggtgaaattacagctctaaagtctatgacaaatattcaagctgaaaagactattactgcagcctttgatgttcttaaggatcctgctgcagaagggatcaatcctcaagaggccttagctttgtatgtttgcgaagctgataaggatcatgggagatcagtttaccagaaattgatagaatatggatatctttcatctctacttcatccaattgcccataaaatgtggggatgtgttaaatatggtcattattatgattctgctggtaataatcctttgcatcttgcagcaatgtctaacagtttacaagttgttgactttgttttaagattaattaaagatcctgttgagattaagattgctttagaggagaaaaataactccaaccagactccactcgatattgctgttgatgaaagacgccctagtattattagaagacttaaaactacatacaggactatgtctaactttgttaagaagcttgatcctgaagctgtaatggaggagaagagaaaacagaaaattatgacagaaactgctgcactattctgcaagcctgttttaaaaatgaattcaaattatgaagaagtagttaatacagctattgaaaaaggaaaggaagttagtcaaattatggataattatgccttagaggaattaaacaaagaatctgttcagaagaatcttcgtgctaaaagaaaggaatataatgatagaaaggagttactcttatctgcacataaacaccagaaaatccagcctcataatcctgttgaactttctgaaagtattctcgaggacgaagttattaaatttgaacatgacgacggtcaccaccgtcataatcatcaccgtcatgccattgagcttcaagacatacaaggaaaaattttagatgaggctaatgaaagtagtagtgaaaacaacattgaaaagaaagcttctcatgaagaacaaagtgaagttgatgataaaaaagctcaggagtctgataaaggcgaggatgagcaaagtacaaaaccaaaaagcttccttgaaaaagttcttttctggtcaattattatcttctgtattgtcttcactgtggttcttttactcatttggtttgcaactaaagtttaa

SEQ ID NO: 2620 - DNA, 1728 bp, Cryptosporidium hominis
atgaagatttttacggaaaaactggctgtatttatcgccgtcttggtaatattaatttcgaatatctcatgcaacgaagaaattgaaatccctgaaaatgttacaaaattgaatgatgataactttgaagaattcattgatggaaataatcttgtactagtattattttatgattactccattacctcaaaaaatataatccatggtcttggatatgtttcctcaaacgtagtaatgtcaaaaggaacaggaaaaattgctgttttaaattgtgaggaatcttcaattcaaaagaaatttgaaattcaccgtcctccaaaactgttattcttttttggaagtatgaacaaatttgaggcatatccaagccatctaactggtttggaaagagaatcaatgatttcgattatccttgcaaaagaaaatgctctcttcattgaacatgatgccagagatagtgaatcattggaaaaggctatgatagagtttgacttggaaacaaaagttcgctcctccaatctccctgttattgtttattatggtaagccaggtactaagagaactgatgtcgtaaaaaacacactcgaaaagttaagaataactggagtttccgttaaagcattcattgtttatgttaaatacaaggctgatatcggattacatatttatagattgcctgattcagataagcatgactccatgaatactcagccaaaagaactttatattgcaaagaaaaagatcttgggattattagagtggaacaaagatattttatctgtctttattgaagcttgcataaggccatatgtctcttttaaaggtaatgaaattatgtatgtacacgaaagttctaactctttaatagctttccttaagggaagcaacactctagatcggtatggatctagcaatattcagtacttagatcatgattcaatggaatctttgagagcttttgcaaaggctaactttttcccagaagatccagataaggacttaatgattgggcttgtattaccaggattagaacaggaggtagaaaactttactggttttcgaagggatgctcatgtgaatgatggaaccttcctcttgaaacttcgacaatccaaattcgagcttggggactccgggaagtctgataaattcctgcttactgaaggggaaattaaaaaacatggatttgaatatttattttctcaggctaagaatagaaaattacctattttttataaaagtaagagaataatgaaacaccaaaaggtctctgctaatgttgaacaatatttcacaactccatatcattttcttgagctaaatccttcttccatcagagagctcatccaagacccaaatagtgcactgatagtcctttactattctgaaatgtgctcagggtgcatggatctccttccagtttggaactcgatctcttcaaaaattgcttcaaaatttggaaaagattccaaattccgtgtttttgtctccgctttcgatgtagagtcaaatgacaatccaatcgatatgcaaattgagaaaattcctttagtatattatttcccatttggagatgataaagtttccaagatgttcttatatgatgaggaactaacctctagagctgttactacatttataactgatagagttctagaggcgtctgaagacaatgatcaagctgagcaaaaaattagtccggattctcaaatcagggatgagctttaa

SEQ ID NO: 2621 - DNA, 6990 bp, Cryptosporidium hominis
atgaaaatttatctatactcaatttttcttttaacgtttaagatattgttttgcataggaaccaaacaaatatttcctattggttgcccattaaacagtatttcagattcattggtaaatgtaatccagaaaaataactgtgaatgccaaaaagatattgcttacacagaagaatgtcttgatttagtggacgaattccatgaaagtattaggctacaggatcttgaggcaatcactgctatgcttgataggttatgcgttaataatattaattcaatttctaattcaacaggagaaactgccttactcatttcaactcgacaaaatggatatatttcctatactatctcgttatatttgatagaacatggagcagatgtaaacatagtaggtgcgaatggaatcagtccattgattaatgctgttcaaagaagcaacttaccattagtggcattattattacttaacggagccaatattgattactcagataatagggatttgtctccattattttacagtgtaatctcaaagaatttgagaatgactcattttctgttaaaatgtggatcaaacccaaatattccagacagaaatgggctaaccccattttatttcttattaaaagacggaatgtcaacaaataccgaggaattcttggagttgcttttggactacggagcatctatgactgatttaacccttgaaggaaaagatgcgatttcgtttattattgagtcaggaaacaaaaagttattaaataaattaattgaacattcctccttttccaagtatattgtgaggaataatattgataacgagtatatttccagtaatgaaaagttacctttgaattctactcttgccgaaattaacagaaagttggccaatgcaaaggataaaattcttcgtattattactgcaattaaaagaggatttgataaaaaagttatcttttctctattactcccagaaatcaaggcatataacaaggatatatgcattgttagggataatgaaggccggaacttgctttggtggatgacccatcttggagatgaagaactgattaggattttggttagtttctacaagttccagactaatactggggtattggattttgaactttgtgaacttcatgaacctgatatatatgggaaccttcctattggccaccttatttacaaaatcaattatcaggaggaattgatgttaaaagagagcagagaacttaataaagaaaattcgcttttatataaaccaactattagtagtaaaaaatcctttaaaatgtttgaagagtttgatcaaattaatgagttcaaattttctggaaacaataacaataagttgcctaagttccaaattctcgaagaaatgcttatgtttcaaaatccaaaaaccaatacaactctttggtacgaacttgcagtgagctcaggaaacgatgttacaggtgaacataaaattgttgaatatctctcatcaccagccatagacttccacgtcaattcatttgtcgtgagatgtttttgtaagcctttaaaaaggtactcaattcctacaccacgatcgatacctattataggtacttcagagtatgataattcaatttcgattttatcattactacttttattaaataaaaattatacatcaaaagtggtattacagtcaatattaagggaggcaatgttacaaagcttttggtgtattcatgcattacagcatgctcttattactgcaacaattttaggaaaggatgatattattcgaaatattcttttaggaagagtccagacactatcagaagtactttcaagtcttgattactcatcagaagtgagtatccaagttgcttccagattattgggttcattacctccagaatttccaaatttagatgatttgatggctattcccgttacacttttggttagacttattattctttcgaatggtattgaaggaggaattcgtgaaattaattctaattcagagtctgattcagatgagactgagctagataatttggctaaaattaatagtattgaacacaataaaatcttccagtatattaatgaaagtttgacagcttctgattcaaatggaaaagatgtaaatgtttcagaaaagctagaaaatactacttttaatgagaaagtaaagagcaatagttccattgaaggtagtatttactctaatccagaatttagtcgcgatttctttttgcagtatcaatttgattttactgaaagcaataaggaagtagagaaacagaatgagctggatgagcaaaatgaatttgaagaacaaatgaattttgtgagaagtgaaatgagaagagggtattttgaagaagatgatcatatttctcaacacgatactagcggagaatatgactctatttttagtaactttgacaccattttttctcaaaagactaaacttttccaaaattatactgacaaaaatgatgaattagttaatttatcaaagactaaaacagaatatcgaaaaactgattctataggagaagctatcaatctagtaaaacaattattgtctccagaaatgaccaaatttgtacgttccagcagttttgaacatattatcaagattttacagaactccacgtgtaattatccaagaaataatgaagctgaactcttcttagaaaagaacgtagatttttcaaagattcaaggacttcacactcttaaaaatagattagagaatctaaatattagtgatgctaatgaaaatactcaaagcaaaaatttaaatgagaagatacaaggaatattggacgactttgactattttggtcaagataagatggaaacaacacctacacatggaagtggaattgatgtattatataaaaagatggataaaaaaatgggaataaatacatatttgggtaactgcttaatagagctaccaaacatttgtaatattatgcaaataaaagaggtcttatgggtacccatgatttttagtcaagatcacgaacatgaatttgatccatccagtacattgttgatagattcccaatgtattggtgaaaaaactgaatgttatattccgagtctaaatagtgattatcaaaagattcatcttggttacataccagaaataccagctaaagctaatgttactgatttaggtcccttaataagtagaagtaaactttatggaatgatgaataaacatccaatctgtgataaatcaagttcatatactacgtttgaagaactattggctaaaaaggcaaaattaattactttattaaatacaagccctcataatcatataattccatcagttattcggggttctactgcaattctattgacatctataatttacatattactttgggcaattatatcatatctcaaagtcttttatatcaaaaacatgataaacgattggagtaaggaaaagattaaaaagaaaataaattcaagtaaaaaaacaaagagtgggttaatcagacaaaataaaaaagaaaaaaagagaggaatatcgggtgtaactaatgaaagcaaaaattcaaattttaagtcaaaatcatcaattcagttattaacaaagaatattctcaaatatacgagaaaagcttttttaaatacattgccatattctttatttagattaagagattttgcagaaattttcccagtatctgcatcaggaaaagtcatcgattcagtattgttggcattgtctttaattttcacatcaccttggtatatttataaggataactctttaaaagaaaatattaaggataaaaagtctatgaatactattaaaactacaaagagtaatttgttgaatgctccaatgaattattttaagcaaaaaaactctcaaaaaaatacaaatcttcagtctattatcaaatacttattctttttcatacaaattatttcattaatttacttattcacgatacttttcctaattagtgaatatgactatatatggttcttaattggagtcattatcacagccgcactctgttcaagtgtcagaatatattacacacatgaatttgtctccaactattgtaacaaatacttttgtggattttctaaagaatattacttatataattattactattataagaaatctgtagaaaacagaaaaaatatcagaaatatatattcaaaccttttaaactgtgcaatgaattcaagtactttaattaaaaacaactattacagtcataataataataatgagtatgactatgactttgattgcgacaaaagtggtattgacaagaattctaataatagaactagtagtgaagttccaatcttagacaatcaaattgaaatttcaccaaatatgttgattccacaaaaattatcaagtcaaaaattaagttctagaaataattctcatatggatttaataccggagttacatgctcaagtgcatcacagatttggcgggagttttatatcagaattaaataatagtcgatcaggatcaagtttttcaaaaagtaattactacattaacacaaaagctagtaattcttatgcaaatgaaataaatggttgttcagtaacttctcaaccagattcttcgtctaatttttcttcaccaaatactgcaaggtttaatttattgggagtttcttcttcaaatgtgacaacttttggatcgagatcatattctcgttttacctcatattcatcatcatcttcaaaatattttgaaaataataactttgcagatgatgagaatttgagttcaagtgaatcaaatgaagatacaaattctcttggttcagatttagaattgataacaaaaaataatgataataaatataacaataggataaaattaaatccaaatcattctaaagtgaataaagtgaaagtaatgaagaaaaattcagttaaagtaaaaaaatctacaacaggaggagaatatatttgtttgcctgatctattatcaattacttcaaccatttctaatgataataactcaggagataaatatttgaaaacaccttggattcaaaactataattctaaaattgaatcaaatgatattaacattgcttttgatattaattcttcaaaatcttcatcttttgggttaggaaatgataaattttgttcaactttgagtggtccagctattagaataacccgaagcaacacagcaaacaaacgttttaagtcagttttatctaattattgtaatagaataaaaaatacacaacaaatatgtcaaagtgagactaacatatcaagtaaaacaagtatttacattaattctaaacggcagaaaaaaattccaagtattaatgataactttaataattttataaaaagtaataaccaagttaaaagatctattagattaagaaaaattaagaatattatttcaagtgcagaagataatttaagttgtgataatattagaacaaatattggaaatgttgtaactaataatcagattcataaaccattatatcgattagtggatgaagtgagttataatactccatatgaatactttaatgttgttattatttgcaagatattaagttgtattgtggcaatgtcatcaaatatatcaataacattatttaaaagtaattcatatttaataagggattcaactttatatttcctttataataaatctccaataacagtttatattattgaatgtatatttacatattggatttccaacttaatttttgagattttgaaaggtttgattattttattattctttgtaaaacaaagaaaaagactttgtattgtattagttcaacatattccaacccaatttaaatattcaaatgttcaagaatttattcaaattgttagttattggagaagtgcaatacaacatatcctttataagaatacaaagctttggacatctttcttaaatgcttctgtatctataaatactttaattttcttttgtattgggaaaattatgcttgttgcaatatataacaaaaagaatagaatatataataatcgagtttcagatctttcatcttctacaatgataaataagaatttaagttcaaatcaaaatctaaatggattatcagcttctggttcaacaaatattgtaagaggttcttttgataaagatatttcgagaatattaactacatctccaaatattataggaggaggaattagtacaaatttgttaaatgagttaaattcaagatcaataggggataattttatgaataacttttataagacaagatctttttcaacaaataaaaatcaatttatggattcaatttcaaatattgattatattttaaattcaaataataaagataattataatatgaataaatataatgatatatcatcaatgatagatttaaataatcattattatactaatattccaggagaaagtaccaacaattttataagtaatataaatttgatgagatcaatacgttctggtataaataataatgataataatccagtaatttcacattcaacattaacatattcaaatctagcaagtatatcaaatattaaaacttcagctctttcatttatgttaacaattcctcaatatgcaacttcgtatttatcttatcaaggaacaattccatcatcttcagaaaataatattatcaatacttattcaaattgtgagacaatttttttaacaatgggaatagttatgtttattttttcttcatatgtaataaggctactttatcaaataaacagaacatcagtaagaactcattcttggttgcaaaatattttacatagaactccaccaggagcagggatttatattgtgatagagaaggttctacttgtaataaactcaacaccacctttgcttaagatttgtggatttgatataacagaaaaattgtcagggttttatctttatatttttacaccacttgcaatattgacctttttcaagtttacaacttaa

SEQ ID NO: 2622 - DNA, 795 bp, Cryptosporidium hominis
atggatttctggtttgcagcaataagatttttctttttggaagctggaagaaatttacctcttaataggttcaaatatagtccaatagttgcagctctaaaacataatcacaagttattaccagtttctgtagatcaaatgaagtctcatgttgtggtgactttagataaacttttggctgaacatatagttttctgtgatcaccagcatcctcagccacacacatgcgatacaagattagaaataaaaggacaatcaaaggtcttttttgatgagattgatattgttaggtttgtgaggcaatattttatgcatctggaagttatggatgatgaattaataagaggaagtaggcagttaacaagataccgtcttgcaatgtatttctatgagtttttaaagtcaataaaaatgcttactgagaagggaaatggtgttttcaaactttgcagaattgagtatcttgtaaatacagggactattctaagacataggatatggcaccaactctatgcatcttggggtagctcaattaatgtcaaaaagtcaattgatgctaattcaggaaaagaagataaaaatttagggaataaatcttcagaacagcatgattcatctctttcgggcggcaagccaaaaagactttccgatagttctgccaaaatcacaaaaacgactaataagaacaagtcgagtacttcaaatagtaaaagtggaattgggcaaaacaaccctgatgatcttgttattgaagttttcctaacaattgctgaccattttcaatgggatagttag

SEQ ID NO: 2623 - DNA, 633 bp, Cryptosporidium hominis
atgaaggaaacttacatagaaatagctcaccaaattgggaaaggttggaatacactttcgaagtatatacagagatccgttaatgccatatctcatttacttgcaactcttgagctgcatttctccgatgatattatttgtaatcaaacttcagaagaaactcttcaatcgagcagatttaatataataaatgatcttaccactagaatcaaaaatttatcttcagaattacgtagttatgttagtcagttttttaaagaacatttttcaaatcttgaaaaaacgattaaatggattaatgacgagtactcaacttttaatcactataattctgataaagattctaaaataacaagtattaaaagagtccaagtattacataattctttgaaactttgtactttaattaaatcgaattatgactttattttgagctttacttgcataatcgcaaataatattgatgaatttgttcagcagaagctaatcgattcgaacaagaaatatccaaacaaatcttcaactccatttgataacaaggttctggatgaaattcgcaaaattgagaactttaattgctataactgccaagctgaattagaaattatctctaattatttagagaaaaattaa

SEQ ID NO: 2624 - DNA, 1734 bp, Cryptosporidium hominis
atgactacagttagcgaagcagtgagaaatagctggatgcatatcttttcttttgacagtgctattcctaggagtaaccaaagggaaactattggggaagttttaaaagaaattaatcgcataaaggatgaaatgcaaacattgcatttaaggttttctgacattgaacagggcaaattagacatattatcaattgagaatgtagaatctcaatttgagaaacttaagcaacaacttcagttacatactcttttaatcagcgagttaagaaagtatcatactgaaatagaagatttgaagaataaggaagaatatagaactcaagaagagagagaattgaagaatgaaattaggaagttaaaaagtgatttccatttattatctgagactgttaatagcagaaattcaattcaaaactctaatattccaagtattatatcaaaactggaaggtttacagatagaatttgattctttaaataacagaatgattaagaatgagaaaactaagactgaagttgaatcattaaaaagagatgttgaaaatttatcaattatgaagaagtcatatgatgatcagagctttattattaaacaaatgaaagaagatattcactcaattcaatcggtaatacaagaagacattcctcaactcaaaaacgaaattcaaagaaagatgaacaaaactatacaagctacaaatgagcttaaggaaaactttggggagcttaaagatcaatttaaacagattactgaagaaagaaggcatgatcacaatgtaatcactcaattggcaacccaagcagagcagctaagaatacagatacaaacaataaagatgagtcaaaaagacagttcatctagcaaaatgaggcaagaggaattagtgaatcaatgtgtgaaaaatatcgcaaaattggcagaaagtgttaacaaccttcaagaaaagatttccaatcatcttatcggattatctatcgcaaagtctaataatagtttttcagttgttgggtcaaaaagtaactcgcatattaaaactccaatcgtaattaacaaaactactccaaaaggtaattactatgaagtagcaaccaatggaagtgagaactataaaagaatgtctagcaagtcaaagaactcaccaagaagtcataataaatatacaggcaatcatttcactcttcctgatactccctcaacgcaagcccccccagttttatcatccaattctgtgggaagacttagctcattctttggtaacagagagttgagtggaattgcaagctcaagtagtcttacctcaagtaactacattgaaagtagcaatattgatagtgccaataatagtaggccaactacaaacaatacttgtgatcaagaagatgatattatcacgccttcaactattgaagaggaaagaattattacaaaaagaagagtatcaacagatggatttttgcaggattgtagtttaaagcactcttccacaagcttcctagagatcaaaagcagtgtgaactcttctgaagaaaccaactgtacaacttctagtgaaaatttcttaattagaaatactctccatccaagaagtgatttagttatgatgtctacattaactgagtccaattcaaagttatcatcaagtatcaccactccaaaaaagtcgggagatagatccaagactacgagttgcaatggcaatcacgctatatctgactttctgagccatttttaa

SEQ ID NO: 2625 - DNA, 1503 bp, Cryptosporidium hominis
atgggtgcaaatgaggtagaggaacttatattagcgttaggaaaggaaatggggaggaaagatcaggagatgaagatatttgttgatacaattgtgaataagaactggtatgacaaaatagaactattaaaggatgttacgaatgagcaatgggaaactatgaatattcccttaaggctggttgatatgattagaaaacgaatattttcacaagtaaacgagcctaaagctgaagaagactcgaaagaagaagtaaaggaaatattaaaagaagatgatacttgggaattcgagtacttgacgccagaaaatctcgaaatgactccatcactatataattctgtcgaatcattaggcagaatctgtaaggaaaagttaaaggcagtaactgatatattgtttaagatcattgattcaattattaaagagcctagaaaaggaaaaattagaagaattaaaatgaaaaatcctaaatttgcatccactgttggaagcttttcagaagcattgaatgtgctaaagtctgtggggtttgttattgtgaagcttaaaccaagccaaatacacaggattcctgtagatattactaagtacaaagaacaagaagaagaagaaaaagaagaggaatatctcgagcttcctattgcttatatatctcgtttaacagattgtcatcatctattggctatcttttgtgagaaaaacaggattgagtacccaaagcttgtttcttgtgatttaacttcaattgatacctcaggtgaaggctcagttaagatttctcactttaacccatatgtttcaaatatatcttcaacctcagttagtacaaataatgatgtttcaaggaagctaatgaaatctgctattgaagaaaggcgaaaaatggaatctgagatcaagaaaagggaaagagatatggaaaatgggactatagatgaacaaaatctccaggatagtggaaatatcacttgcactaagccctttgttattcattcttcgaatatacaaaagtttgataacttggttaaagcaatcaatgatatggaatctccggaagattttgatgaagatgataattctcattttgaacaatctgaaattcagagaattaaagattcaatacttggaaaggctcctacgttcaaaagcagaactaatgaatatcttaagtcactactgaagaggaaagttcattcccattcatcaattagagttgtttttccagataaatatattcttcaactccaatttagacctaaccacacaacttatgatctaattcaatctgttaaggattgcataaatccaaatatatcctccatgaattggtatgtttatcaatctcctccaatcttaaaagtcatcccagacaaaaaacttactttactaaaagctggatttgttcctaatgctcaactttactttaagctagaacttcctcctaatcataccttaaaggggaactatattaaagctcagctattaaatgaagacatttag

SEQ ID NO: 2626 - DNA, 471 bp, Cryptosporidium hominis
atgccaaatttaaccttatcaatttgtcagggatcatggctttattatgaaaatcctgttgcacactttactaagtataaacaaaataactcaaatgaaatcattgaaatcttgagttcatgtggtacagtttataaaattaatgaagatatcttctcgcattgtactagtattagtggatgcgggcctggatacttttctaatattgctcatcatttcatacaatctggaatcaaaattgggattcctgaggaccttgcaagaaagcttgtcatagaaacgatgtatggcacttccaagttgctttttgagtcttccattgatccgcaagtttttcaatctaaagtctctactcccggaggttctactcaagcaggaattgatatacttgaggatcgattaattgggaaaatttttcaagattgtctttactcatcattagatagatgcaatcaacttagcaagaattaa

SEQ ID NO: 2627 - DNA, 6756 bp, Cryptosporidium hominis
atgtttacagggagtgacttgaaaaacttagtattgaaaactctattattattgctactggaataccttatcatcaactttccaggagtttcatcaattgatgaaaaggttcaggaaagaaaagatgatccagtagcatatatgaaccccgccccaccaatactatttaaggaaatgaaaagtccaattgtgggagtgggtgatatttgttttggaaacaactgtaactattaccaagaaagtaaagaaaatagtccatccaaagacagagaaagctatcattcagttggctccaaagttacaaggtatatatgtatattattatcagaaaatacttttactagggaaaaagaggcagatttgctttttgaaagattaaacgagtatacagaaacttcagaattgccattttcatatgttgaattttacgagaaacttggagtttttgtaattgatgttagatccagtattaaggagtatgaagaacgtagtatatttcctttggctgaaggtttgaaactcatcaaaaagttagatattttaaacaaagccgactgtactaaagattctcttttaagtgaacaatctgtatttacaagtggaaatgaagataaatctactgagaattatagtaatagctataagtgggattggagcagtattcctaataattttgtaaattttaatcgaatcttgaaatccgaagagtctcaaggaaatgttacgaataacaatcaaggcacggaatatttaacagatgaagcaaagctatacaaagagttggatggttactttttgaaaaagttcaatgaagcatctaatctacttaataaactaaatatgttctcttcaccatcttcttcatcatcaaatttcaataatcctactgtttcatcaacatcattttccggagggaggcaatcttctctttggaatgcactcaactttttatccagcttttcaaataaggaagaaaagtctagatctacgccaatccaagaaattgaagatccaatttttggaaaaatggaaccaacagatggtaattctaaattaacaatatctccactataccttcttgggatgaatctcaaaggaaaaaacattacagagctatctcaaaagttcaaaaatcaaacatctcctatcgttcctgtagatatgtctagagaagatatcagcttggacaatgatcttgcaatgaatatagcaacagtaatcttcaaaggaatgagtgattccgctgcaaagcttccacctccttttgggaaccctgcagtcaaaaatgagcaaaagtttccagaatataattacaaaaaccatataaattatcttgaaacaaatgcaaataataactattataattccccatcaatctctaactggagttataaacccataccacagggtaacaataatgtaattggtggatatgaaaatgaccaaagccaactcaatattcaaagtgatcactttaaaggaggaagttttcatccaagttcaaataataatgctatcaatacaattgataattctattattggatttaatagtgtttcccaaggtaactcaaacagtaattctaataaagcaggagttcattctcaatctggttctggcttagctccaaatatttttgaatcaatagatacatggggaaaacagagctcagcttatcaatcaacttcttcttccgcctcccccccatcatattatgcaaaaaatggcattaaaactattaatccaaatcaagtgacatctaatggaaagagtaatcctgatttaaaagtaccaaccattaactccccatcaacttcagaatggatgagaaagactatatcgaagcaaaatgagggtgggataaagcaaccatcatttattaataaccaaaataatcaaacagaaattaataaatttgcaagtaatatgaaccaaaataccccctcaattgttaattcaaatggtaatcactttaattctccattttcacagctttcaaagttttctaacaatccattccatggaaattcagctggaacaacatttgtcaaaatgaatggtagtgtttttgatgatgataatgatatcacttcttttcatccggaaggatttatcaataaacttccagaacatgtacaaaagaatatgactcaatcccaaagagacaaaattaacttaataaatgcatttattggtactggatttgatacaattcttcagatgaataatatagattctagttcaagttatggtaatcagaataatgatttctttagaagttctccgccaaaaagaagattatttgagattgactcttcaacaagaggaaacaaaatggtgattgatgaaaacatgaaagaccagaatttaagtgatcaatcaaataaagaatatgaaatgtatgccaaattgctgagtaatattgacacgaaccaaggtcaagatactgcaatggcttatgtgacaggatgtgattgtgatagatttcctgaaggagttgcgtgtcccatggtgctttcaggagaagcgaatgttgaatgtattgggtataaagtttggaacagtgcaagaaaaggtgctccattgagtgagatagcttcagcaatagattctgcaattacttctaaagcaagaaatattattttgcctttaaaatttgatacaaagacaattgaagaaaatcgagcagctccaagaattttgaggcacatcatgagaagaacttcaagggagaatggaatattatttgccttaccaacaggaaataatggtaaacaggagttggatggaagcttagactttccttgcgatgatttgacaggaatgtacgctttttgtgtgggttcaattaacaacaaaaatggaatgccttcgaatttttccaatgttcctcagttaaataatgcaatctatgctaatggtgaggatgttgaatcaattggaataaatcaacaaagacgattattttctggtaccggtattgctttagctcaatcaattggtgctttgaatattattcaaggtattacaaaggataaaacgagctcatttgaccaacttgctatcctgtacagtgcccctaaaaaacttccatcaaggaattttttggagcagctttttgcaaactcgagtccgattacattcaagcctcaacagcaacaacaacaattccagaaacaaagctctaggaacgagacaggcccttcagattctgttttgatgtttggtatgggatctgggaacaatacaaatggttccttaggaccagtatctcatgaaaggatcatgaattcgagtctaatgagtggaaatagagacaatgatttagatgcaataatggccaggattgagagcattgaaaaaagtcttataaagtcaggtttagatggtggcaccgttttcaagggagaatttccagctggtggtccattttcttcgccttctgattcctctactttcccatcctcttccactacgacaactactacaaccaccagtccagttagaactacaacttccaatgcttctactctaaccaatataaccacagaaattcctcaaatatcaaattatacaaacataagtagttccagtacatccactctttctattagtctcaatacttctacccctaacatcgtaacaactcttccctctaacatcacggcaaaccctccttccagcatcgtaacatcttcctccagcatcgcaacaaaccctccttccaatatcactactaccaccaccaccagtccttccaaaactcccggagcctctaatccttttacagaaaaccaagaagaagaacatgggcactataaggaatctaactatagtccagaaataataggagttgttctagatccaaaagaagtaactgaagtctccagattagttcactccagtaatgaacattataaagagtactatgatagatatggaaaccatgatactgttgatcacgaatatgaaaatgacgatgggtaccgacaatactatattgatggaaatgaagaaaagaatcacaactacggcaatacatttaattcagaggaaaatatgtcaagaaatctttgttatgaagaggaaaccaggttctacagtcccttagaaatggctatacccgtagataatattgaacaatgtatattatcttgtagtaatactccagactgtagatactattcatatggagcattccttaaaggccctggaagcattattgggacatgtatattaatgcctgataaacaaggatcggtagccttaccaaacttccaatctggagctctgggatgcccagtttctgctagtattgcttatgctcaggctatggaagaaagactaatacaaggtattagtaatgcaaatgaaaatagtcaaaaaagttcttctgctcaagttaataacaatttaaactcggattggccggggatactttccacctctactgtagcagttaaaagtatgagtggattcttatctagatttcctctcaacgatatacttcaaacaagtatttccttatataattcaggatttctggatcaaaaaggtgctttaagaccaagtggagcttttgaaaagcaaagtatattaccccctcctggagttggatctccacatgtagtatgtaccctacaaggtatgcaatgttgtgtcccacagaaatctgctaaaggatggagaaaaaaaccaccaagttttcttagagttgaagatccttcatgcgaagctatttatgtctcaaaaacagatatgttctgtgcaaccacatcattatatgataaccaggatatctcttcatcaggatataattcgcttgatgattttaaaagccaatcctcattttcatcaaattcttatagtaataatccaaaaccttcaggaagctgtggaatggttataattgaaacaagtgagcatcttatttttcaaaacactctaaaaatgccttctaaagagatgaataatgcattatgtgaatgtaagctgaataaaagagataaaagtatacatggatctggtacttgggaatactcagtacaagcagtacaagctgcaatgagtcgcaaagttgaaggagatcaactttcttctggagttgctcaagctttagcttgggtagaagcagttgggaatgatccaaatcctgcagtgaatggacttggtgagcttatttcccaagttgctcaaagaccaaattcagatgtcgagttaattactcagatacctgcaattagtcagaatgctgtttctaatatgctttataatcaacaacaacaacagattgaagagcaagaacaaattattaagaaacaacaatctattcaacaatacaataatatgagatatttattatctcaaaatggaactgatactaataatactaacactcaaagtcaatcagatcaatgtttaacaagttggccagaaaaatgtcaaatttggaaatctaaatgtgaggataacttaatatatggttataaaaatcctcaatgcgttccattgactattttagagaatggatgtccaatgaaacaggttggattcaaggtgaatcaaataaatccaggaattttgagcttcagttttaaacctatgaggttttcagataattcaccattcagaattgcttgtcagttttcacttatcaaatgtactttagcaaatattaaaagtaaatgtaaatcaaatggtattaataactttaagaaaccaaagaatttgaacggagacgatgaaaacaatgcaattaataacattagaaaacatttaaataatcataaaaatcaaaataataatagaaataacaacttatttcacagaaaagacactaatgataaaagtaaaaataatgaactaaaacatttattcaaaattccaatgaactatcttccgtatattccaaaagatacaggagaaaatgacgagaaatctgagaatatcgtagcaaagtatattagagtccattttcctcaagcaggaaacttttcaaatatgacaatggtaaaactattaaacaaagagtctaagagagaatttgcagcaaaaatgattaatgaggaagaaataccaaaaaacaatactatcgaggatgtattaattgacgagaattcaaactttgagtatcttggtaaggtagagataattactcaagatgaaaatgatgaggactactcaactattaaatatgaaaatacatcaattattgctgatagaaagggagttgatgttgaaaataaggatgttattttcagccatcttataaagtcaagcaacgaaagtaaaatatacaaagaacctttgcttttagataaatatcaaccagattttacaggtgaatcatttcctgaattcaagatggagaaagttgtgattcctaatgaaaaaagtgctgaaaatgtaacatctcagagttttaataaagattacaactctgaatcaaaattaggaacaaacgaaagaaaagaaaattggaataatcaccaaaatgaagatggagattttgatgaatatgaagacttatactattatggatttgaaaatgattatggaagcaatcatagcaaaaatcaaattagtgactttattcctttcatttcaaccaataacaagaaaaataaatgggaagttcaaataaacaaatcttctggagataatagaaatacacaatatacaataaccaaaaagaatattcttttatttatatttgcttgttatactcctataattctcatgtttggatttatttaa

SEQ ID NO: 2628 - DNA, 252 bp, Cryptosporidium hominis
atgggaatttctgttggatttaaaatagttgagctaatttcaattagagataaagctcatcaaaaaagagaaactagaatacttcaaattctttcttttatatctcaaaagtgttggaagtatttatttggacatactggggatttacttaaaggtcaggaatctgatgatgaatgtaagttgaaaaattacgatttaaatctcagaaaaccaagaatatttaaatttctttttctcagatatgatcaatga

SEQ ID NO: 2629 - DNA, 255 bp, Cryptosporidium hominis
atggataaaactgaatggcttgaaaataattaccaagttaagatagatcagaacattattcaatcttttggtagggaattgaagcaagagtttaattctcaatgtgaggaatatggaggatgggatggtagctacacaagccctaagaaagggcaaatccagtattcaatacaagattctgcagaaaataatgtatcctatatgttgaatgtgcctaaatattctgtaactatatatagattctgtaatttataa

SEQ ID NO: 2630 - DNA, 2418 bp, Cryptosporidium hominis
atgagccaaggtcaaaataattcatataaattggataaatctaatttaaatattagacagattatttcaaaaaatatttatccaattgaggttttattaaaactttataagcctttaaatgttccaagaagtatcttcaaattggaaacagctgttcaaaggagtagtattcacacttcgaataattttggattttcaagaaattctggctctaatagacaacactctaattatttagaaagaaaacataaaaatggatattttaataatcaaaataaagctttcagtacgtttgatacaaatcactcccccacaaaaaatccacaagtttttgaagaaggaggagctaatggaacaaataatgggtattcttggaggaagaataagcctataacagataataatgttaatcaagaatctaaacgtggaaatcataccaaaccaagtaaaaacactgaaaaagtggagactgcaataggatttagcgctcataaccaattaactgatttagagaaagatatgtcatcaattgagaaaatcttaaacaataggtttgaaaaagagagcattgattctgagaaatttattagaaataagcttgttatggcattagaaggaattgactcgagaatttctcaaagtcacaatagcgaaacgttatcgggttttaataacagtgagaaaatcaaagtgccattttctgataagttaattgatactggaagtgatttaactgatgaaaaggctcataatgtaattcacagtgattttaaagacataatattatctaattactattatcatggtaattgtgcaacagcagattcaagagtatttaagagtaatatagtcaaaaacaatgtattgaatggtaagtttgtaaacaattcaagagccgttcagaatataagctgtaacaacgatattaatagctttaatgagattaatataggaattgacaataataatataaatattaatttattggggattgaaactaataaagaccattcaagggtaaatatccaaaataactttaataatttcagaattgataaccaattaattcaaaatcaacataaagttggtctggaaatgagacaagaaatagatatgcttaatattccgatttggttatacaaagaatcaggttctttaacagttaatggacctttttcaacaagacatatgagcagtttatggaaaagttatacatttactcatgaaacgttgtttacaatgacttcaaaacaagtttggggaccaataaacttattttacccagatgttaaatcaacatttacttatattcctgatttggaagtaatattacaaagacttacagattcttcaatccaaaatgataaagtagagaaaattaaaagtgaggatatttcatctattatttcagaaatcaatgagctacaattagatgttggtgatcaccatatttctcctccaaagttgattagtaatgaaaaggtgaataaaagttttaatactgaaaagaatttatccagtactctaagttctggaaaagattcagtaaaaatgaaagatttaaagtctgatcgtgataactcagttgttgaatcacaaaaaagtgagaataattgtgattttgtgtcagaaataatacaaccttcatccgcaaaagttccttggggaggggttgctactgaaaattttaaagcaaagagagaagttgtgaatttccaggatatattaagagaagaagagatcacttctaaggaaaagcttaaaatagaagctatgaaccgagcaaataataagagcaataatttggaagcttttaataataataaagatgcacctaaaggttggaaaagaattccgaaggaaagatcgtgtatttttttggattcaattaatgaacaagattcttcagtcaatgatcaaactaatcagatcttatataaagttccttactcgactaatcttaatattaataatgggaataaatggaaaggttggggaatcaaatctggagaatcaacaaatgctgatttatttgaaaccattgctttgaattcggtcaataacttttcaacgaatcaaatacaacgaaagaatcaaaagggtttctgggaaatgtgtaattccgactctttacacaaaagttatatgtggggcagtaataatcgtaccatgacatgtaatcaagttaatgaaaacattggttcagaggtaatcgatcataaagcagaatgtagttttgatgagattgagaaggaagaaacaaataaagatctttataaggaatctgagcttaataccacaaccaaacttttaaatcataaaaataagagaaaaaaaggaaagaaagtagactcatctctgttagcttttggaatccgttcagacaaaccacgaaatttgaattatgatttggattag

SEQ ID NO: 2631 - DNA, 237 bp, Cryptosporidium hominis
atgagttacaatattgactggccaaggcaggattccattgataatattggttgttcatatgacaacttaaattatgaacatagatcaagtactgcatctaatggtgggaagagcagagaaaatagcatatatgctaacactgcgttattcgaagatcatttttccccaagactttcggagggtctgaactcaatgaggttttcggatattggggatatgacagaggaagagtggtaa

SEQ ID NO: 2632 - DNA, 1086 bp, Cryptosporidium hominis
atgttatctacttattattattatcattattattttaggaataaacaacaacaaagacaaaactcacagagatatgatgctttgtatattgtaagtgagaaagaagaagatatcatgaagatgaagggcactaaggataagttgaaattcaaggagattggtaatgaatcaataaaaaccaataaagattcaatttcagacacttcactgggatatatttgtagtttgatatataacttcagaaacaataatacaataagaagtaaacagtcacaactaactttatgggaaattatgaaacagttttatttgattaacaatttattttttatacttaaagtcttaaaaactttaatttcaagtaataagactcatagactaagtcaagatatgggatgggtttcttttatgtgcctattatcaactttcatgaccagtatattggcatatttaacgagatcattcatattttatcatcgtattgctgataaatatacaaacaagttattttcacctttttatgtttattgccaaataagaaaagttggtgacgaaatgcctgaagctttattcatgctggaaagagttaattggacttatactttaataatgcatatattagaagacattccccaattatttgcatcctcaattttcttatcatattatggaaatgatttttatgcattcttcatgatcacatggagttcttgtatgatcattacaacttccatcagaatgggtatttcttatcctcttattggaactttaagtcttattttctctagaaaacctcccgttgattcacctactttgaatgaagcaaccacaacaacactgcattttcctctgtttatggctgcaatcacttttatttgggcagtttcagatagtttatgtctatatttcactcatggtttctggactatccttttttattttggtctaacagcaaatattcttgcatctacattgtttatattatattatgtacatctttctaagcaagcatcaacatatacgcgccaattaaattcactttattttacggaagactttagcagaattcaatcaagacatttttaa

SEQ ID NO: 2633 - DNA, 630 bp, Cryptosporidium hominis
atgcagagattaactcatgtaacttgcttttttctaattgtgtgtggatgggtaattaatgtattttggccttttgttgaaggaataggaataagagacttagaaactcatggtgcttcaaaaaatagtcaaaaaggtccttctaatattacatactcttggtttctagaaaatcccaatgagtttgtaaaaggagaaagtagcaataatgatactaacttaataggtacttcgataccatataaaattgaagatgaagattataagttaactaaagatacatcatattatcaaagaaaacatcatgatttactctacttagatcaagttgggatctgggtaaagtttcacgattatgcttcaaatgttgatatattagtagaaagtacacaaacaagaaatactttaacagattctagtcgcaaatatggaagattgttggaggatcaaatcaaaggaaatctaagtagaaatggttcaaatgaagatcttgggttgcactccttaagaaaaaatggcaggaaaggtggttggtggttatttcattcatttttccaggtagtttcaaaagattggttgcttggctggaactttatatgcaattattttaaagaattcatactgaaatga

SEQ ID NO: 2634 - DNA, 1020 bp, Cryptosporidium hominis
atgactgcaactttgggaattaacggtttcggacgtattggtcgtttagttttgagagcctgtatggaaagaaatgacattacagtagtagcaataaatgatccattcatggatgttgaatatatggcttacctcttgaagtatgattcagttcatggtaacttcaatggtacagttgaggtatcaggtaaggatttatgcattaacggtaaggtagtaaaggtattccaagctaaggacccagcagaaatcccatggggtgcttcaggtgctcagattgtatgcgagtcaactggtgtattcacaacagaggagaaggcttcattgcatcttaaaggcggtgctaagaaggtcattatctctgctccaccaaaggacaacgtcccaatgtatgtcatgggagtaaataatactgaatatgacccatcaaaattcaacgttatctctaacgcttcttgcacaacaaactgtcttgctcctttggctaagattattaatgacaagtttggaattgttgaaggtttgatgacaactgttcactctcttactgctaatcaattaactgttgatggtccaagcaagggtggcaaggactggagagcaggaagatgcgctggaaacaacattattccagcaagtactggagcagctaaggccgtagggaaggtcatcccagctttgaatggaaagctcacaggtatggccatccgtgtcccaactccagatgtttctgttgttgatttaacatgcaagcttgcaaaaccagcctctatagaggaaatctatcaagccgttaaggaagcatccaatggtccaatgaagggaattatgggctacacaagcgacgatgtcgtctcaaccgatttcattggttgcaagtattcttctatcttcgataagaatgcatgcattgcactcaatgattcgtttgttaaactcatttcatggtatgataacgaatctggttactcaaacagacttgtcgatctcgccgtttatgttgcttcaagaggtctctaa

SEQ ID NO: 2635 - DNA, 1554 bp, Cryptosporidium hominis
atggaagaggaaaatcaagccaagatgctgtttgatttatatgaagaatattttttcctttcaaatttaaagctgctggagttggttgatgattttcacaaatctttagaagatggacttgaaaatcacagaaatcgactaaaaattgacaaatactattccaattacaagccttttaaaatgttagactcttgtgttgatagacttccaactgggaaggaaaaaggagtgtattatgctattgatatgggtggcactaatttacgatgtgttagagtaaatttacttggtaatggccaaagtgaaaccaaatttaaaaaggtcaaattttcagaaatgaaagtatcttctacagggaaggttgtaaatggtaacaaaatttccaaaattgatcaagaagtcaatatttttgataaaactgtatcttcagaaacaatgtttaattcaattgcagttttctttaatgagtttttggatgaatgtggcgacttaaatgatttgaccaatggtaataatgtaggcaatctcccattagaagttggcttcaccttttcttttcccatcgtgcaatctaaaattgcaagcgcaaaactagtaatatggacaaaagaaattgaaacaggtagattaactgatgatcctgttgaaggaaaagatattggtaatttattgaatttagcctttaaaagaaatggaataccagctcaatgtaaatgcgttttaaatgatacagttggaacccttatatcagcaatgtatgatttaaatattaataattgtgacaataaccactccttaaaagttaattttccaaataatatatctgaaaatcaaccattaattggaattgtggttggaactggagtaaatgcttgctaccttgaaccaaattcttcaaattttggttataaaggagttattattaatacagaatgtggagacttttattcaaccaaattacccataactgattgtgattactccatggattggtttagtgataatagaggagaacaaatatttgaaaaaatgattagtggaacttatttaggagaaatctctcggttattaattattaattttttaaaaaacaaaactccagagattttcttccaaaagaattcattaaaaactgaacatattgccaaaattattagccatttcaatgataatcatcaaaaatataaccaaaaccatgatttaaagtctatcgaaaattatttaaaagaaacattttcttcaaattttgatcataattccacttatattattgcaaaaatatcacagatggtactcatgagagcagcatctcttgtctcagccattattgctgcatttttcaaaaggtttaataagacacggaatcaaattaccattgccatagatggatcagtttggactaaaatacccaaattccaaaaatacgttaaagattcactctcatctttgattcaagagagcggatatcttggctcaatacatttttatgaatcagatgatggatctggaagaggtgctgctattcttgctagcactacagtcaatacgcattaa

SEQ ID NO: 2636 - DNA, 834 bp, Cryptosporidium hominis
atgcaggagggttcgaataatgttagtaccaatctgatgaacgataataaaactgaggaggatgtgttagagcagccaacatttttaacaaaccaaagtcttttgaacgaagagcagagtatggttacaaacgtagatcatgaaccatcatggttaatttatccattgaagaattatggaattcgagttcaagataatagtgacgaaattcaatcaagtatcccaattaatgaaatgaatgggtttaatggaaaggttgataactttttaaaagatggaattggacgtagcgttgctgcattaatgcttactcatcgttatttatgtccacatgtggttttacttcagaatgatttaacaagtgaatggatgcttccaaattgtacttataaagcctgggaaaatcctcgcatagtcttagcaaactttttaaagtcaatgttccttacaagttcgagcattaatagtaatactaatagcagtggaagtaatagtggcaataataatagctcgacaaataataacaatataaataatgcttgttctgataatgcagtagaagttggggaatacttgggaacttggtggagaactgagtttaattattctcctttaccttatttacctccccattcaacaaggcccaaagaaacaataaggatttaccaggttattcttcctccaaaattgctatttaaattaccaaagcaccatgtgttaaagagcttacctctgtttgatttggacccaaatatatttggaatagcatgcggtagtattccccagcttatttcaagatttcaaattcaatcaatggtccagtcggataattag

SEQ ID NO: 2637 - DNA, 1401 bp, Cryptosporidium hominis
atggtatttcaagtgttttttattttaatgatgctgaaaatatcagctttttgtgaaggattatcaaacaagattaggtcaaatactagggcagagttaggaatggaggctatactaagtaatggcttatttaattcaaatgctcaaaaagttgagttaaaattaagtctatctgagggaggaatgaaatattcagaaggcaactatttttcaaggtggattaccaagagtaagtattcagaggcaatggactctcaggatcttagaaattaccaaaatagtcaatattttggtaaaattgaggtgggaacgcctccaagaaagttcgttgtcatctttgatacaggaagctccagtgtatggattccaagtattgaatgtaagcataaaggttgtgagcctcacaacaagtatgatccaaagttgagtacctcttatcaaaaattgggggacggatcattggagacatatatccaatatggtacgggttcttgtgtgttgaagtttggtaaagaagtcataaatattggaaagctgaagatagaagaccagtctttcgggatggctattgaggaaagtacatctccttttgctgaattaccattcgatggtttggtaggacttggatttccagataagaacagtaaaaaaaataatatcccaacaattgttgagaatattaaagaacgaaacattttaccaagaaatctttttggagtctacatttccagagattcaagtattccaggttcaatttcttttggagctgctgatcctaagtacacaataagtggtcaaaaaataacctggcatcgacttactgggtctcattactgggaaatcaagattaaagatataaagattaatggggttagcacaaactattgcttcggggactgcaaggcagctatagatactggttcatctgtctccacagccccaagtagttttatgagaaagatcaccaaagttatacccatggagggagaatgtaacagatatctatcttctcctagaataacttatgtgatagaagatattcatggaaatgagatagaaatgcatatggatcctcaagactacgtaattgatgaaggagggccttcatttaatgcttttaactattattggggcccgcaagaacattattgtagcattggatatatccctcttgatattccagctcctagaggtccactttttgtacttggaaataactttattcgaaagtactactcaatatttgatagggataacctaatggtgggcttcacattggcaaaacatagtaaatatggacctatgttcatctcattatcatccaattcagaatctgttcttaaaatggctacatttggaataaccattatcctcagcctgctactatttattatttattaa

SEQ ID NO: 2638 - DNA, 243 bp, Cryptosporidium hominis
atggttgactttgctactggacaaaaaaaagctcaagagcttcaagttgatttcatggaatcgagcgccaaaaattcgactaatgtcgaagaatgctttgtaaacatagcaagaaaacttctagagaaaaagctaaaaaatggagaaacttcatccaaacccattaattcccagaatatctacttaaaccagcatggagatggtggtttaatttcaggtgtactttcttcttgttgtaagtaa

SEQ ID NO: 2639 - DNA, 2157 bp, Cryptosporidium hominis
atggacttcgtagtaaaattgccagttgaattggatgcagatgagtctcttgtgaacaataggaaaaagctattagaggaatggggattgccaggaacatacgtaactctatggttgaaggaggaattgggagaggacttgaaaactcaagataatttaaagaaaatctttgagaagctagtcaagttaattcattctatgtatatttcaagcatgacatttaaagatacatatttggcattagcatatagtagagatgagtacatttcaaaagtcaattcaggaaagtttcaggttgatcctccaaagtctttatttgagatttacactcataagactactaatattccatcttataaccccattgtaatgattaaggcactacttgttctgaaaagcataattaaggatgaaatttcccaagttacccaaaatgctgagaactctaattttcatatggataactatcaatatctattaaaccagtgcctttcttttgttatgtcatccttagaaaatatttgcaaaccttctctacaagatgtttccaatttagatattgatgttgattcaacatatttagacgatattattcaaagtctttctgggggagaacaatcaaagtatcctattatacttagaaaacttggagtaggaactcatcctactcatggaagaggattctactctacagagaaaattgaagctgatacaaatattgtcgaaatttctttgtatcatgcactttcattttacaatgcaatatactctgaagattttggatatattgcaagatttctatctaacccaacgcagtacattcttgaaatgaaatcaatcatctctgaaacttcaaatttattcgatgactctaaccaaaacattatgtatgaaccaattgacagcgactccattctacttctttttactatatttcaagtttttcaaggagaaaaatcaaagtggaataaagtcatttctatgtggcaaaatccattgcatgcatgcaaccaaaacatgtatatggcgccaaaagaagttagagatttcttatcccatggcggaaatgactttgggagtcgaatttctaatagtattgatgaactttatagtttaatcaaacatgtatattttcttctggatactgtacaggaggaagcaaaaaggttaagtgataagcttggagataaaaaattatcagaatctatccggttttttaaggatttggattataaggccatattcacatggaggagatttaaccaaattaagtacgtattggatactagatcattcagcataaagtggtggcctttaaacgaaaaattctataaacacgaaaagttaggagataaaagtagtttaaaaatggttaataacttttccgacaataacaaccttgagctcattagcataccagttacagatttttccttaaatggtgaatctaagaatttggtattgcctgtacctattgatggaatacgtacaatattaccagttgctgatatgtttaatcattctcatttggcacaatgctcgtctccattattggactttgagaataatatgatttctattaagaatgaggtagaaattccaattcattctgaggtatatattagatatggaattttatcaagcagtgaatgcttatttggatatggttttatccctaaaactgagcctgtttctggtttatttgacactttaacaataaacttggagcctgaagatgacgacccattatataagatgaagatgttagtccttaaacattctaatattccaactgatcacatattttcaaagctatctttggaaaaacttacaaacgaagatctactatttaaatgtatagatgtagttacatccaatgatccaatctctactctgaaaaactgggataaaaaaggaggagaacctaataaatactccaatattaattacatgcaaatagtatatgaaattctagaaagcttattaaaaccttgtatagaacatcataatatgctccaaagctacaaatcttctccaactgatttgagacctttttggttccaagattggggagaaagagcaatatcatattattcaagtcaaatagatttaataaaactctctcttgaaaagtttaaaaagaggaaaagaagttaa

SEQ ID NO: 2640 - DNA, 405 bp, Cryptosporidium hominis
atgagccaaaacgaggcaagtgaagatacaggttttaaccctaaggcatttccattagcctccccagacttgaacaacaagattattaacttggtacagcaagcttgtaactataagcaactaagaaagggagcaaatgaagcaacaaaggctttaaataggggtatagctgagatagttttacttgctgcagatgctgagcctttggagattcttcttcatctcccattagtttgtgaagataagaatactccttatgtttttgtccgatcaaaggtagctttgggtcgtgcttgtggagtatctagaccagttatagcagcagcgattacatctaaggatggatccagcttgtcttctcagattactgagctaaaagatcaaatagaacagattctagtataa

SEQ ID NO: 2641 - DNA, 3308 bp, Cryptosporidium hominis
atgatatataatagccaggaatgtaaagaagagttgaatgagggtgaaagttcttgtgaacaattaagtgtgggtaccgaaaaagacaatgaaatgaagatagatgaaattgttaacaaacatgaaaaaagtgtcgagtcagaattggaaattagtagtgatgaggaaactccaaagaacattgttaaagaatcggaaaaatatttgaaaagagaattagacatgcatcatagagtagcagacaagatgaaagaaagtgtggggggtgaaaaaggaactaagtccagactacaacttttacttgatcaaagtgaatcctatacaagctttatattagcaaggtctttaaatccaatcaagtatactaatgaaaacgaccaaactgaagaaattggtgaaaaagcacccaaaaaacgaaaatcttctgctcatgatcattttatgaataaagatgacgatattgagctctttagagaaactgaggaagaaatatatgggtaccgtccacatactagattacaagtacaaccagcttgtattcaaaatggagtgttgaaaccgtatcaattggaaggtttaaattggcttattaacttatacgagggaggactcaatgggatattagctgatgaaatgggacttggtaaaacttttcaatcaatctccttattagcttatcttcgtgaatatcgtgatattaaaggtctgcatcttgttttgtctccaaaaagtactctaggaaactggatgaatgaaatcgcaagattttgtccaagtattaaagctgtcaagtttttaggaaatggacaagaaaggtcagatttaattgataatgaattaaaaaatattgatcaaagagatcttgaaaatggtacctgtgatgttattgtcacatcttacgaaatgcttcttaaagagagaacttggtttttgcgaagaaacttccattctgtaataattgatgaggcacatagaattaaaaatgctaattccaagttaagccaaactgtaagacaattaaatactcgatttaggctactattaaccggtacccctcttcaaaatagtcttagagaactttggtcactcttaaactttctttatcctgaaatcttctcgagctctgaagagtttgaggctctgtttgaggctcaaactggagaagaagaacagtcaattattgccagatttcatcgaattctgcgtcctttcatgcttagaagggtcaaatctgaagtagaaattgatattcctcctaaaaaggaaatccttctatatgtacctcttacaaatatgcaaagaaggttatacaaagatcttctttctaaaaatgttgatgctttgcaagaaaaagaaggtggaggtaagcttagactcattaatcttgcaatgcagcttagaaaggcctgtaaccatccatatctctttgatggttatgaagataaatctgtagatccttttggtgaacatgttgttgagaattctggtaaaatggtcttaatggaccgtcttattaagaaattggtatctggagggagcagaatcttaatattcagccaaatggctcgtgtattggatattctcgaggattattgccatatgagaggttttccttattgtaggattgatggaaatacttctggtgatgatagagatcgacagatttctgaatttaacaaaccaaatagtgaaaagcttgtttttctactttccactagagctggaggattaggtatcaatttggctactgctgatattgttattctttatgattctgattggaaccctcaagcagatcttcaagctatggatagagctcatagaattggtcaaaaaaaacctgtatttgtatttcgactttgccacgaacatactattgaagaaaagattatagaaagagcaaatcttaagcttcaactggattttgctattattcagcaaggtagacttaaaggacaaagctcagctcagagttctggattagagaatagtgcattatctaagaatgaacttatgacaatgattcaatatggagcaaatgaaattcttaaaacaactaatgttaatattactgaagaagatattgaagcaattatatcaggaggagaaaagaaaactgaatctctacagatgaagattcagaaacatattcaaggatctcttatgaactttagtttgaatgggagtcagtctggaggaaaaggagattctgataagattattaatactggatcaacgaatacaaactctttgtatgagtttgaaggaattgattataatgaagttcaaaaacaacaagatagacaagcttgggggaagattagtattgaaaagattgatcaggaacgtgaggaaagacgtagaggaaggttggaaaattataccttaaagcttatccaaaagtatattaatagacaaaactctgcaagagggatagataagttaccaccaatgcatgattggcaattttatgataaaaagaggattatggaacttcacaaaagagaatctaggtatgtgggagaattacatgcaggattaatcaaactttcacagacaagtactattccatttattgatgagaattccttgttgattccaattgaggagattccaatggataaacaaatagaagatatttctccagaagagaaggaagagaaaagaaatttgcttcagaaaggctttaaactttggacaagaagagagtttaacttgcttttaagatgtttggagactaatggagtagagaacttggacaaagttgagcaagttttaccaaataaggataagaatgagattaaagattatgttgagacattattgaagaagggtccagaagaattagctgactggaatagatactttaagagaattcagtcttcaaaagatgatcaaaagaagagagatgaattgaatgcagtaataaaaagcaagctctcagtcttgaatgacccttggagagacttagatcttgagagccttaatatttatagcaaacaaacaaagaatatgacatataatcagattgaagataggtatctgattaactatacctaccaatatggttatggaagttgggatcagatcctatctgcaataaagaatgatcatatatttagtttcgattggtttatcaagacaagaagttcaaatgatatttacaggagagtagactttttaattaaagcttttaaaaaacgagatttaaataatattaatactaatgctaattctaatatagatgcaaattcgagcactggtaccagtactttaaatggtgttgacttcaataaagatggtgatta

SEQ ID NO: 2642 - DNA, 204 bp, Cryptosporidium hominis
atgagtaggccagaactagtaccaaaaaaaataatttttcttaaaaattttctaaaattatgcaatataataaagaataaaagttttttttttaataataattacatcttgaattttaaatttcataattgggagttggcgccaaaaaaggtaccgacatttttggaatatataatagtgggattggtaataataattaattga

SEQ ID NO: 2643 - DNA, 1275 bp, Cryptosporidium hominis
atgccagatttcccaaattgggtacccattgaccaaaaatatgacgataatattggattattttcattttataaattataccttggacttgtcaggcaaactataattaggaattttgtgagatctaaattgttaaacaaatcaatattttggttggcaattccaacaattaagatcactttatttccattcattatatctattctatgttcttcgcataagatcaaaatgatgaatcacgaagtagtagctgaagctgatgaactaaattattgtgaaaataatgtcaaaagtagtctttgttacaataatgtggagcttgaatctaatgggttagttcgaaaagaaagctatatgaaagagttataccaagatcttgatcaaaataactcaatttcaataagattcaggttttttactcttttatttacgtttatactatttactctagcccatttttttatcatggttttaaatctaggaagagcattccatatcacacaccaccttaaactctgttgggtatttatattctgtctatctctatttggaatgttggatataattacatctctaatgaataactatagatttgcattaactcttcatggaatcatcggtttctttctttttgtaacaccatgtatatttacctacgatatggataacctcattgcaaaatactactcattttcatgtttctttttgcttggagtctgggactcatctttggagtttattactggaaaaggagttcttcatcacttcagattctctactcaaatcaaatacttcttgataagcatatttatctactctgtagctacaggaagcaaacttttatggctatatgatgttaactacaacacaaacttaactcccagactgaaaattctaggatctctgggaattgctacatctatttattacctctctattaagaagactatattgtttaaaaagaagctccaatggatatacagtcttaaaagcaggtatactttggacccttcaatatcatgcttcttgagtctcataccttccagaaagactgtctggaaaatcctcaaaaaagattctttcatgcttctttcattcgtccctatcccaactactgcaatcacctatgtacttactgaaaaactcatgtttggcgccttcgaatctttcttgacagtacttttcgtttctcccatgttaacactattcgtcctgaacatcccagaaatattctctcatatttatactcttcatatgaaagaaaacggcaattaa

SEQ ID NO: 2644 - DNA, 957 bp, Cryptosporidium hominis
atgcgtagtatacttttgaaaaaggaggataaggacgagccgtatcacgggcttagatctccaattggacttacatttttgaatggctttgcagtgtcacttgcatgcactccattagacgtgataaagaattattggatatacaaagattcgaatgaagtttttaatcgtggattttatgcaaataagggcttaagcttgcataaagttccaaagaatactaacacattgaaaatcatccaagaattgtatagatatggaggattacgtacattttggacaggtctgttaccaacaatgatgtttaacattccttcaaacataatattctttaacacctactactattttcttaatgctatggggttctctccaggtattgctggaatccaagcaagaacaattacaaccctattcgtttctccaatggaattcattaggactcgagttcaagctcaaataggtgatgagttatttcttaatataaatagagttggagctaaggtgaataagcacagatccttcctttttgattcaaaaagatacttgaacatttatcaattgtggtcaggtctatggattacaattctgagggatgtgccatttacagcagtctactggactttaaccgagaagctgagaagtaggatagctttgcagggggagacgaacagtggcccaaaaaaaactctcaagctattttccatagctgcattttcgggaaccgtggcaactctcgtaagccaccctttggatattgtcaagaccaatatccaaacccacagcttcaatcatagcttacttggtaagggtcaaatttcgccaggaaggattgtctccagtctattccgaagaaggggcttccaaaatttctatactggagtgttcccaagaatacttaagatagtaccgtcttgtgcgatttcactatctttgttcgaactttgtaggaagtag

SEQ ID NO: 2645 - DNA, 330 bp, Cryptosporidium hominis
atgagggaaaggaactcaagacgcaaaataaagccggtttattatagcccgagcgaaaatgaggatagtaacgaggaaattgatgaaatagagagtttggcttctcaagatggatctattagaaaacgagaaaggatacatattgaagaaggttctcgagaaatcaacgatatggtggagtcgatagatctcactcttgtggtatggcttaggaagatgtattgcaagtacaatcagccatatttgacgtgcttggattgtttagagcattcaaactacacaacaagattggcagaggagctacttatgagtaaatttggcgccaagtag

SEQ ID NO: 2646 - DNA, 1041 bp, Cryptosporidium hominis
atgaggcgtagtgagtcaagttctgtactgcagaggtacaacaacaggcgaaagtcctccatttctggaggcagaacagcctctgcaagtatgataggaattctgactccaaaaaccctgtcttcaatgaaagactcgtctaaaaaggagagatctacctggtcaagaatcttttcccctttgtcttttggttttgataagagagaattgagctattctggagaagaatcaagttacagccaatcaagaagaaggacccatgattatagtaaaacttgcccaagttttcaacgaaaagggtctcttcgtccaagtcctaatactcaagtaagagataggaatcaatctatttccaaagagcctagaagttccctacagtactcagcttctgctacggatctgagctttgataatgatgttctcgggttaaatgacctttctagttgtgtttttgaacctgttctgggtaatatgtctaaaagtaataacatatcacgagttcaaccattttcaggaaaagatacaacaggatacatccaaagaagtaagacaacagggttcatcaaggaggacaacagcactaacatttacaatgatttaaagattttaaggtttcatgatgggatttctggaaagacttataaagctcttccaagtaaaacattggattctattaaagattctgataaagttggaaaagaaaaaacaacagcaacagtgacagcaacagggtttaatcttggatttgggtcatccacaaaaaataccaattctaatgctggtaactcatctgggactaattttattgaaattgaccccaataataaaactcacctattcaataaggataactttactgccaatagaaacaccagtattcaagaagctctttctaataaggagtttattcaaggagatataccatactgtgacactatactatatttggataatccaaagcctaaaaaatacgataccactttttccaagcttcacgataacagcttctataaagattcttttaatagtagatttgaatag

SEQ ID NO: 2647 - DNA, 1191 bp, Cryptosporidium hominis
atggtttcaataccaaaaagggataatcttctcacacatcaaagcttaggagctgatggtagtactgtactaattaaaaagcgaggactattagggagcttaaaagaagagaatgtcaaggatccgagagaaattattgattcagctcaaagtattgaatctttctatgggactgtccgagaaatggaaaaaaagaaagtctcttcgggtttggactggcagacggatggaggtcatcaaagcgatttatatagtgatcatagtagtaatagagaatacagttctcctagagtcaaaaatactcctagtactcagtgcaatactgattcttctccttgtttaggtattagtaaagaaaggctaaggaaaaaagaagaggatgggaatgcatttgaaaataagcaagactcacatatttacaaagaagattcagaatgtgatgatcatgaaattaatcaaaatatgaaaagtatccatagtaatatttatcagaaggagaaggattcagaagctgagttagtaattccaagactctccttaactgaaaaacgaagatctatttcaaaaaaactctcagaagaagatttaagtattgaaaaagatcatatttcctttagattacatagtgagagaagacttaatcactctagaaatagatttgatagagcaccacatggtaactatcattctcatgcatatacaatggagaatttagcagctacaattcaaagaccaatatcaacatctagagaagaaatactcaagttatactcaaaggaagaacttgagaagattcaaacctttattgaaaaagctaatgaactagtttatgaaggaccattggaaaaaaagaattcatggtcttggggacataaacttagatgggtaaagatatttaaatgtgagatgcattacttcttatctccaaaagagtcaaatattaaagcaaaagcacctcttggtgttattaacttcaagatagcagaatggaatcttcaaatatctgattctgatgaaaagacgttcactatagtagcacgtggaaatacaagtaatggacgagggtatcaatggaggattccttcaaattctgaccaaagcagaaaatcttggacaactagaattgaaaagatcctcaaagctgcagcatttatgcaacagctcaagggaattattagaattccagcttaa

SEQ ID NO: 2648 - DNA, 2370 bp, Cryptosporidium hominis
atgaaaatattcaacttattattactaattctattcacactggctatatattctcaatatattcatgcaaatgaagatgatgttactccacatacaggaagaaaaggattaactcaagaaagaattgaacattttgagaagattattaaagaaaataaagaaaaaactcaacttaaacctcaattaaaagttgttaaaagaactaaaccacttattcccaagttccctattgaagaagagtctcattctgctgctattgatcataatggagaagtaactgatgatagttttgttgatcctcttcatgacgataataatgaggatagtaactattcttctaattatattgagccagtttcatcggatattgaaaaccaaactgatattgaaactactgatgatgaaactaatgttattgaaatgaaggatattcaacaatcaagaatactagacgacgaaatatctaatgatattgatcaaaatgttcaagatgaagaaactaaaagttttggtagtgatgtaccactctctttagataccacaacagatttatctgatacaaatcaagaaaatccatctgaaaatgtaccggtatcttctttaaatcttactaagagtcagaaaaagaaattggaaaaggaaagattaaaattagagaagaaggaaaaagaattgaagaaacaaaaagaaaaggaaagattaaagttagataagaaggaaaagaagaaagagaaagaagagaagaaacgattagaaattgaaaagaagaaacaacttaagaatgaaaagaagaataaaaataagagtaagaatgaaggttctggagaaacatccatagaaagtccaaaagaaaagaagagttcatgtttttctaagaagaaaaaacaagattatgttcaagttgaatctcatgactcattggaggaaaagctaagcagtcaagaagtagttccagaggatattaatgatgaagtctcaacagtagcaagtgaaaatgaagttttcgataacataagttccattgatgaaggagaacaaactgaagctgaagatgatattaaggtagaaaaaccagaaaatcaatttgaatttgatgaagaagaagattctgagatcaaagcaagaatattagcaggaaatgaaagtgattttaagactgagaggatttcatcagaagaaatacttcaagatagtgattcagattacttagaaggtgatgaataccaagaagatttaaatggaaaatatagatttagtcaagaatctgaagatctaattacaaaagaaaaagccgtaaaacctttggaaggaattgaaatcgaaggaatttctgaaggagaagatgaagatacttcaaatgttagtgatattccagttgtaagcaattattctttagatcatgaagaagagaaagatgaagaaaataagaatgaggattcagatattcaagaattaagcagcggtatcgaactttcaaatgataatgataatgatattatgagtaataatgaaatagaagttttgaattcggcagatgatgatgatgatgatgatgatgttaatgaaattatagtagaagaagaaaagaaagttgatgaggactttactaataaggattcaaagcttgatgaaagaagatctaataataaggttaagtcattttttggtaagatcaaatcattctttaagaaaaagccttcttcagtgaaacttggttgcaaaaaaccaaattgtattaaaagactttcaaagaatgatgagccaaagtattcaagtgactttattccaagaatttacttattatctagaagtataccaaaagagaatttctatcgtgttccagaaattatctcaagcttaagatcagaatcaaatagattagtatttgcatatcagttaattgatggaagtttagttccatcatcagctttagccttaaactcaaagagcttcattgttagaagatggggtaaaaacgtacaatctaagcttagaaagctcagatcggaatttgactcgttgaaaacaagattaagttcaatgtatcatgaaggtgttattaagggagaatatgaactttttattgaagaaatggatgacttaactattatgctttacttacttgcaaaggagttcccaagtaagaaccactttgcaaatattgcaaaagatattttaagatatccagaagtggtatctactccaggagaaagactagtttctatgttccgtaaatcaaagatttcaaaatgctccaagaaaacaagcgagcccaaaccagaaagaagtgagagcgataaacttgctattaagactttgagaaagagaatgaaattcatcaaaatgagattaaattcactaggaaagtga

SEQ ID NO: 2649 - DNA, 2436 bp, Cryptosporidium hominis
atgcttaaagatagtagtgagaaatcttcttcaagtactagtataaaagccgaaagtttggatcatgatccaattcttgacggacctgatgaaatcatttcaaggaaaagtaaagatacgtatagtgttggaggtgattcaattagttcgattgattcttcaagttccaagatttctagatctctaaaggattttgcaacaaaaactgctaaaaaagctaagagagtaaaaagacgtttaaagaaaagaaagaagaggtcatataatttaacagatgatgaaagtgatggcaatatgagtgataccgaaagtagtgatggtgaagataattataaaaggcgtaaaggagccaaaaaaggatctgaagtcgagttaaaaagcacaaccaaaatatatagtgatagctttgatagctctgatgatagtacttcaattggaagccaagatacaaaaagtataggagaagattcaacaacttcaagcacttcttctataaaatctgccggaaagagagcagcaaaaaaactcaaggaaaaaagcaaaagtttaaaacgtcgattaagtaaatcattgcctaatttaagtaaaagtagaaggggttcatattcacttacagatgatagtgataatgaaagtgaaggtggaaaaaaaggaaagaatactatatttagtgggtctaaagacaaaaccaaaacaaaaaagaaaggattacttggtttatttaatgataaattaagcaaatctgcaccagaacttggtagtcaagataaaaaaaataaaaaaagtagatcaaatctaatgagcagattatttgctaaattccataaaaaacaaccaagttcatcagaaacgagtgaaggcgaacaagatcaagaccaacaagcaaaaaaagacaggaaacaacaaaagaaaggtcttatgagtcgtttgaataactctatggctaacttagctggacgaatgaaaaaaggtggcaaacatcaaagagatgaagaaaagaaagagaaaactaaacatggtaaaaagaagagagctccaattttaaaaaagatttttgggaaaaaagattcttcaaatattgatgaatcaggtttatctgaaattcctatgagctcaagaggacaacaaccaacattttttgaagaatcgcgagaaactgatccatcttcaagcgaagatgggaacgaagaagataataacagccaagtaaaactaaaggatagtcctataagtgataatgagcaatctaacaatgaaccatcgcttgagagcattgataaactttcaaaggaaaaaaagctttcagataaaaaggagaaacccattgttcaagaaaaagaccctaaaattgataaagataagaaaaagcatccaactaataaagatgatagtaacaaaggagaatcatcagcaggagctcaagaatcaacaaaagagctgccacaaaaatctacagaagattcagttcctggagatgaaaaaacaagtagtagcacaaaagataaagaagaaacttcttcctctactgcatcagattctgatgaagggtctacttctaaatctagtcctcgagtaaaaccacctttgaagccaaaaccaaagtttttagcaccaccaaaaaatcctaaagtttctcatctatcacctaaaatgcagaaagccttgtctgaacccaccaaatcaaaagaaacctcatctacgagctctgatgaagaagaaactccacctcctctacctcctccactttctccaccttctccaccttctccacctctacctgaagaacttccgccaccacctccatctgaagagcttccaccaccaccgccgtctccatctgaagaacttccactaccaccggcaccttcatctgaagaacttcctctaccaccgccacctcccccttcattggaagaacctctatcaactccatctgatgagcctttgccaccaccgcctcctgaagcctcctcatcatcaaatgaatcgttatcaaaagaaaaagctcctactgcatctattccacctgcacctgcgcttgcacccacacctacacctacaactgcaccaccacctcctgcacctccacttccaccaccttcattttcaccatctacagtctcttcgcaatttaaattaaaattggaagcgccaaaactaggaaaaaaatctaaatcatcacctgatctgacaacaaaatcttcaataggcagttctaaattaactccagagacacttcaaactttaagaagcagtctaaaaaaagtcgatgcagatgaactgagtaaaagaaagaggcaaagcaattccttcccaggagcaaaaaaaagtagcagtggtgatttgtatacttcacttttcgcagccattgaaaaaagaagagaaaaaatcaaaaacaaagatgatgaaagttcaaaagatgatgattggtcttaa

SEQ ID NO: 2650 - DNA, 174 bp, Cryptosporidium hominis
atggatgatttaaaggtgaattctgagagtagagtttctattttttcaaattctaatgaaatgaagaaaaggtcaagaagtagacattcagtaagaagaagaaataccagagaaatgggaaaatattgccgttcaaaaaagataggtaagttaataaaaaatgaatttgattaa

SEQ ID NO: 2651 - DNA, 987 bp, Cryptosporidium hominis
atgctatttttagttgataaaagtggactttctccaaagcttttaaggtacttggaacaaaaagaaaaagatcaagataataatccagatgatgatgatgatgataacgaaagagaaagagaaagggaaagagaaagggaaagagaaagggaaagagaaagggaaagagaaagggaaagagaggagagagaaagggagagagaaagggaaagagagaaggagagagaaagagaaagggaaagagaggagagagaaagagaaagggaaagagagaaggagagagaaagagaaagggaaagagagaaagagagagaaagggagagagaaagagagaaggatagagaaagggaaagagaaagagagagagaaagggaaatggatggaaagaaacatggactcccaagaaaaactggagagggctcttcttcatcagctactcttgctaaaagattaatggaaaggatgggccttcaacctcaaccacctcatagtccaccaaaatccactaaaccaccaatacctcctaaaccaacatttccatacaactcgcaatcttttctacttggacaaattccagttccataccaacaaggaggaagcggtttccctccaccacctccattaccaccaacaccaccgtcactaccgctatcacaaactccaagtaatgatgatttccctccaccaccaccaccaccaccacctccaccaccaccatcaccgccaccacaatcaccaccaccacaatcaccaccgtcactaccgccatatccagtttctggatcacaaggttcaatgccaatgccaatgccaatgccaatgccaacgccaatgccaatgccaatgccaactaactctccatatacacctatacctcaggctccaaggccactgcctcaattgggtagttttttcacacccagaccttggaaaggaggaaatcaatcatcaagtagacttaaagattccacaggagatgatgattaa

SEQ ID NO: 2652 - DNA, 234 bp, Cryptosporidium hominis
atgaccttcaataatgataattcattccttcatttcagctattttagctcaaccaatgcgttaagccttaaagctggggctcaaggcccaattgattctgattctgattctgatcaggaagaaaagaaaacctctgcccatcctacattgaagcaagtttcagagagtctaaagagaagaagaagaagaagaagaggctctggatgtaagttagctactatatttattatttga

SEQ ID NO: 2653 - DNA, 555 bp, Cryptosporidium hominis
atggattcttctctaagaaaaatatcagatattataattgaccgatttaagaattgtataggaaattggatagcaataaatacaataaatgataaggatttagaatatatagaaaacaatgaactaaataatcacaaaactgacacaaatttaaataactttatcaaagattttagtaatttagaaaaaaccttaaagaaatacttaaaaatagactctttaatttggaaaattatggatagaattgaaatggaatgccttaattcatggaagaatattttattaattgattatcatcaaaaatcatctacttcaaataaaaaattaaattattcaaatttattatatgatttattttattttcatgtggacgtgaccattcgcattttttacagagaaaatgaaaataatttagaaaaaaagacaaatttatcaatatctctattagatattctatttgatcactttaaaagtaatttctcaaagtttgatgagaaaaaaatctctcaaattaacgaaaaattttcttttattagaaataaattgaatacgtaa

SEQ ID NO: 2654 - DNA, 2622 bp, Cryptosporidium hominis
atgcttaaaagtatatcaacaaagttagatctaccttggaattcaaaaactagaagcaatctccagaaagccattagttgtaatttttattacaattgtaaaacaaaaaaggtttcgaatactgggacaaaaaaagaccagccaacaatgatggaacagtttattttggacccaatttggaatatttatcaaaatatatttatcaactttaatgaagaaaaaatcagaaaaattactcaagttctgggaataaattcttctgagattgaatgccatattagtgaatatttaaaaatacaaaatgatctaaataatgtaaagagctcaaatttattggcatttatttgcagaaatattatgacaaactggcttcctttgtcaaagagtatttttgaaagagtaattaattatataccagatccaaataaatctaacaaattgagatttccatcaatctatacagaattaatctcttcaaaggtggaatacgaaaagctagatgaccttgatatagtttttatttcaaaattctcagcatgcgatttgacaaataataggctaactaaagacagattaaaaggtaatgaagagttaaatggctttgttggcatatctagagtttttaatggaaatattaaagttggagattcactgtatgtttcaaatcacctcaataataacggcaacagtaaagtacaaattatatcgttattttatcttcttggtagtgatctaattccagtaaatcaagtaaaaaatggtcatatttttgcattatgtttaaaagaaatacaagatgaagtgaatattcaaaataatgatgggattattggaagaatatcatcattggacagaacattgacactctcaaattatcccaattttcctgcattcaactctttatacaaatcaaatactaattcttccttatcctccattattaaagtttcaattgagccaaaaagaattcaagatcttcctttaatgctgagagggcttgaattattatcaagatcagatccttgtattgaaattgatactttagacactggtgaatatatcctcggatgccatggagaagttcatttagaaaggtgtatttccgatctgcaatttgtatttgcacaaatacctctatctgtttcaaaaccattgatcgctataagagaaggtctggtaaatcatataaattctaaccaggttcagaacttttgccctcatataccttttccaccttggagtggaaatacaactaatcaaaacaaagaagaaaataatgatcaacaaaatgaatttgaccatccaattgaaaaagaccaaaatgaaaatactgcaaagataccatgcgaattagccagtatacagattaaagcagttccgatggaacatgatttgactgaatatattgaaaaaaacttatctctgattcttgaagtagttaatccgtctaatatcacgaatgagtcttacaaatatattgacaaattggatgagattaacaagataatcctatgtaaaaatgctccaaattataatgctggttctcttgaatctgatcgccttcaagattttgtattaattggaatttttgttaaaaaaggaagtattactatattgacaagtaatgaaaaaaatctaaaaacactaaattggtctttaaaatgtacttataattctaattattatccagaattaaccattccagttcaaaaagatgttattgatctctatagaaaagttattaatggaatcattacaggattcgaaattgcaagtgtatcaggtcctctttgtgaggaaccaataagaggtgttaactttatattaagtgaattggttcttgataattttgatattgagcaacttttaaaagctgaacatcttgaaaaccaagaatttactctatcctttaataatattcagaaatcaattagtttaatgtcaaaccaactaactacaacaaccaaagagttgtgtagaaaagcatttctccaaagaggaaatgttcgaatatatgaaatctatttgaatcttgttatttactgcgaacaaagtgtattaggaaaggtttacagtgttattaataaaagaagaggaaatgtatttaatgaagagcttaaagaaggtacttcaacttttaaaattgaagcatatataccaatcattgaatcactaggaatcagccaagaattgagaagtaaggcaagtggtaatatttcattcaatttatctttttcacattgggaattactggatgaagatcctttccctgaatcaagtatgaccatggaagagtttgaagatgaaggattttcaaaagttaatctcttaatttcaaacagtaatagatatgactacaatttgcaatttggaattgataaagacaattcaaatatgaatgaaagtaataataatttacttggaaaagcttcttttggcttaaattcatgtaataatgatgatgaacctaataataacaaaaatagttcgaataattttggtaataacacaaatattgcgagaatgatcatcaattcaataaggcaaagaaaaggacttcctactcaacacaaaatagtcatggcagctgaaaaacaaagaactttgaataaaaaaaaataa

SEQ ID NO: 2655 - DNA, 660 bp, Cryptosporidium hominis
atgtcaacaactttaaattcttttgtaggaatcacagattttgttcttgggaattgtttgagtgcaatattaattctttctggaaaggaggaaatagatggaagccttcttgaattggagagtgtccttcaagaaagctttagtaatgtaaaatttggtaaaatctcaccttctggagtgaatgaaatttctgcaataaaacaatttgatgttaaggagctaccttcaatattattatttacttgtcaaagcttaaaaccttataaagtgatttcaggttataacccatcggaattacatacaaatcttgaagagctaataaagatccaaaatttaagtatcccaagccaaaatgaaaagtttaagattttaacaaactttaagagtttaatggtttttatgaaaggtattaaagaggagccatattgcagatttgcaaaaggtcttgtttcattattggatagtattaaggtaaagaattatggtcattacaatatatttgaaaatgaagagactagacaaggcctcaaagaataccataattggccaacttttcctcaaatatgtattaatggagaatttataggaggattagatatcttgaatgaaatgcattctaatggtgaattagttaatgaaataccaaaagatgcattttag

SEQ ID NO: 2656 - DNA, 474 bp, Cryptosporidium hominis
atggtagataatttagggaagccattaacaagaggacaaagaaaaagaagactagtgttagagagggtgaaaagaaaacaggatttgaccagttacttattaagagagaaacaacttgaaaatgctaaaaatataaagaaaaagtgctacaatttgaataacctgaagcatgagattataaatgcttcggaagttgacaaggaagaagcatctagtcaagagcaaggcaagaaaaataaactttcgaggaagaagatacaaaatattaaaaggtcatctatagaattttacagggatgttcttcaacatcctgattttaatgaaattgacagtattaagtcaaagcttatggaaaaatttgaaaataatgatcatggaaatgaccagattatggatatagtcaagaactcaaagaagggaaaacaaaaggttaacaaatctgttaaagttgctaagagtattaaaaaaagatga

SEQ ID NO: 2657 - DNA, 1308 bp, Cryptosporidium hominis
atgggtaaggaaaagactcacattaacttggtcgttattggtcacgtcgactctggtaaatcaaccaccaccggtcacttgatttacaagctcggtggtattgataagagaactatcgaaaagttcgagaaggaatcttccgaaatgggtaagggttccttcaaatacgcctgggtcttggataagctcaaggctgagagagaaagaggtattaccatcgatattgctttatggcaattcgaaaccccaaaataccactacactgtcattgatgccccaggtcacagagatttcatcaagaatatgattactggtacctctcaagctgatgttgctttattggttgtcccagccgatcgtttcgaaggtgccttctccaaggaaggtcaaactagagaacatgctttattggctttcactttgggtgtcagacaaatgattgtcggtattaacaagatggatacctgcgaatacaagcaatctcgttttgatgaaatcttcaacgaagttgatggttacctcaagaaggtcggttacaacaccgagaagatcccattcgttgccatttctggtttcgttggtgataatatggttgagagatctgacaagatgccatggtacaagggtaagaccttagtcgaagccctcgacactatggaaccaccaaagagaccaactgacaagccactccgtctcccattacaagatgtttacaagataggtggtgtaggtactgtcccagtcggtcgtgttgagactggtatcatcaagccaggtatgaatgttaccttcgctccagctggtgttaccactgaagttaagtcagtagaaatgcaccatgaacagatgccagaagccgtcccaggtgacaacgttggtttcaatgttaagaacgtctccatcaaggatatcaagagaggtttcgttgcttctgatgccaagaatgacccagctaagggctgtgaagacttcactgctcaagttatcgtcctcaaccacccaggtgaaatcaagaacggttactctccagtcgttgactgtcacaccgctcacatttcctgcaaattccagactatcactgctaagatggacaagagatctggtaaggttttggaagaaaacccaaagcttatcaagtctggtgatgctgctttggttgttatgcaacctttgaagccactttgtgttgaggccttcactgactacccacctctaggtcgtttcgctgtccgtgatatgaagcaaaccgttgctgtcggtgttattaagtctgttaccaagaaagaagccacttccaagaagaagtaa

SEQ ID NO: 2658 - DNA, 1938 bp, Cryptosporidium hominis
atgacagtcaagagaataccaataacagaaacagttcttttattactggttctcttgatattatctcataatggaacttctgccctaaatatctattctgcattacctgatcatattgtagaatggcttaaaaggcatattcttatcgagatcagtaacgtagatggtaatatacctcatgattacttgaaagatgatcacctagaatatgctcaaacttgcaattcaattaatggtccattttgtaaatatcttaatcaaatttctgactcttccgaatttgatcttgatgtaaaaaaatatatttatgatcatgaaggaggtatcggatattttaataaagatttcttcgttggtaaaagtatatttaatttattcttaattccaaaaattactgatctaaatggaggatatgtatatggttcaaaaattaagggtgtttctagaacaaggtctgatgatactagtaaaatacaaagacattgtaagctaacaaggaaaagtttattctactgtattaaaattattataatgagttattacaaaagttccattcgacaattcactgggattagttatatatctaaatttatcaatatttggaaggaattcttaagtcttataaaaaacaaaaagttattcaagtttattaaaagaaaagcaagtaagagagcttccaaaatgatgtatgaaaaaagaactcagatatatacaatcattgataattataatcttcctccattacattcggattttctcaatcaagaagacaaatttttgaagacaaatagaatcaaagacgatcaaagtcaattaaaatatattagtcaatttcacagtaaaagtacctattttcaaaccaagtctaatctactttttgatgaatctttgagtcaatttctaaaaagtagatatgtcagggttaattttatcaatagtttaacttggattctacagcaaaacaatccatattctgatatttggcaaaattggaggaatgaaaagcttggaaaacactatataattattgatcatcatgaaaattacaattgtgataaattctctatttctccttttaatggtgctaagatttgttcaaatctattatttggtaatttttatgatcaatttagagtgattagaaaagcatggaatggagtttcttctattatgaatttctcaatattgaaaccaaatgttcgtattttgccaagacaattctctagtgatgaaaatctttcttgtaattgggagggattgtgggaaacttattacgaccaagttttaaatattaaattactttccaaattagggaaacttaagataattaatgaaaagattgttatttctcgtctccctatttcaataagtaaaggttttataaaaagtcaaactcataataaaatggatgaattaaaaaccattactatttcaggatataatcattcaaaattattatggaaagcaaccattcctataaatgaatttataatagaagatagtaatgaaatcaaatggatcaatgctttagactattcagataatattccatattcacttattaatattattcaatttgaaacagatctcacaatagataatatagaacaaagtattatagtaggtcaatttgaatacaatctattgaatccaatttttaattatattccaagaactggacaaatctatgagaatttgaatgtagaaataggccaagtggctgaacttagcttagtggtttacattaacaataaagaaaagagaagaaataatagaattccttcaatatctatgacaacaatgtatgccagcaaagcatctcctttagtttcaatgtataatatagagaaaaacagactacaattaaaagacagaatcaatgaaaatactctttgtataattaaaagaaatatggcagagatcactaaagatcaataa

SEQ ID NO: 2659 - DNA, 483 bp, Cryptosporidium hominis
atgaaaaagctttcttttttattcttgtttttttttgaattacaaaatgcatggtcaagcttaaactcaagcctaaactcaagctcacatcaactcattcaaaacaactactggaattctcactttccacatataaaaccaattaagcctggagaaacaaccacattagaaactggtatatttaaatgccatactgagttaaaagatgaaaaaactatgagaatctcttgggagtgttttactaaagtacataatgtcatttggattccaaataaaaagactttgaatgaaaaaaacaaatatttaatcagtttcactgattctttgggtaccttgtatacttttccatactctccaaaaaagttacttaacctctgtactagtactagcattgatatattcggtaattttagcgaacaagaagtcgcaatcttgccaaaagactttaaatttctaactgtaaatgaatgtattaactattaa

SEQ ID NO: 2660 - DNA, 1206 bp, Cryptosporidium hominis
atgggccaaatctctggaaaggatgattcattgattggaagcagttatattaaactggttgatattagagagttatattgtaaacaaaagatgaataagaatagtggaaaacttaaaagttttaatgatgagaaatgggacattagaaaaccagaaatactttccaaggaatggtataatatcgacttgcttgagttaagtatcgatgaaattaaagaaattgcagaatttttaatctattacagatttagagaagtaatacgtgataaagatgattatgatgatgatgttttgtcttggcaaataaacaacagaaaaattaaaaactttgtttcagagttaataaaatattaccatgaagaaaatccttttcataattttcatcatgctgtaagtatttccatcacactaaacaattggctagacaaaccttctgtgagacattatgtaaattccttagaagcttattgtctaatcatttcatctctttcacatgatttggatcatccaggattaactaatgatatgattaaggagttgaacattgtctcaagaaaagtattgcaagaatttacaacagaagaacagttttttgaaattttacaaaacaatactctctcaacactaaacatatataataatttttcagtattggaaaatcatcattcttctctcttatttgtaatattaaatgatgaagcttccaatattatgcctccaactacttccaaatgttattcagaattacataaaatgatgattaattcaatactatttactgatatgttccaacacaaatatttgagagacttagttttaaactttaataaaaactattcctcaaattcgaggagtattgaagttgaagcacaaaagaagaagttgtatttatcaattttactacactctgttgatatttcaaatccattaatgaatactaatatatatctaaaatggtcaagactagtttatgaagaattagaaaaccaaaagaaactaaaactaatgttaaatatttcactaaatgacacaactgacacgtatgattatactaaattgcaaaccagctttattagctcaatctgtattccttattttcaagcattactaaaatttgacccagaaatagttcaagaatgcattcaaaacttatactttaacaatgagtattttgcaaaaactagtcagaaaaacaagaacaaataa

SEQ ID NO: 2661 - DNA, 3123 bp, Cryptosporidium hominis
atgtccagtgaaaacgtaaagactgatagtttaaatctaggaaagtctattctatcaccgcaaaatcgtaatagaactttattattgaagaaaaatgttcaagatgaagaggtcgaggggagtggtgcagaagaaatttctccaattattaaggtaactccagcaaaatctacaagtaagatacaaacaaccccaaaaaaaggagatagtcccgggaaaagtatggttaaaggtgaaaccacgaagtctggaataaaaaaagaaccttcattgggaaagaagacaattgtggatattactagctctgggttgcttggactttcaggaaagttaagagagaagaaacaatcagttccattcaacttgttgaaaggaacaacaaatctagaagctggaaagtctgatgtaaacaaaagtatcaaacctccaaactcgcaaggatctgtattacctttgacgaaaaatgcacaaaactctgcgaaaattctaaatatggtgaataagattaatgctgcaaaggatttaagtcctaatattgtagattttgatccatttaagtccaagcttgtaaagactagtaaaaataacataaataataggtctcatttgtttggccacgagccagcaacctataccacaaatcctctcataattgaggatttgattgatgagctggaggagaaagccaagaactattttattatgttttcaaaggagcgaaaagaaagagaaaaattggaaaggcagtgttattggatgcaggaagaaaataaaactttacaaaatactttaaagaatcaaatgactacaattcaagggcttcaaaacaaaattattgacttgagaggaaatccaaatgttataacagaaactattgaaagaatagatatgctttatactcaattagatactttaattcaagcttttgctggtatatgtagttatattacattcaatgagccaactgacagacgtgagattattgagctggttctagagtatctacatccatgtaggggacttgatttgagactcaattcattatatggatcaatttattactttaagcttggaattatcaaagatttacctcctcctatacaaccaccagaaaagattccaggatatgatgtttggcagccacctccaccacaaaaagttgatcagaaggattctgataattcaaggcttcaaccacatatgcaacaaggtaattctttatcaaaagttgctgatgattatatgaatgatggaccaaaagaaggggctgcaaaggcttctatatctgataaaattaacaaagatgaacaatcaattccaaagatttcaacacctgttgcatcaaccaagcagtcagttgtaccaacaagctcatcacaattgactggagatattaatgtacctttatcaggttttgaaataaagattaagtcagtccaaggaattgaaccaattggggatggtaaaggtaaactatcttttgtggctagaattgataacgagtcctcaactcagtgtaagaataatccaaagagaaggtcatctgaacatgaatacaaagttaatcatgctaacaataaagggtcaattgaaaaggagatgattctagaaatagatactttacctcctaaatctccaggattaatacctagatttactattgatatgtgggattcatcaataacttccggtccaattggccatgcttcaaagacatttattgatccatacacattacttccagaacaaccatgggatgtaatgaaggaagatggtgataagcctttagctactttgataattacagtggctccaaaaccaggaaactcaatgcttccagctggtcgctttatagttgctaaggaatcaaagaataaacaagacccaacagctaagaaggagagtaagttatctagactaagcttcagaggagataaggagagcaaaggattagataagattaactcaatgcttagaccagcattgaatattggaaagagggcaaagagtactgttaatttggacgataaggatgagaagaatgaaaaactgaaagaaggcacagacttaacaaagtcagttgtaaaaccattatctattaaggaatcaacttccgttcctcctccagctccaccagctccaccagctccaccagctccaccagctccatcagctccaccagctcctccatctccacctactttaagcaaatcggaagctcaagagagcccaagcgtattgaaatcatcacaaataacagtcaaagaaccatccaaagcatcagaaggtgatactaacatattgaagaaatccatgataaatcagcaacctccaaaggaagatttgaagtcttctgttaaggctcctccagtcccaaaatcgggcccaggtaatgagaagactgaagaggaaaaattaaagagctcagagccaatcataaaagaaaatgtaacaaaatctaatttgttagctccaaagtcggatttaataaaatctgatgcactaaagaaatcaacagaattaggaaaaagtcaagtagactcaaagtctatgactattaagaagatgggatctggagaattggacttaggcaaaaaatcaatttcagctccaaaaactgatgtaaaatcttcaacatcagaaaatactgtatctaaagaaatcagtgctccaataccaattaagattgttccaaagattattccaaaacctgctattactaaggaacaacccacaaacaatgctccgaaagccgtacaggttaataacttagctccaggaaaagtaaaacaaattactcctcctacaattattaaaaagattgacgttaaaccagctgttattaaaccaaagatagctacagcagctcctgtaattaatattaagaaacctggaagtcctgtccaaatcaagcctaaaggaatcgaactaggaaaacctgctgttacaattactcccaaatttgctgcaagtcctccaaagcctgcctctggagcagcagcaggaggggctgcatcagctcaaccaaaagaagatttgaagattttagtaaccaaaggagtagcaaatatatctccaaaaattgtacccaaagttaagatcacgccaaaagtaaaaatgtaa

SEQ ID NO: 2662 - DNA, 447 bp, Cryptosporidium hominis
atgataaatcagcaacctccaaaggaagatttgaagtcttctgttaaggctcctccagtcccaaaatcgggcccaggtaatgagaagactgaagaggaaaaattaaagagctcagagccaatcataaaagaaaatgtaacaaaatctaatttgttagctccaaagtcggatttaataaaatctgatgcactaaagaaatcaacagaattaggaaaaagtcaagtagactcaaagtctatgactattaagaagatgggatctggagaattggacttaggcaaaaaatcaatttcagctccaaaaactgatgtactggcacacccaaatgcccctcaaaatccgccctataatagcagagctccaattgttcctcagaaccaaccaactatgcaaccacctccaggaagacaagtctttggatatgcagttgttccaaacatccgataa

SEQ ID NO: 2663 - DNA, 3615 bp, Cryptosporidium hominis
atgcatttagaaaatccaggcactatacagaggggggtggaggaatttgaaaatgaaatagaattctttttggcgaaactatatgaaatcaatcatgatgacgaaactttgtcttgcaaaatcaatacctttaagaggatgaagctaagtagagattgtgattctaagagagtcaatttagaaagaactcgtcgtttaatcactcatctttgtaaccatgggcaataccaatttctttatgatacctttaaaaagaattatttcgatctttggactagtaatatccaaacaatccaacaacacgaattggttacaaccattcagaataagattcaaaaagataatacaggtctagagctctctgacttcatatataatactttgttttctctagaagacttcaggatgttaatccaaaatggaataataagtgactatttgaatgtgttcacaaggttttggtgccatcataagagatccactcaaatcatatgtaacgtgtatttgacttttgactgcatgtacaagcgttatagagcaactataagtgcttctaataaggagaatgagtatcttggctttattcaaaatgccaactcttttctaaagtccatcattctttctatacatcctgcaactaatcattcctatatgataggatcagtgcccatttcattagtgggattattactatcggtttttatatctataaatgaaattagagacttcagttactctaatcaaatttctgttactgagagattaaaggaagcagttgaaggaaaatatgaaaagcctttttttatgctcaaaaagatctttgaaatgtttattgaactacaaattataaaccaagacctgaagaaactttacttggagattctgagaaggtattacttgaagatatttgaagaaaagaagtctttaggctttaaggattttgtcaactttgtgagagaagctttggaattggagagaagtcttttagttacttataataatagagatttgctttataccagtaattttggaagctcaagttcaaagcttaatacctctcttttatctctgatccaccaagatcagaagatcccattgaatgcatttagagacacttctccaacagatatatccggctttgatcaatataacgaagatgatgaaactagctgggatttatttgtctttaacgtggagctgaacattttagacgttttgatttctgatgatatcattcatcactactccaaaagtaatcaaggacttagctgccttacgttacttgtttcaaatgaagaatttgagatcttgacattccttttcaatgtattcaaaagaaagaacaaagaacaactatttagaaaagagctagagaaatgtataattgaacaaggtctcgatttagttaagcaactacccaaatatcgatttttagttccaagtgaaatgaaggatcacagaaagacaaactctatattcgagacttatttgcagaatataaaagggttgttggagttttatttaaagattgagaggatctggaagagatcttttattgaggatgagaaaattcgtaatttgtgtataaatgaggcctgggtacagatcttgaattgtgacgataccttagccaaagagataatgagaggattttcaatattaattcaccacatattggttagaagctataacttccataaaggggaaaatgtagatttaagatctggtggtacccaaaaaagactttctagagctaatttggacataatttgttggaatgtcaataattcctctagtgggaattctctagagggaaccagtaatggtagtgatattaagactagagaatactttgagagcattatttatttatttaaatgcagtaactataaggattatttccagaaatactatcatcagctattatctcaaagaatagtttactattttacaaacaacagaattggttttggaagtaatcaaggagaaatcctcaagtattaccttggctggagttcatcatcagctttgggaagtaatatagagatgttaatgaacaaggttgatatttatgagatttatctgatgaaattactttacactgaatgtggttatacttttattagtaaatcaaactttgtaattaaggactggtttgccagtcagtccatctttaaattctatctattggagtctattgggcaccaaatggcgccaagcgttaagattgttgaagatgctaattcagaatcttcttgtttaagaaaagatgagaatcttaaaatcgaatttggtagtttttctcacagaaaaaagagaattacaaagactttatctacaacaatttgcgaagagatccacttttggcttaaatcagaagatcttaaaatgaagtatgagagttcatccttggataatgtaggattggttgaaaatgacgaggttggtgattttataatttctagtggtgttccttctgaaatccaaaaatctcaagaaagcgaggagcttgagaaggaaattgttcttaaaaacatcaaatatgaagttccattttctttaattgtgttatcttcaacaaactggccattaagaaattataaaaatggagaagatggcgccaaaaataccggtattataaatgaagagagttgtttaccattaaattttttggagtgtgaattgttttccaagtacaatggcaatatagatattcaacatatccacaatgaaatgaaactttaccaacaattttatactaaaatttactccagaactttgacttggtcttattttttgggtacttgtataatggattattgcatgcatgcattagggcgccaacgtctgaggatgattttaactttacagcaaggaatattattattatgttttaatgaagagaaaatgtttgtggaattaagaagagaacaatatttagcccttaaagacaatattggtagactatttgatccaattagacttttggtggctcgagtgagattggaaggagaaattgaagaagtggcagaagaaaaagaattggagttaccgccacttctaatgttacatgaggaaaataaagataatgtaaagattgggtataatatagattttgatacaataataaaaaattatgtaggatctggagagtttgatcaatcaaaggaatatttgatgaactatacttcaggtttgaatacaatagactttagttcagacttttgtttggactatatttataatgaaaaggattatttggatgagaatatgagtagaaacgagaaaggatgtattggaagagaagagcaatatagctttgattatgatagcttaaagagtaataactacatttctttgtttaaaaataataagtaccgtatagaggccataataatgaaattcttaaaacataaacaaaagtcatcacttcttaatttagtacaagtagtaatgaaggagttttctttaaataaagatgataacgttgacagtattcatcagaacaataagataatcaacggagagatcttgaagattttgaattctttaatacaaagagatttgatagagattgattcagaaaatgaacatttctataattatataccttag

SEQ ID NO: 2664 - DNA, 2298 bp, Cryptosporidium hominis
atgatgacgtcatttgtgtgttcaagtgcaacttatcaaagtatttttgggtgcaacgttgtatattctgttatagtgaacgggttggagtatttctttatttataagtatgagtcccgtataataggagattgtgaggctaatgcttggactggggtgattgaaggagatgacaagtttgtaggatttacaagcaaggctgatggaaacaggagtgagatcttttacttggataatacgaacggattgcaacgatcttgtaagagattaatgactcatattaatattagagagactgaatttggtaacaagttattggatagactggactcaaaggattatagagaaaagcattccaatcagtatagctttgacttgaataagaggttgaattcgaattattacgagtgggtgaagagattaagaacatttcctcggtctctttacattagaattgtgaacttgacagattttgatttaactttacagctccctgcagcaagtaagagcgatagcgaaaagttcaagaataggagtttgggaaattcgaccatttcatcagcagttactcccagtatgcatgtagaaagtcacaatgaaaatttaataacaagaggcccatattctccttattctatggagaacttagtttcgggaggacagtggatagaatttcctccagaaaagatttatgcaaatagcatagtggagtttggtgccagttgtgaatctcttttttcggcagatttcaaggcaagtattgtttatagagtttctggatatgctggtaaggttttgtttggatgggatttccctgctggatttaccccaagtctctcgtgtaaaggttttcatgatcttcataatttatcaatatcatcacactatgagaattttaacgatgggaatatattatttcatataatagatgaatcaaaacctccaaagatacgtttaatgtcagttaaggccattttctcagagaattttttgagtataatttctgaaaacagcactagcgaggaaaagctaaacttgaatgagaatattttggaccaaatttttggcaagaataatgatactttgacagggaaaagtggtttgaatctggaaaggaactccacagtacagaatgatgaaaaaaatattggttcaaaaatatacaataaccatgattctggtttatacaatgttattggaaaggatgaggagtttacggacggggacttggccagagatattttgccttactttattgaatacattaaaccagaaagagtaatacattgcaaagaaggaaacatatttctttataataggatagctttagatagtccaagagtattattttcttctcttcttgcaagcagcaacataaatatgcatcaaaagtattgtgggaacatagattcaatttctctttttattgaatggtcaattggatgtgaaatatttaggaaaatttggggtccagatgataaaccaattctggtatcaagtagtgctggaggaatgaatgattggaattcaatattgaattccatatattctcgaatttgcagaagaaacaggtcaaaagatagaatttacttttatgatgatgatgatgatgatgataatgatagacgagaatcaataggaaagaacacttattcaagaaaattgtcaagctgtcagatgaactgcttctttctggaagatgaggccgaagtgaatgaagaagaccaatctaattttgaaattgctttaactgtacagcaactactcgctcagatacttgcaccatacttggttaaatatttgaaatcttcaaccatatccaaaggtggaatgtcctccaatatttcaaactcctcaagattttcgaatgcttccacagttcttcaaggtcttgttgatagtgaccatatatggaaatattcaaagattagaaatatcaaaggagttaataattttgatgagagggataagcaaggtattcttgactttcaaggaaccataagctttttaattttacactgggatgacttattctttgaactctttgaaaagaaattaagcaagctatcttcatatttcaaacatcaattcaattcagatactcttttgtgcattattcagagagtaagtttgctttgggaaaataaggattttgagttttttgaagattccaattttcttctagaatttatagatgctgcagcagtcatttgcagaattattgagaatgatgaaaacagccacgcattgaactgcttgattaagctccgtaattcaattaaagtaaagactccttga

SEQ ID NO: 2665 - DNA, 390 bp, Cryptosporidium hominis
atggcaggacaatcagcaaaaagaatagctaaagaagctgccaaatacacatcaatttacctttatataatgatttcttgtatttcaattcatttcatttttaaaggactatataccccatcaaaactgattggaaaatcaggcattggatttgcaataatttcttccatttacttttttacgtactccagtattaaatcccgtttagaggttggagttggatattcaatgtaccaagatgtatatatcttaaactctatggttgcaatattatccgttgtatcaaactatttctggtatatttttttgctaatcccaatttatattatttataaaattggaaaattaatcattaattgggtatttacccctgaacctgtaagtttataa

SEQ ID NO: 2666 - DNA, 1321 bp, Cryptosporidium hominis
atgagactggtcagagcagtgaaacatattggccaaaatgcagaaaagttcaggtttgatctgagagttgagaatcttcatatttttctacacgaacagtgtgaaattactattgattggataagaggcccaaagaggatttctggaaaagaagctgtatcatgcgtgaatggaagtataatacatcctttctaccagccaatggtcttgattgcaacactattccaaaaatcctctcagaaacaaggaaaaactcaagcaaattctgaaacattcttacccaaggattctagacttgttatctacggtaaatttaaagataatcccctggtttcattgattggagaggtccctttggagctttcaagctttgcaaacagctatagactagcaggttatgaaacttctgagccggtaaaagttgaaattccattaattaaatgctcagacccaaattcatatattgagatttatatctcatgttcttctttaggccaagtttctgagggatttgatgatacagcttctatgatgtccggatttaccacagtttatagcgagatttctgacaatccaatacaaaacttaaatgaatttaaaaataactttgcaagggttaatgaattatcttctgttcataacgatggaattactcaaaaagaatttcttggcaaacattctgataaaaaaaaggataacaaattatcatgtgaaagcacattaggaattccaatgttttcaatcaaagaagatattgaggttattaatgaaacagttagagaggcggaagagttaaccgaaactgctactattattgatgttgaagttaataatgaaaagttggaatctcagatccatgagattcgtcagggtaaagatgaatcagagacaaaaaataatggattaagccaaattaataattatgagggtagtcaaagagttactccaagttattacccaaatccaatgattaagataccaaaccaatccatggacaactttaaggcatttgatgttgcttcagatcagggaattgcaaaagtttcatctcctcagtcatcaacatcttatgagatacttacacaaaggttatacatggagcaggaggaaaataaaagaaggattcatgaatataacatggagattaactctttaaaacaacaactacaaatatattcagagcaggaaaagagttggaagcagagggaagcagatttgatgaatgaaatcatgattttgaggaatactgaggacttgagtgataagcctgacaataaaaatggtattgaaaacaataaatgcacaaaggttgtaggtttgg

SEQ ID NO: 2667 - DNA, 441 bp, Cryptosporidium hominis
atgtgtaaaagtcttttgaattatactgatgcagtcagagataatttaaattattatccaattgatgttcctctattaatatgtcattgtgtacatgacatattgacagactttgaaggaagtgaaagtactattagttattttaataaatcaatcaatgaaatccaacaatgtgaatctaccgaaagtaatatagaatcagaatttgtattatggccaattacttgtaagaaaatgtcccatattctaactagagaaataggatttcaggatttaattgaaaaaattttagaatgggtatctaaaaaagagtctttgcacgaaagcaagtgtaaaagtttgagaagagcggaaaaaaatagcgagccgcttttcatatcaataaaaaataagccatttttaagacaaaatctaaataaaaacattcaggtatctaattaa

SEQ ID NO: 2668 - DNA, 723 bp, Cryptosporidium hominis
atggatcctcttggaattattcggtttaataatcctaatcatgtaactgatttaaataataatgcaaaaagtttctcgattaatcaaataacagaaaataaaaatgaagagaacttaactttggacttattattatttgaagaaactcaaaattatgaggaaaggtatctgatttcaaatgagatacatgattactattgttatggaaatcacgaatataatttaatccttaataatttttataaagattatgaacttgggatattagaagagtttaacactcataattttgatatagaccttaatatagactctaattccgattcaatttataaaattgaatcaaatccaagttcaaattcaaattcaggtctagaagttgaagaaattcctatttcccatcaaagttttggctctagttcttctttggaatctagtccttgctcacagtataaacctaagtctcagactaactacaaactcgattccaactcaaattcagaagaaaatatttcccactcttggtctacagttttaactcctcaaaatacaaaaatttctgaagaatctttagaccgttttgtaaatagatcaataagtaaattaaagccagatcaaaaggagataatatcaatagataagggtgaagagtcaccagacgttctaaaagctataggatactgccatacttcatcattctatacagtaaagagtttggaataa

SEQ ID NO: 2669 - DNA, 4980 bp, Cryptosporidium hominis
atggaagaacaagagaggaattggccagctattaatggggaccagtctgtttctcgaccttatgctgccatatcagtatcagcaatgccccaaaaccagaataggccattacaatcatttgttccagtccctgaaggagaaagcaatgacctgaatatcagagaggttcaaacttctacaaatacctctatggtggaagataatgctcaactgttacctatcaatcattctttttccaagcatactgagtctattccagcagtatctaaactaaatgctactgtttccattaataacagtaatagcgccacaaacactaatgcaaaccctataagctttaaatctaatatagcaagtggaaacactgagctaagtggtaacagtaataactgctctggaaatactcaaaatggtaccttaaatttagatttataccaggccgctcaacagatccaaacagggaaccaggcaaagccaataattgcaggtttagggagcactaatggatctcttaatgctcctttgcagtttactgctgagcaaattcaccagcagcagttgatgttactaaatgcgatacaacaacaacatattaaacaacaacaacaacaacaacaacaacaacaacagcaacaacaacaacaacaacaacaacaacaacaacaacaacaacaacaacaacagcaaacacaaaatccttcacaattacatgcgcaattgcatgcacaacagatctttaatactatgatcccccaacatgctcagattaatccaatgatttttcaaaatccaatattaatgaatgcacttcagtcaggtgggacaaatccaatgagtgttccatcacaacaagtagtgggccaaccgcattcaccaaacccaatgggcttgcagccttttcctatgcattcaatattgttaccaaccctattacaagctcaaattcaggcacaaatgagacaaccatcatcaaaccagtcagttccgtccagtatttcagtggagaatagttcaattgcaaaaggagtaagccaaggtataggaaaacttccggtagactctcatgaagcaaaaagtactaataacgagaatattgctccctctggagacgagaataatgcgaatgatagtaaggcagaaggaactattacaaataacttgattagttctactttagcaacagaggaaaagaaaggaggagatgataatgatgcaacctcccaaggtataggtataagctcagccccttctcaagtaacaaatgatagcaatggtgtagcagagaattctcaacccactaaaactaaggaggaaagtaaagaaacaaaaggattatcttctcaagaaaatactcaattaactgaaccaaaatctgacattgataaggcagactctaatgccattaccgggccagttcaacaaatggattcaaattcagttaagacttctccatcattagttccaaactctggagggaaccaacttgcaactccattattaaatcaatcccagcaacaggcacaacatgcagcattaattcaaggagggttgttgccagggcttggtattccaataacccaaccaggtgttccaggtgttccaggtgttccaggcattccaggcgttccaggtgttccaggtgttccaggaagccaaggagggttagttaatccatttttgatgatgcaaagaatgtctgcagcaaatcctatgcttttagcattcaaccctcagctagctgctgctgctgctgctgcaacagctgcaacatctacaggttcaggaggacaagctcaagttccagctcaacctcaaaatatgcctccaattattcctcctactccccaaggtgttgcacaacaactttcccaaatgatgggtttcatgggagggagtggaggttctggaggaattgagggtttccaccaattcttccctggattaaacatgggtggggaatatattggaggattacttccaggagctttagctgcagctggagtgaacattggaggaggtattaatagtgcaaatgcaggtgtagggggtggaaataataatgcaggatttaatggaatggtaccgggaataataggatcaggaattaatggaggatgtttattggaaaatgatcttgaaagattacattctcatgcagaaagtcttgtaaagactttattagatacatcagtacctaaatcaggtattagattacgccttgaatgggatagaagaagatattgttttaaatttacagtctaccaaatagaagaagtgagggattctcttggttatcaaaagaaaagattaataccagtcgaccaagatgagttatttgtcaatgtgaatgcatcaaaacaattaagcatagacaatgtggagaaagcaatgtggagtgcgtttgtttctgttcgtcatactttggcaaagtactgtgatcggcaagctgggcaacgacgtcaaagtggggcaggcttaacctcaactgcatcaggacgtaacttaggatccaattcccttgttaagttggatgagagcggtataatttctggcattagtggaaaagttaacaaatcattgaagaaggatgagcaattgcatactagattattggatggcaaaaagtatatcccaggtagtgtgggaggaggattaatttccgacttacctggtattggagcaggttctgctggtcttggaggtagaacatataaatctgatccatatagtaataatatgggaggaattggttcagcaggaggagcatctatgggcggaaattctacgattggtacaaggggaagaagaggttatggtagtggtagtacaacaactaccactacaactagatcaggaagatttgtatcccttaaatatggctatgatgatattctaatgagtgatgatgatgcaattttaggtgctgatcaagagtatgtaggaggaagaaagggaagaggaaagagttcgaagtatggttcaggtgctgttggaggaggatcttcatctggagaggatgaacatggtatagcttcaggatcagtttctaacaataatagatatgcaaagacttatttgacaagtagtagaggtagtagaagaggaggtaatggagcatattcatcagggaataatgctggtactgggggaatgagtgtatatagaacaagaggttcaggattatcactttcagataattgtgattctttgggaggcggtatatcaatttccacaaatgttcctatatttgtattacaaaaagacgatccaaataagaagagcaactctcttgttggattatatgcagaatgggttgataagaatactatttgggatgttagaaagggaccttttaagacggtttttgtttctgaaagtattaaagatttggattatacatcagataagagggaaactttaaaatttacaactaataactacttgaaatgggatccttctcatctgatcacagatttaagagggattcatattcctctttctttagcaggcaagtactttggactgcttaggaatgagagaactaaaggggataaagaagatgtgagaagtaaagtagataagattacagatcaaacttgtgctatttctactgttacaaataatgatcaagttggtattaacaaagaagagcaatcatcttatttaaattcaaatattgaagcaggaaataaatcagctccaattactattaaaggtaaccatgttccaaatgctaatcagattagatttatatctaatgatgagagttttaaaagccagcaattatttaataataatgtagtaggaggagaaaaacttaataatgagaaccaggaagagcttgagagcaagttattggagagtaagctattagaattggaagctgttgattcagttttagtatcaacaattcaaacaacagcagctttagagcaaagaaaaaagcgtgaaaataaaaattcttgtatatcagtaccaactggatcattcttaattagagctttttatagtaataatggcgtaaataataataatggtaatcattcagatagtacaaatgaagatgaaaatagttcagtaaatggaggacattctggaaatggaattgaacatacaaatcacctaattatttttaataatgaggaacttgaagaatacaaacatcttgtattgaggtttatgcatcaacaaaatggaaatgatgattatcatttaattgaaaattataacaatacaaataatataaagaatgatgaagtggtttcagaagctgttgttaaatcacaagagataatggattctgtgaatactactgaaggaataaatgatcatcaatcaaagaattcagtttctcaaacaataacaacaggaacaggaagaattccttcaagaggaattaaaagaagagggtcattgaaaagtcagacagatattactatgaatggaggaggaattgaaggtaattcaacaactgttttagatggaggcagtacttgtagaaacactactgatgaccattcatcttcaatgacaatatcaggtacaaatattaattcgaattcaggtagtagctcatcattaacgacagctttgaatggtggaggagtgttaggacagcattcttcttcttctaataataataatagcggcaatggaatttcttcatcatatggaggagttgttaatgacgatacagtctcctcaggaggagcaattgcagtatctgcaatgttagagggactaattacctcagttagaggaagctcaggagacaaatatagacagcagcaactgatgcaagcatatccccagaatagatttgtatctaaaaagaaatgcagagagacaaacgaaatcttggcaaagtatgttaatgatttggccagtgagtattgtcatcgcaactttgggtctagcaacttggctgatggttatattaatgctttcaatagtcatgttttgaagaattttaataaataa

SEQ ID NO: 2670 - DNA, 474 bp, Cryptosporidium hominis
atgtcagaaaagtactggagtcgtctacttttggacgttgcaacaaatgttagatcaatgcacgatggagtaagcagaatgccatttaattatagagaaaatcaaaagtatccagaatatttggatgatattggagctctctgtgcatgtattcgagtctttcaagattctctctctcccacttctcagcatcttgcattacatccgtatgagaagatttacaaagaccctatatctatgcctgacctacttacaacaagtatatcagaccagatgagagaagaaattaaagcttcagaatcgatcgtagaggaacttaaagatactgatgattttgatcagatattctttaaagatatggatagaagccaaatatgcaacagaattaatgaattcaataattcaattattaatatttctcagacaatttctgacttggatttactgcaattcaatgataacactaaagcctaa

SEQ ID NO: 2671 - DNA, 897 bp, Cryptosporidium hominis
atgactcagttaattattacttatcaaagtgatagtaaattagaggagagtgaggtatttttgtcagagctgaatagaattaagaaggaagaggataaatttgcaaagttttcatccttatctgatttaagagctattgtaaagaagggagaatttagaattgtatccatttatttatcatcaggatcaattttggctgaaatctttacatttgaatttttgaaagagttttatggggtgttggattttggatcagttttaaaagtgaatatattggctctagactctattgataaagttaaagcctttgaaaggaacttgttgttttctgggtttattaaggtaaaaaaattgaagggtgatggattaaattcatctgatagtgattttgagatagttattaaagctgaaaagcccagttggaaacctgaagaaggcaaagtacttgttgatgatattgacttagaaggttctgtaccagacatcaagaattatgttcctcttggacaaggaaaagaaagttgtaagtcaaaagagagagcctgtaacaactgtaattgtggaagagctgatcttgagaaggaaattggaattgaagctgcaagaaaggtatatcaagagaaagttgagacaggtacagctcgctcaagttgtggcaattgttacttaggtgatgctttcagatgttctggatgtccctataagggaatgccagcgttcaaacctggagagaaggttagtttagcaaatgctgagggggatgctaatgatcgtactgttgatatgaatttaatacatgaagaaaaagtcgatttaattacaactacttttgatgatgatggttctggagttagtaatgtccagagcaagggaggagttttgaagcttaatatttag

SEQ ID NO: 2672 - DNA, 2091 bp, Cryptosporidium hominis
atgtcgagtaatgcttttcgtccttttggccaaaattcaatgagaagaacaacaggatttagagataattcagagaatggagatcttaatagccaagatgtcgtaatgacatcgttttctatagggcaaaataagactcaatcacctacacattttgccacgtcatcattattaatgaagggtggtaatagtaataatataaataatataaataatgcttgggcatattcatcatctagaggtggaaattctcaaaggggagcaaatgcagtaggaacatcttcaatgactggaaatatgggctcagcagcagcgtcatcatcaaaagggagaagtatttcggatagcagaagagaaggattgaagacaatattaacatttttgagtaagagaggatatccaaatcagattaatccaaaaactttaaatagtccaactagagcattatatttagaagttttacaatttattataagccagtatgatccaagaataaaaatatctaagccagatgatgagattccaaggttcttcaaagatataggatatcctattacaattaacaaaacaactattattgcacctggagctccaaatacttggccacaacacattgcagcaatgacatggctctgtgagttattagattatgaacaagcagtcttcccacatttgaattatagcaaagatggagagtttggtggttatatggcagatacatctctaacaagtactttgtctaatatttttcagcatgcaaattcaagtgttgcaaatggttttccaaattttgaaggaaataacaataatttagattcgtcaaaattgttatctcaaacattgaatagaaggttaagtgagagttataagttatttctgaatggtcagaatgatggaggattactaaatgagactttggaagcttattgcagagaaaggaagaaccaggctcaacaggctttagagaagaaaaagcatgaacttgaacagatgaatatggaaatccaaaaaatcaatcacgaattacaggaaggagagttattgctccaaagaaatcacacgctttctcaggatttgttaaaaatggaacatgctgttggtcaatgccagaattctattcggcaaatggaaaattcttgtaatgatactgaaaatattttgaacataaaaaagaaggagttgagagatatcgaggatgaaattgaaaaacttcaaaagagaattgccaatcaaggaatacaaagggatgatgtttcaagagtttatcaggatatgaaagtcaaaagacaaacaatacgtaatttaaggacagaaagagaaaatactgaaaaagaaaactgggagattgaattatctattgaggaacattcaactaatttatataatttgagccgagcttggaatagtatatatcaagaaattacaaatattacctcaaatgatataagaactaatgaagtttgttcattcaatttgcttcagcctttatctttaaatatttcatattctggaagcaatgataaatctcaaggagtcgatggaataattggacagaattggagtaacatgaaacatagttgcaaaagatgtattgttgaagttgaaatgtggaagagaaaactgaaaactcaagaagtacaattcagtgaaataatgaagagtacaaaagatactataattcaaaagaaacaggcatgcgatgctttggagaaaaagatcaaaaatttggatggagatttatcagtctgtgacaagagggagatgaggcaattggaacaaattcaagaaaaagtaaagagttataaggcagagtttgaacgtaacaaagatgaagctctaaaaaggttggagaaggcaaagagtcgtattattcaacttgaacaacaaagcaaccttcaagaaagccattctagaaatgaaattattcaatgcaaacaagttattcagtcagatgctgaggcaatttttaaacttaaggagtatattatccaaaatctttcaaattcacttaattcgatttctaatttgaaaaatcaagtaaaactgaggaataattctaagttaattgaagttgaaaaatggaaaaagtaa

SEQ ID NO: 2673 - DNA, 4908 bp, Cryptosporidium hominis
atgaaaaaattgggtgtgccaggcaaggctcctctttctcctcctggtggaaaaaagccgcctccccctgctaaaccacttggagggaaaccagcaacgaaaattccaccaccttcaaaattatcttcaactccttctccaaacccttcagaatctcctctgccaaaaccatcatccccacctccaccaaaaccatcatcactacctccaccaaactcagcttctccatcaccctctcctcctgcttctcctcctggtccaaaggtctcgaaaggacctcctactgcattaaaaccaccttcaaaggccctaatacctaaaaaatcatcagaacctttaaatgatacaccaatatccaatggtcacgctcctccagcaagcgtaccatcaaagccagcctcagcaaaaactgttctgaaaagtataagtaaagattccaaagctagtagtctaccttccagctcaacaggagcatcttccactgcaaccactgttaatggtgaatctaaactattgaagaacaacctctctaaagatggacgttactcagaattaaataatagaagtacctttgttgaatcaactcttccttttgatgttggccctattaaacgtctacttttccaagataaagctcctggaaagagtaatttgagaaaaaaagaaggaagaaatgctcgaatttctcaaagagaagatgatatgtttaatctacacgtaagtgtattggatccagcattaacagaagctgctgaacactcactagcagctttaagtcaaacatttaaagaagagtttgcaagtagacactttacactaacaacttctgaaaagaataatctcttatttggacaaacaacaaaagccagacctcaaattgttaatgagaagtttgaaattatgacagattcccttcttcttttacaacgtcttgaagaatcacgtggagatggagaaatacatgaaatccaaagaatcattcaaagactaagaagctcagctttagagaagtttttgaaagctcaatactcggatgccatgctgaatgctttacattgttatgaaatatctcgagcttttctatccaagtaccttggacacccattagaaggtgtaatggttgtagaattaatcattattgctaaatgttgtggtttaacaggagaattacgtaaaggagaacaatatcttaaagaacttcgatttcttgtggaaaacaccatcttagctgttgcagatcgtaattctgagaataaaaatgcaaagaatgattcttctcatattagcaatatctcaaatttatcaggatctggaggttcagctcaaaatgttacagctgtaggaccatcagtttcatgcgattcttcagtattatgtagtctggtactaacagtctctgatctatgtagtatgtatagagatcatacatcatcagcattttaccttgaaaaatatctttcattagtaaatgaagtttatggttcaggagacttagttatgagtgatgcatactctacagcagcaagttactatttcagaataaagaattttgaaaaatgtaaggaaatgttacataattgtctggaaatcagaaaacaggttctgggagatcataataagaatccacctcatcctcgtgtagctgattgttattcaaatttgggattagtttatcgattacttggagattgtagacaaggagtacaacatataatggtagctttagatatgttaatgaggatctacaataacagagagtttccattagtacaagacaatatactagctttgggatgtatttttcaccaggctggaaactttagatatgctttagagctttataatgaagtttataaatatagaagagagaacttaggatttgatcatcctgatacaagatatgtattagaattgataactttattagatgcagatacccaagtatacttaacagaaaatgtaagcagttgtacagattcttatatagctcatgagcttcagaacaagtgtattgatgcaagagaatcactagaatcaagagcagagagatctttaaaagaaataattaccgataccttaggaaaatcaagtaaattaacaagaataatgtatgaggaatcaccattattagcaagtccaatttgtccaagtattgatcaattaaggtatcgacaattagagacttttttatttgatccaaagaatttgagagggttaaatagaactactccattttcaaataaccaaactcaacagcttttatgtacttcaagaatcagagcactacatggagaatcatttcagagtatgacagtgagttcaacagcaattttacctcacttgaaagtaagaattacaggaccagactatctgggagtttctacaatgctttctcttcctccatttagtaagacagaaagaaagaagttacctataattaacattccaaagttaacaagaggattcccagttatgggagagcagtcagtgacaatgatgataaatgaagaagctcagatagttttggagaaatgggagatgccagaaccttgcataacaccagaagggaagttgttaactcaaatagaaaaagatgagaatacaggtttgccattttatttgccattattggattatgcaggtaaggaagaaatgaaggcttatttcaaagaatcaatatggattccaaatgcattaattcctttagttagacaaagaaataaagataaggaggaggctaaacaagttaaagtaactcagactcagatagtaggtatcgaccaacaacttcctccagatgatattttggtaaagattcaaggagcaaaacctgatgtagaagaatctggtaatgaaagacttgcatgcatttcatttttagatggtggggggaacgtagtaacaaagttaccttatgtgatcgatcttgagccatttgtatgcgcttcaactagaattgctcttacagcatcagcaaaatggggacttccttctcctgattcacagggtgtgatagaacttcttaaaggtagcggagttggcgctcttattagctcaatgattcaatacaaaccttcggatggaggagtatacacaggtattgtgggaacaggtgtgaagtcaggaaaggcattatctggattgctggatggtattgggaaaatggacaacattattaacaaatctgcgccatcgcaagcaaaagaaggtgctcctacagaaccaaaggcagaaccagcagaagcaaaggccccgccagcaaaaggcgcgccgccagcaaaaggaaagggtccgccagcgaaaggaaaaggacctccaggaggaaagggtcctccaggaggaaaaggaccaccaggtgggaaaggtcccccaacaggaaaaggacccccaaaaggaaaggcaggaaaatttggaggaaagtcaggaggtaagtcaactggtccagaatcgaagacaaagaagctacattgggataaggttgagaatattcaaggtacaatttgggatattaaagaaccaatcaagttggatttcgggaatttggaagaagtatttggtatcgaatcagcaaaaccaaagaaggcggcagaggcggcaaagaagccaaaggtcatgcaaattttaccagattcaaagagagcatacaatataagtattgcattatcaaagttcagtgcatatacattccaacaattgcgtgatgctatattggatcttgataagaagattttggatacagaagctacagaagctttgattttaatgaccccaactccagaagagtttgcaatcgtaaaagagtatattgatgcaggaggtgacttgactcagttggataagcctgaacaatttatagctgcaatgattggtattccaatgtttggcgcccgtttaaatgctcagctgtttattctttcgtttgacaactcctttaatgaattaatgacgcctttacaagagattattacagtttgcaacgaaattaagacaaattcaaagcttaagaaagtattttccataattctttcagttggtaatgttttgaatcttaatacagaaaagggagaagctaaaggttttagaatgagttcactatcaaagttatgtgaggttcgttcgagtactaaacctattaaaactttgcttcaatatatcacagagattatttggagagataagccagaattgctttctttggcagagccattggctttagtagagaaagcagccaaatgtgatttaggtgctattgaaggtgaaattcaatcactgaatggatctttaaataaggtcacagatacaatgaaatcagctcagaaaagtaatgagagagccggccctatgggagaaaaggatcccattgctaagattctagcggactttgtttccgatactgagcctagaattgaagatttagtagcaactatgaaaagtgttaaagaaaatctagaaaagatggcactatacttgggagaaccgcaaaatacgattcaaagaattgtttggccagattatttccgtgtattatggaatttcatttcatcagtagatctcgtacgtaaaacaaagttggatgaagaacgaagattaaaacaaaagcaagaaaatctcgcaaagagagaaaagagtgcaagcacagtcaagcttaaactatcagaaaagaaatcagtttcccaacctaaacgaggaacaacagaatccagacctacattacaaaagcaaaaattgacagtaaatatggcgccaaaggcgaatgctgtcaaaaccagtaaacttgatgaaatggcaagctggtttgcgaatgaaggagaagtacaaactccagcattcttacaagaggtttccaatcaagctgatgatacaaatgtggcacttactgatctggatattgatgtagacttgtggtaa

SEQ ID NO: 2674 - DNA, 222 bp, Cryptosporidium hominis
atgaaaattcaattctctctttggactataaatatgaaaaaaggaattaatttatttgcaaaaaaaaaaaaaaaattaatgataattaatagtcatttctataagattcaagcttcttccctagtttctcaaaattcattcaaaggaagaaaaaatggatggagcgtaacaatcaaaagaacttacaatcttgaaaggtggcatctcaataactgtatataa

SEQ ID NO: 2675 - DNA, 1089 bp, Cryptosporidium hominis
atgatttcattattaaatggaacaggatgtgttgcttgtacttctggatgtaaggttgtagttgatgactacaaaactacagggagaatagaatatggtgtatttgtaggatattattctgaaagtgaagaaagtgattatgatgagtcagatgttgttactttagataagaagccttcaaatatccaagattcatcaagtgctgaagtagtctccattgaagatgaattagaagaaggcgaagctgatattattaaagaaatgtttgataatgcttcatctggaggagaatgttcattagatcagacatgccatttagcacatagaatgggtctagcaccttctaaatcagatcttgaaaaacttaacgaagaaactggtggaaaagtaacttatgaagaatttgaaaggtggattatgtcaattacacatccagaagaccatattgattatatggtttcatacttcagaaagtacgatttgagaggaaatggcaagatttcaagacagcaattcatttggttaacaagtattggcggtgatattcttaccagagaagaagctgaagctattcttgataagttgtccattggaggagacgtatactatgaagatttactcagaaaaattatggatgtcgaagcttctgataagcctatggtaaatattggaaacaagaaatcaacgcctacaaaaatgccaacaactaaagtacttgtgacacaagtttcgactaccataagagatttagctgataatgaagcatttcttcctactattgatcttcttatggctttaaaagcaacctatggaaatgaattaactgaagcagctgcaaaagaagctacagattgttgtgaaaatcaggatgaagctgctaaatgtttacaagaattctactcagagtgggcacaaaataaaggtatggtttctagaaaaatcgttagaggtcttcttatggtctggaaggctaagctagaccaggttagtgctgaggcttggattacaagcttatgtggaaccgatgaaaatattgatattcaaagtgttttgaacaaggtagaatgcaaaactaacgagataaactaa

SEQ ID NO: 2676 - DNA, 2205 bp, Cryptosporidium hominis
atgcagaccttttctcagtctcagactcagaatcagacccaaactaagactcaggcccaaatccattctcagtctcattcccaatcccatgttaaagctccaaatcagactcaaactcaaactcaggttcattctcaaacccagatcttatctcaatcccagcctcaatctcgctctcatcttcagtctcagagtttgccaggtccacagtcccagacttattttagccatactcagccaaataacaacatacagcctccttctcacccaagaactcaaccattaccgcatccctactcccaaggaaactcaggacatcaagtatcatctcaaaactcctccagttcaagcattcatccaaatttagtatcagctcaaggatctcacgtacaacaaaacttccaaagcttttcatcttctaatattaatcagagacaaattggagacaatttaaaaaatccaaaccatggaattaatgttgggcctaatactatttataccaaaatagatgataccggagtgggaacatcaggagtaggaggcagtcagtataggtcgaagccttactctcaacagagtaataaatacactcatcagcaacaaatgaatccagtaaactcagtattgcatccaaactattctcaatcttactcacagggttcttcatctaatttaggtggattgacggagacagattctaaggcaatgtcacaatatatatcaacaattggatacaagacaagtaacatagatttgggagtttgtagctttcaagtcaacgttccaaacaatatttcagatgaattaagaaattctattattagattggttccaaaagaacagctcaattcggtatttttccttgtttcatcattaattagcaagagtatcaattttagagactttcatgttcgtctaatagctattttgaggagtagtcaacttgttgaaatccttgaaaatatgctcagagattacttccaactaaatacctcttcttcacatacaaattacactggaattgctgttcatcaaggtatttcagattcaagaggtcaaatttctcatccaattactactaatagccaagtttctgtaggaagatctgactatttattggcatcacaatctcaatacacatctggaataggctccaatagtcaaatatatgatggtacattattgaactctatgatttctcatgctcactcaaaaaagtcgattagtagacatggaggacattataatatgcatgcaaaagaggatatattattacagatgttgaaacatgtaagatctaaatctgctgcaagctttataggtattgatataactggaccttcttcttatatttctaaattaatctcaaataaaactatacaaaacaaatctatggtattggaagaagaatcaatatctccagaaactcttaatatttatacggaaaaacttaataattatggtcgatacctcctttcttgtgatagttcacttaacttagaatttatgaattcaaatcaacaatctgttacttctaaattagggaaaatagttaagtttggtactcagccagatttggaaagatcagttttctcaagtcaagcagtaaagacaatccataagttagtatctttctatgtcagagacatactaaagttcatccttaatgaggaaagtataagtaatgagaagctgaatggtaaaaatcttgaagaagaagaagaaaaaagggaagaagaagagatacaacgtaatcaaaggggacaaggtgatcgtcaaattattgatgatctgataggaaatagtaatagtatacaagttcaaaaaatggagaattcaaaaactgttagccttatatctaaagactcaagctctagtaattcatgtaattttggaatgggtaaatctattggaggaaaaggtctgggaatgaagttaactttatctggtaacgtttcctctgtaaaacccataatgattactagtctatggtcatgtatatacaaatccttacgttataatatgaatagatataatgcatgcgaacctaatgctttccataatataataattaagaatcgtccaggacattctaaagaacaatgttcgaattatattctaattccagagtcaatgtatagaagtgttgaatcctggctactttcaaatgcttataatcaatgggataaacttagtatattataa

SEQ ID NO: 2677 - DNA, 450 bp, Cryptosporidium hominis
atgccattttcacaaaatatgatgtattgtcaggcaatcattaatggtccaaaagatactttctgggaaagtggtaagtctaatgttatcaagaaatttaacctatatacttcaaccacaataggcacctttaacttaattatgcaattctctgaagaatatccaacaaaacctccagatgtaagattcttaagtaaaatgtttcatcccaatatatatccagacgggaggatatgtttagatatacttcagaatcaatggagtgctttgattgatattgcttctgtattaacttcaatacaatccttattgagtgatccaaatcctaattctcctgcaaacactatagcttctgaaatgtatgttaaggaaagaaataagtataatagtaaagtactagaatgtgttgaagaaagttggtcaactccctcttattctctgcctaaataa

SEQ ID NO: 2678 - DNA, 669 bp, Cryptosporidium hominis
atggcacgtcgtccagcaagatgttatagatattgcaggggaaaaccatacccaaagtcgcgtttctgccgtggtgtaccagacccaaagattcgtatttatgatgttggtagaaagaaggcagaatgtgatgctttcccagcagtaattcacttgatttctgatgaatacgaacaaatttccagtgaagctttggaagctgctcgtatttctgctaacaagtacatgatcaagttttgtggtaaggataacttccacttaagaattagagtacatccattccacgtactcagaattaataaaatgctttcatgtgctggtgccgataggctccagactggtatgagaggtgcttatggtaaaccaacaggtactgctgctcgtgtgaatattggtcaggtcttgatgtccattagatgcaaggaagataagacccagactgcagtaatggctttgagaagagccaaatataagttcccaggaagacaaaaggtcgttgtctcagacaagtggggtttcactaagttcaccaaggaggaatacctcaaatatcaagctgagggtagaattgttcctgatggagttaactgcaaatacattagttgccgtggatctctttctagaatcttcccagaagctgctaatattaatattccacttgatgactaa

SEQ ID NO: 2679 - DNA, 1059 bp, Cryptosporidium hominis
  misc_feature (24)..(24): n is a, c, g, or t
atgacaacttttttcaatttttgngatgaatgtgaatacaagtatgattcaactgtacatggatattttatggaatcctttgatactcttccaattgctgcaattattaatggaaagttcttttgcgtacatggtggactttctccagaattacgttcagttgaccaaattctgacaattaatagattccaagaaccaccaagatctggactttactgtgatattttatgggctgatccttttgatgaaaaagatgaaactgaaacttgtgaagaacatttcgtgaccaatgatgtcagaggatgctcatatttttgtgctactcaagcatgttacatgtggattgatcaaaatggattactttctattgtaagagctcatgaggcacaattagaaggttttaagatgcacagtccaaatgtaaaaacaagatttccatctgtaatcacaattttcagtgctccgaattattgtgatgtatataataataaaggtgctattctcaagtttgaaaataacactttaaatatacaacaattcaatttctctgctcatccatattatttaccaaactttttggacatattttcatggtctcttccttttgtatcagaaaaagttactgaaatgttatattctattatacaacctgttgcaacttcttcttctgaacctatggaacttgaagaggaagatttaccagatgatgtacgtagattaatggatgcattttgcattaatgaagatggaaagttaccagaagaggttgctagtcttggttcttcaattattagatctgcacagccagcttctagtgttatttcaaaggaaagagctgatactctcagaaagaaagttcaaagtgttgctcgtattatgagagtcttttcaactcttagagagcaaaacgaacttattgttaagctcaagggtgtcactcctggtcatagaatacccatgggattactccttggtggaagggatgctcttgaaaatgaattagaaaagttcaacaaagttaagactatggacgcatataatgaaagaagaccttattaa

SEQ ID NO: 2680 - DNA, 3555 bp, Cryptosporidium hominis
atgaagaattcaaaaccccgtcagaatactattgaggagaacggagtaaatgtgaaggtaattgtcagatgcagacctttgacagaacaggaaaagaaagaccccagtaacagtaatgttttgcaagttaagccagattccaaagaaattgttgtctctcaccaatctttgagtcgtaaatttgactcatactccaccaagctgtttacttttgatggagtttgtgggtcattcacttcacaaagagagctttttaaacaatatgtggttcctattgtggatgaagtactattaggttttaattgtacaatctttgcatatggacagacaggaactgggaagacttatacaatggagggtgatatgaaggagtatttggaatcaagtaatttggaactgactgagcatgcaggaattattccaagagctgtgcaacttatttttgagaggttggaaagtcaatacacagaatatggagttcgagtttcgtatttggagatatataatgaggagttatcagatttattgagtgatgagaagcttaatttaagaatttatgatgatattgctggtaagagaggtctaaatgtggatcgacttgaggagattcctgtaaataaagcacaagatatacttaatatactttccactgcagtaagaaagagacgaacagctgagactttattaaataaatcatcttctagaagtcattgtattttcacaattacaatccacaccaaagaaacaaacatagatggagaagatgttttaaaggtgggaaagttgaatctggtagacttagcagggtccgagaatattcaaagaagcggagcaaatgcagtaaaagatcgagctaaggaagcaggaatgattaatcaaagcttgttaacattaggtcgtgtaattaacgccttagtagagcactcaagttatgttccttatagagattcaaagctaacacgtcttttacaggatagtttgggaggtcgtacaaaaacttgcattattgcaactatcacagcttcctctatatatctcgaagaaactcttaatactttagactatgctcacagagctaagaatattaagaatatgccagtagtcaatcaaaagatgacaaagaaagtcatgatcagagaaatgaattgtgaaattgaaaaacttaaacaagaactacaatgtaatagagaaaagaatggagtttatttacctctttctcagtttaacgagatggaaagcaaacttcaatcccaggctaatgaaattattgaaatggaatctgaactccaaaatcaacacgctctttataaagaaatggaatctactgttaatagtcttactgatcaactaaatgagaaatctttacgtgttagagctggagactttgctaatattcatgtttcaaaacatgccaagctttatcatgaaaagtataaagacttatttatgcaaatgaatcaatctttagagaacattggaaaattacatagaaaaattattggatctgagcttttccaatcttctcagaatactcaactatttaagctccaacaacaacttattagtgatattcagttaactgagaaaaagactagggaatgcctagaaattatatataatgatctcaatcaggatttacttgttcactggaaaaataaaagccaactttcacatggtgaaatcattggaatgattgacactgggaaaaagctttgtaataacgttatctctatgctctctgattctctagaacaatctttaacagaagaactttatgctggtatgaataatgcaaaggaaaatttaaagaaatgtcttaaaactcaagatgaaataactactagaattaaagatgaaattagaaagggacttgtagactgctcaactgatacagaaaagatatcaatggatattactaatcaattagaaaggcttaagctctcaaatgaacgttgccagagtcttgttcaagattacaaagatcattcaaagggatgtgaaacacaattagatacagtattctctcaacagcttgtaggttctgttgaaaatcttgcaaagtcacacaaaattgagattgatcaacgtctttctggacaattatcaagtttggatgagaaatccaagggaatgaagagtcaattctgtaaattagttgataactttgttgaagaaacttccaaggccttgattgatgaaaaggagaggcttttcaaacaagtggatgatttgagagaaaagatcattaatgaattagaaaatgggtatttagcaaataagaatttgtttcgtgaaactaatggccgaattgaacaattagaattggctcaattagagcttgttaaagatcagacagactgtcttgaaaagagaaagaatgagcttggagaacttgttcattcaatttctcaccttggagatagaaagttgattgaaggatttgctgacttttccaagattaggaatgaacaatttgatcaaattaattccaagtttacagaaatatctgaattaagcgctagttcaattcaaagttgtgttaataatgtttcatctgtagtgaatctacagaacagctcttataatgaattatcatcatgtgttgatgattattttggttataacttgacatctttccaaagtaatattcaggtgaagattaatgatatgattcaacttttgggtgaagttacttctttctcaaacttctctcatgaaaaatctggaaataatgagaagaaaggtttttccagtccggtaaaagacttacccaagattctagataaagtccttcaaggattaatagaaattgagaatgttgttgcaaagaccagcccagcctcaggacaaactccaagtaggagacaaagctacaatatacctattttaagagaaagatgtttatctccaatgaaatatgttgattactatattgaaactttaccgagacccaatattgattttaaccaaacccataaaatgttggatccatttaatgatgagaacaaaaaagatgatgaaatgttaaattctcaattaaatcttcaaggggaggaattaccaaatttatcttgtttcaactggggaaatgtaaagtgcgatgaaataagatcattaaacatttctcagtttatccaagaaacaactgctggctcttctgatttgtttttaagggaagaagtacaacagccaaatggaattgataggtcagaaaagagaaaagaacgagagaatattattaatgatgaaaatttgaatatttactcagaaaatactttaaatcttagtaaaaatccttcaatcatttcctcaaaatcagagcaaaagcaaggctcactagattctttaaaatcatcaaacttttatcaaagttctccaattgatgaaaaccatatttcatctaatgaaaatacagaaacacaagagaattttctggaagctattagcagtccaatgggatctagtaaccaaataggtgtgacaatttcttcatcttctacaggaattccaagacctggaagaccaaagagaactgttactgcaaagaaaagatga

SEQ ID NO: 2681 - DNA, 1098 bp, Cryptosporidium hominis
atgagttcttttgtatccacaagcagtagtaggtgccaaacagaagaaaatgagctcgaacaagctattagagaatgcaaggagctgctccaggattcacctcagttattgtatgagcattcatataagaaatggaatcgcatgattaataaaggattggattactttgtcaaagaacacccaaagactctaagaagaaggttagctagaggagtaccacaagactttagatggaaaatttggaactctttattacagatttcttctctagatgatgaggataaaattaatgaaaaggtttctcaaagcttaagaaactcaaatttttttttggaaatatttaatatcaatgaccagaattctccgaattttcagtctccaaccattaattttatatattgtaattattacgattatgctgccaaatttctaaacaaatattcccctctgataagtattgatgttccacgaacttttccagaactcaatatttttagagaccaagcatctcaggaatgcctttttagagtattaaatgctactgcaaaccatattcctgatgttgggtattgccagggaatgaatttcattgcagctttattattaataaccagtaactttgatcaagaaagaagtttttattcattaatactaatactagaaacatatggactttctggattttataaagatcaattcccactattaaccaagtatattcgagcatttgacacaatgtttcagacaaatattcccaagctttggaaacattttcaagatgaaggaatctttgatcctgtttatcttcatccttggttccttactctatttgtttcaactcttccgctcaaaactgttgtcattatatgggattacttgctagcaaatggccttcaatccttaatttccatagctatagcgcttcttaagacccttgagtcctctttgattggacaatcaatggagaatattatccaattctttaaatcccttcgtatttcagttgggataaatgacgtcacatgtgctagaatgttgctttcaaaggcaaagaacatccatatttccgaagaaatacttgctacttttaaggtttag

SEQ ID NO: 2682 - DNA, 1470 bp, Cryptosporidium hominis
atgaccatattatattcctacatttctcttttattcctattcttactctatttttcctttggctcttcattgaaatcgaatcctttaggaaacggaaattatgatcaagcttactcagatagaaatcgttcttctagtaataagaaggtggatccaaagagaattggatcttctggagggctaggttctaatcgtgctcactatagttataattcccgagatgttaataatggaggaatttcatcgcagagccgaacagtttactctagaagttcattttcacctgggaatcagattttattaacaaaacccggtagttcttattcaactccgcctgtaaatcctcctgtacagtcctctttctacaaatattatttagaatctattggaaaaagtcccgctgctcaaagtagtcaatataacatatatggacaaagattttctaattactccccattaaatcctcatcgtacaccattttatgactattacttaagttctgttggtcaatcttacgataaaaaagatggtaattgtctttacgatagaaataaacaaaaatttttaactaatttgggatataatgattctaagaaacaatggagagatcaaaaatctggttatagacagactctcccacataaatctcctaccagtgatttacaaataattaattctaaagataaacaatctttcagatctcaacaaggcagtacaacaaaaacagaagcttctcattctgaaaaaccacatacttctgaattgaaagaagttattgaacgactttcaaatgaaatatctactgtaacaagcccagttattggcaaacaaccattaactttatcaactattctaaataaagaagattaccagttatttagacgtgtaagtcgttgttgcattttaattcaggatttcgttgatatagcattgatgataatttcaaatattgtaaaaacttggactgggaattctgaattattagaggagatgttaattcaagcaaccacagctttttctattcttcactcttcattgtctagctgtaagactaagcttctgtcatttgatccatcaaataagtttgcattatctataactaatggaccgtacattgacgaagaaactgttaaacactctgagaaaagtttagatattgaggatgagaaacaatataagactgtgctgcgttcaattcgtaaaatttccttcaaagttaatgagaattcagacttaataactaaaattttcaaactaaaacaaatggatcagcaatgcaaagattttggtataagttcttgcagaagagctcttataaatattcttaatatatattcaaaggtcttgaaagaagaattagacaaggctcagctagctgcagatatttatacagcaaatgagatatttgatgaatcagctcaatcagactttgataaatatgtactaaaaatttccgaatcatccaattga

SEQ ID NO: 2683 - DNA, 252 bp, Cryptosporidium hominis
atgacagcattttcaagcaactgtgaatatctaaaaattttcatgaatttgatcatatctcacttaaatactacttcatttgaagcatttcatatttttaagctttttgttgcaaatcccaataaatcaccaggaattcaaaagattttatttaaaaataaagataaaatagttgaattcctaattcatttccaaacttccagaactgatccgcaattcatttcagataaacaggtaagtcacttatttcac

SEQ ID NO: 2684 - DNA, 420 bp, Cryptosporidium hominis
atgcaaaatcaaatagaatctgaaaatctcattccagaacttgttaaaaaggtatcatatattgttgaagatacatatagacgtcaaatatttgaaattgaatacttaagtaagcaaggatgcttacaattatatgttgattctaaatatattttgaatatatttgagatacttttactatatcataaaaatcctgaattggataattctaatactcaaaaaaaattacaaactgaagaaaatattcaagatcataaacaaaacaataatgaggtacctgttggtaatgaaattgtgtctcttaataatgctttgtttatgatcatctcaaatacatcaatagaatcttcatcaaataacaatcttttagaatggtataattctttgaaacaaaaaataaaaaataccgtccaagaatga

SEQ ID NO: 2685 - DNA, 732 bp, Cryptosporidium hominis
atgtcaggggttgactattcaaaatgggataaaatagaaataagcagtgacgaagagtcagaaaagtttggttcaaggtgtaatgtgactagatttgactctcctcactcaattactattggaggtcatatagaaagtgaagaagataataaggtaaactctaatgtaatagtggacgaattaaaaaaaatagaacctggacacgtatcaagggagaagatatcatctttaaatgattacgtgtttggggggaaatctaagaatggaaaaaattattattggactcagacagaaaatgatttgacaatagttatagaaattagtccagaaatgcaaagtaaagatttcaaaataaatgtaacggagaacaatattacaataatgtatggattagagacaatactatttgagaaatttgaatatgaagtaaaatatgatgataatacaatattttggtcaattaaagatgtagaatcgtttgataaagttcaaaacaagagaataattaataaaatgttagtattagaattagaaaagaaagaattgaatacaagtattagattgtggtggaaaagaatttttaaagggggtatcgaaacagatatttcaaaatttaataggttcacatcatctaataaagaagaaagaaataaaaaatttcttcaagcttgggaaaaagcacatgatgaattcagaaataagatacaaaatagacagaaatttattatttaa

SEQ ID NO: 2686 - DNA, 804 bp, Cryptosporidium hominis
atgagattcgctcaacttgtggtaggtccagcaggatcaggaaaatcaacatactgttctaccattcaaaaacattgtgaagttattggtagaacatgccatgtagttaacctggatccagctgcagaacactttaactacgtatctcaattagatatacgagatttaatttcattgaatgatgttatggaagagattcatctaggtccaaatggaggccaagtatttgctatggaatactttatagagaatttggactggctagaagaacaactaaataagaattttggtgataatgactatgtactgtttgattgtcctggacaaatcgaactatttactcatctaccagtaatgagaattctagtaacagcattgcaaagatgggatttcaggatttgtggtgtttattgtttagatgttgggtttcttacagatgcaagtaagtttgtagcaggatctgtctcagcattaagtacaatgatacaacttgaaataccacatgtaaatgtcattacaaaatgtgatatagtccaggatgagaatcttgtttctagtttccttcaaaaggattctcttactctaattagtgatcttgaaaaagtgactccaagtcatataatgcctttaaatgttgctctagccaatcttcttgaagattatagcattgtttcttatgttcctctaaagcctgatgatgaggattctgtatcaaatgtactattaagtatcgatatgaatcttcaatttcacgaagagcaagatccaaccatgaactttgatattaatggtgatgaatattag

SEQ ID NO: 2687 - DNA, 1368 bp, Cryptosporidium hominis
atgaataaacatagaaattttttaagaaagttatgttctggcccaatattattaataattttgagcttatccaatagtactcaagtggataaaggcattgattttaaagaaaacttacaattaaaagaatcaatattttcaacagggcttagaataccaaattataataatcattctgaaatttgtagattatgtggttgtgattctacgaagaatgtaaatgtagaaggtttcaagtcttttacatgtagtagctgcaacaaatccaaaattcaagaaggagattgcattttgcaaggagcaataaatgattcaaacaataacaagactaaactagttcatggactagaaacttcagtttttggagattatagaagtttattctttgggaaatctgactttttaaccagtagaagctatagaaataatctattggctcgtatttttgaaccagaatttacatgggaaaatttttcacatggaagtattaaagataattgtaaaatatacagagatgaaaatgatgattatgaacattataagcttagttttacttatacactacatggtgaccaaaattgtacacgtcttttacttcattttgtgaataaacacactggaaatactctatataagaatttacgtccatttaaagaaatagaaaatgattatgatttaaattcattgatagtttttaggcatgatgatgtcaaggttagagtagattctcttgagaaggttaatcttcaccaagaatttaatatcacttcgtacgactcacctcccaagttcctatttagtcctgaacaacaagaatgggtacccgttagtttaagaaatcaagaaattattgttaatccaaaaattattcatgaaaggttattaattatatttcagctcattaattcccaaagttcaactccaaactgcaaaatggacaatgttaaagtcgaagttgttgttcaatgtaaatctgtagctttcccgccaaacccaaaatataataaggactttgttcaagataaacttaagaaaatacattccaagtatgatgataaaatttttaagcttttcttacaaaaatttgaagaaaagtttatgcatgttcttgactcaattcctaatgctccactcactgcaaatagtaacaagttaataacgaatacacccttgagcaacttttcaattccttgcaaagaagctatttatctcgacgatattccaaagttaatgtccaaatttaattatacctccaaatttaatgaacttgctaattctagttcctattatacttcaacaccaacttttgaagatattgacgaaaataagctttttgatgacatcgaagttgcacttaatactaactaa

SEQ ID NO: 2688 - DNA, 4317 bp, Cryptosporidium hominis
atggataaagctggtttggaggctaaccctgattcatcttctccttcttcctccttttcttatggaactgcatctcttagaccagaaaagctccagaaagttcctgatgaactttttgaaatcgctcttgaaagcttttctggagactcattcagtgtctctagcttagttggccgtttattggagcgtgttatatgcagattttctgagatctcaaatagaaaaaaggaagactcatctcatacttctgaagccttttctgattctaataatagatccgaattcctattatggatgaatggattgaatgatctcgtatgtaacttatctttgattgggggtagtaaaaagattgaccaaactcttattcaaagagaaatcatacaactccttagaagacttctctcaactgagacaagttctcaacaactttctagtgttgcatctgaaagtctttcatctataattaaatatctagaggatggaaatctcgagccttgttttaaatcaataatttacaatattccacaaattggatcaggatcaagatcactaatatcggtacctggtttattaaaaacgatacccaaatatggtaataattttaataaagaatcatttaataattattataataatatgtataatattttagtatcagtacaacaaagatctgctattttattcacaatattattaattaaaagtttaacaatactgtctccaagttcaataatagagatgcatcttggattacttcctaagacggattatataaaatctaattcattaattaaatcaacaggttataaatcaattaagtcgtttgttttgttagcatactttttgaatgtttttggagttaaagatgcaatggatgttattatttcaatacaaggagttaaaggatttgagaatctattgattagaatggcatcctatactataggcttgagacaatatgcaactagtaactttattatagagaatattgaaaagcttcgtgatcatcatccatctttagattgggtatcgtctttaagaattactgataaattagcaatcagtgaggaagttcttaagaagactttggagactatttgtgatcatttttctacaaagagtaattcagcttttgctcagaataagaagactttggatttaatacaaaatgttgaaggaattgtcagattctcagatatcaatgattttgcatatgaagaggctcaattattggaaatgagaaaagttggaaaagattctcctcaagtattagttaataatgatgacttatgtataatacttaaacctcctttctggtactgtccaatagaaggtacagggatggatgaggatgaacaagatgaggaggatgaagaggatgaacaagaagaaagtgtagaatatgaagaagaattagaatacgaagaagatgatactgatggtgataaaatagaaaatcaaagaaatgatgataagaaaagaagaagggtaaaaaagaagcttgatcatgatagtatccaagatgaaaataaggatgagaagaccggtataagaaaagatcttaagaataaagtatcgagtattacgattaaagaagaagataatgattctgaaatggaagttaaaaaagccattaataatactgatgaatttgaggagattctaaatagtggaagaatggaaagtatcttgaactttttgaaattaagatgtaaagaaataggtttagatttaagaggtaacgagaaaatgattaaaagaattggattaaagcttggagttgaaattggaggtccaatattaatttttaagaatgaagatatggagaaatactataataagaatgagatcttgaatcaaattcattgtcagtatatattcttatgccatggacagattcagaattcttctgatagaaatgtctctttatcaaatattgtctcaaatgcttcaaatcgaatattctcaaaatgtctttcatcagatggaggtgattctattgcaaaatataatgtttgtgaacatatcaagtttaagaattataataaaggttctccatccacattttctttgtgtacatgtatttcaaaacccggtaacgtaaataagattagagcttatatgcatcaaattggtcatacaattgttggtgattccaaacatcttggtcagaaacaactaagtttggatagaagatattttcccaatatattcttttattgtactcatttggagattcctttaatgcaaaataataatgttaaagatggtgatcatgaaatggaggaaaagcgtgatgggagtacaacaatattggatggtaatgcaataataaataaagaaagtattaaagttatggctccagtttcaagagatatcatggaacttcttgagaatgattttgaaattacagaaaagttctcagatatgtacttttgtcatttttataaaactaatattgaacttgaaaagttggataaagctgaaaagacttcacaagttaccccttctgatgctgatatagaaactagagttgaggatgatttagtagagtataatgaaattaagactacgaatatgaaatctggtaatgttattaatgatgaaaaagataaaagaaaatgttcgaaaagtacagaaaatgataattttgagcctcttagtatatcaaatactctgatagcttctcttcctggacttggatttggacttacaccatttcttggtatgcctaattctcaatatgctgtaagtgtgaattgctctcaagatgagaaatcattggaacgtaaacaaaaccagagattatcattatcttcttcttcctcctcttcatcttctacttcttcttcagttcatactatgataccaccagattcggctagcttatcctctccaactcctgcatcaactttacatgcaaagacaaatggcggagtatttacatcatttggatttggaaggaattttctaacatcttctcttgataattcaacaaactctgcaagtattggaggcgggattggaagagttggaggaggaattggaaatattagaggtggaggtatatcatctactggtggtatgacagttaacaatactggtttaaggcatttggtatctcaacaaaaccaatctggaggtggaaatggagatggaagtagtatcattaacagcaatagtaacaatagtggtaataacaataatagtagttctcttcctataaagactcatccaagcttggtttcttgtcttacagaattaaactcaaaatcagatggatctgcactgggaattggactaagtacgagtaatttggtgcctggaggaggaaatatcttccatcaacagaacttcatgcagggaataatggcaggaggaacaggaggaataggattgggaggtatggcaggaagtttagcaggtggagctgcaggtggggttgcaggcggagtgggaggtggagctgcaggaagcttaacaggaagtggagtagcaggcggagtaacaggagtaggagtttcaccatcaccaattttccaacatcacgggaataatacagctggaattataaatagtggaagatatggaagcttaacaatgaacagtggtattagaatggatgcaggtactggtacgttagttaataatgcagtacaaatgcatcagcaacaacaacaaagttcaggagcaaaacaaggctggaatactcaagatttgcttcaaaatccaagatggacttcatctgaagttaataacgatggttttggaggtggagtcaatagaattgtaggaggaggaatttctgaagaaatgaacgtaaatcaatggaataatggaattggcgggaactttagagctttaaactcaagaggaattaataattctggaggattaaatttgtcaacagttaacttggttacaggaataggtatcggcggcaatatcggtatcaatagtaatattggtaatggaaatagtaccactggattaggaaatataaatgtagcagaaggtaccggtctaaaaattggatcaggagtaacaatgggaccaggagtaacaataggaccaggtttatggggacaacatgctgcccaacagcaaccctcaatcattgttgatcctccgtctcaggggaaacattcgtcaatccaacaacaaattggaggaattcccaatattgtctcaagtctacatgccaaaaacatacaagaaggaattagttcccaaagatttgatacttttcctcatgaaaggggtgaaattactgagcatttggaatctagacaaagaaagaaatctccattttaa

SEQ ID NO: 2689 - DNA, 2172 bp, Cryptosporidium hominis
atgattccgaatggatcaaaacttgagcttggaactttagtattaggttctgaaacagtaaaaaaaggatggaatgcattttcaactttaaataatgcaatagatggagttagaaaagtggcaaatgatgtagtaggatataataattcaacaataggaaatgagaattataaaggggaattgggaaataataaaatagtaagtataatagagaaaatagaagtaggacaggtatatggaagattaaaaaatgatttaaaattaatacaaatatttgaaagagaaacgaaatcaatgggaactttagaaattatttcaattaataataatttagacttttcatatttaaatataagatggagacgaaaaatgggtgaaaaattaattgatatacaaggtaaagattcaagcctaaaatataacttaacagctgatgatgtaggaacaattattattatagaaatatatccaaaaggagaagcaaatgatcctctaaatattacatattgtgaattaggacctatagaaatagatgatacaacaaagatatctttatcaaaatctttaaaaacaggtcttattagattccctgtagaaattataaaagatgaatttgaaagcttaataaatccagaaaattcttcaaaagaatcaaaaaatgatgaagattcaacaatgacaaaagatattttggtagtaacaaatgatgatgttaaagtaattaaaaatggaatgacaagttcaaattcaaactttgaaaagaaaattgtatggtcagcaaaatactttggtggtaatatacatattcaattaaatcatcaatcatcatcttgtcaagaattcactctttgttctggatacgatattcataaacaaaagatatcaattaaaacaacaagtagaaatgctagagatattgcagctttaacaattagatgtttaaatattagacacacaatatcattagaagctataattggaggtggagtttcctggatcccaaaaaactcaacagtaaatgattcagataatatagaaattgaagaaaatagaaaattaaatatttttgcttatataggacgtctagaagatgaaattgcaaatttagagaataacaaggaaaaactgaacgaagataaaaaacttcttcaaactgaaaaagctattttagaaaatgaattagctgagacaatttcagcttatcaagatataatttctcaatatcaacaagaaaaagattctaaaaccaatactaacaaacaagccaaggaatttaacatagaatttgggcttgaaaagaacacaggaattaaacaatccaacaatagtccaaacaaaaaatcgattcaatcaaattcaaataattcttataaatccaccttattacatggatacagtggtacctatcccataaataattcaaaacaagatgggtctagcaattcagaaaataataataattcacagaaaaatgaatccattcaacaaaattccactgaaattaacaaaataattgaagaaaatgcttctcttaaagaatccatttctcaacttaataaaaaatttgaaaatgaaattggcgccagggagtcaatggagcgcatgcatgcagaaattgaagaattacgcgggagattggaaaggtcggataaagaaaaggaagactataaaagattaaatgaaaaattagatagcgaaatccttgttaaaaatcaagaattagagagtattaagttaggacaaggtttaaatttgactagaaatatagaaaagatacagcaattggaagatcgtatattggatcttcagagtcagaattctgaaaaacaacaagctattcaaactttatcaacagaaaaatcaaagcttctaaaagacttttcatcattaaaattagactttgataagcttaaggagcaacataatcaactaaataagagatatataagcttaaatcttgagaattcaagaattcatgatcaggaaaaatcatcaaaatttgacaatgaactcatgaattctgactctcaaaacaaaaatgaccaaactgttgatattacaaaactaaaaagtgagcttgaagattataagaaaactaattgtgagcttaaccagactataactcaacttaaaacaagaatacgaaggttagcaatgatcaattctacttag

SEQ ID NO: 2690 - DNA, 609 bp, Cryptosporidium hominis
atgaatatagaggtaccgggtaccatactaagatcaagaacacaaaatgaaaattttcaagtttcaggacagaatttgtttaagccaataagtccaaaacactataacaatagaaatgaagatgattttcagaatttacttgaaaaagttaaccgactattagatcatgattcttttctggaaagctcagaagctgcagaacttagatctcagtatattttaagacgaattaaggagaataattgtataaaaaacaccaatcataaccaacctcctttggtaaacccatcccatttttccaactctatcagattttcatttattggtaaagtttgtagtattgaattttacctttataatcctctttcatttccaatcgtttgtgaatctctacaattatggggtcatttaagactttatgatggatctactgctactaatcatactattaaagatactggtaactataatattgatcagccgtctaaaggagcagttttctttgaaaaatctattattcttaatcctaatgaaacaatgatccagaaactatctgttattcctttgaagctggagaattattccttgttggtatttcattccttttag

SEQ ID NO: 2691 - DNA, 471 bp, Cryptosporidium hominis
atgaattggatacctaaaatatttataaattcaaatgacaaaccaatctctaggtaccctataaaaactgatcaagattatctaatccatacattttctttttctaaaggaaaatcaagttatattgataagaacaataatagaagcctacttccagcttatatagagaataaggctaattctaataagaaaactggaatatatgaatcgaatacaaaatcctctattgaagctaaatctaaagaaaacctatttatccaacaagatcatattaataatattaataaactaaatataacaattcttgataaatggcttaaaaataacgaaacagcctttgataatggaggcaacattaaaataatcaataattctaatgtatatagaactgtaaatctcccccaaaactatctaaagaggagactaatcgtccaaagatctcatcaatcctactttctcattagaatgtag

SEQ ID NO: 2692 - DNA, 591 bp, Cryptosporidium hominis
atggcaactttctctacttctgatgttaaattattcggcaagtggtcttatgacgatgtcaatgtttctgacttatctcttgtagattacattgcagtcaaggacaaggcttgcgtatatgctccagttactgcaggtagataccaagttaagcgttttagaaaggctctttgcccaattgttgaaagacttgtatgttctttaatgatgcatggtagaaacaatggtaaaaagaaccaagctatacgtatagttcgtgctgcttttgatatcattcatctcgtcactgatcaaaatccaattcaagtctttgtagatgctgttaagaatggaggtcctcgtgaagattctactagtattggttctgctggtgctgtcagacgtcaagctgttgacgtttcaccattgagacgtgtcaaccaagctatttatcttatttgtactggtgctcgtactcaggctttcagaaatatcaagaccattgctgaatgtttggctgatgaaattatgaactgtgccaaggaaaatccaaatagctatgctattaagagaaaggatgaggtagaacgtgttgctaaagcaaatcgataa

SEQ ID NO: 2693 - DNA, 954 bp, Cryptosporidium hominis
atgtggttttttattaggcatgcagaatcagcaaacaatgcaaccaataataatgattcaacagatttaggagaaaagtataatgatgaaagagttccagatccaacattaacggagttaggacgtatacaggcagaaaaaactggattatatttagcttcagaaagtgttaaggtgtggaaacaagaaagggaagaccagaagtcaatgaatttggctagtccaacattcaaagcaatttattgttcaccaatgcaaaggtcattagagactgcaaatgagatccagaaaattcttagtattccagtatttgtaaatccagatctatgcgaagttggaggagtttttaaaggcagaagacatgtttatagccccagagaatcaaaagaagtttgtggcgggaaaaaaaggagtgaaataatggaagaattcccaaattttcaattagatgataggatcacagaaaaagggtggtggggaaaacctcaagaaactttcaaagaggcctctgagagagcaaaaagagtcgcagaattattatgggaaattagttgcgaagatttgcaaaaaaaaggtaccgaatatcaaggaaatactaatattctaattagtcatggactttttcaagatatgataatgaagagactattcatgcatagaagtcctctcccatctttagaggagtctgccattttcccgtgtgaaaattgcgcaattagtcagattgcattgtatgaccacaatattagacaatatgaagatactagccacaaagaccattctcaaaacaatccgagacgagtgtgtatttgtattaaatggaactcttcacaccatctagaggataacgaaagaactacaacaagaatctatccaaattctaggcgtaatcaccaaaatactaaaaattgtaatagtagcagtagtagtagtaatactaataatcatatttaa

SEQ ID NO: 2694 - DNA, 3063 bp, Cryptosporidium hominis
  misc_feature (194)..(194): n is a, c, g, or t
atggcaaaagcaatatacttgaaatattttgattggttagtttttagaataaataatcccatgacaaatggattgatgaataataatagtggaggaggtatcggacaagatattttgtctaagaagatttttcaggaaagatcaataggtcttttggatatttatggttttgaagtctttgattgtaactcttntgaacaattttgtattaattttagtaacgaaaagcttcaacaacagtttaatcatcagatgttccaagaagaacaacaagtttacgaaggagaaggtatcgattggacaaggatcgattttattgataataaggtaattattgattctctcgaaaagaagccaaatggtatttttccactattagattccgaatgtttaatgcctcaaggatcagattcatcattcttaaataagattttaaagttttcaggagattcaaataagactcataatagtaaccagatcatttataaaccaagtaagatgtcaaatagcagctttgctgtttcacattatgctggtccagtaatttacgataccagaggatttttagagaagaacagagatcaacttcattcagatgttacagatcttttaaagttatcagaatcatgtctaataattgaattatttgattccagacaatcaaatgaaaatttagcaaaaagatcttcaatttcaagatccggtaccggtataaaattgagtgaagaccaatcatcaaatgcaaattcaaatacaattaatcgaccaaaaggaattctagtaacagttagtggagcttttagagatcagcttaatggactgattgagactttgaatagtacatctccaagctatattaggtgtataaagccaaatagtagaaaggcagtgcatgaatttgatagcttggatgtattacgtcaattaagatgtgcaggtatgcttgagagtattaggattcgaagatctggatatagtgtaagaagaaagtttaaggatttttataatagatataagatcctttatccctcttttgagtctcacgactttactggagctaagaattactcattgatttgtaggaagatcttagagaagtttcagagtgatcttcaggagggtctaaatgaggaggaaagaagaaagtgggattattcttggcaaattggaaagactcaagtttttgttaaagattccttacaaactcatctagaacattcagtatctgaagcttgtcacaaatattgtacaagtatctccgcaacttggaggatgtacaaagcaaagaaagagtataaacaaattagaaaagcttcatttagtatccaatcaagatggaggtcattccagattaggaaatctttcttagcaattttgggatctagaactcaagctgcaagggttattcaaagaagatatagagatcatttgaaaataaaggaacaaattaaacagaaagaaatcagaaatatacccgaattgaatacggtacctaaagatattgatcatgatcaaaaggtaccgaaattattggatagaattgaaaatcaagataatgatcagaatttatcgtcaaactcagttccaacaaatgtttcaagactttgggagattttggattctttacagacaaatagtgacaaaactagacaagatctagaacaaaataaggaggtagtggagagaaaggatgaagagattgcaaattcaaagatagaaataggatcactcaaagatagaataactttatatgagggccaaattagctctttagagtcaaagattaagttaatggaatctgagcataaaagaatcatcagtgatttggaatataagatggagatttcaaagatttctatggagactgagactagtaggatttcagaatcctatgaatcacagaaatctgatctcaataacaagattttggttttagagcagaaaatagaggttgagaagaacagagtattgtatttggaaagacttttagagcaatctgataaggatttgtcagctcttagaaagcagttttctgcagaaattgaggatagacaacatgagagagaatattgtatgaaagagacagaaaggtaccgtgaaacgcaggtaaaacttcaaaatcagctttccattctagagcagtccagattagcctctatgaaaaatgtggaagatctgaataagtataaaacaagaactcaagagcttgagaaggagaattctgctctaagacaggaacttagtgaaaagaatgaacgaatttcccagctagaggcagcaaatcaacaactaaagtcctcaaaacagttgggatcgcaaaaactcgaccatagttactcaaccataatgagtagatctgacatttctacatgtgaagatgttatttctctaagcggaagcggaactccaaattactaccatattcatccttcacaaaagtcttcagcaaattctttaaggttagcagaattagaaaaccaatattctgaacttctcgatatcaataaccaattaagagaaaatgttgatatcttagaggacgataaagcaactttgcaaaagaggattcttgaactttttgttgaaagaagagcattaatggatgaaaataagtctttaaatgttagagttcgtcagaaatctacacaggtcgatgcccttaaatctactctaacagaactcaggaataccgctgaaaacagtctaaatgagatcagaagtgaatgggaaagttgtgttcaaagactagaagctactcaatatgctttaatggaatccagcaaagaattggaagtagttcgatcagaaagagacgagcttctagcttgtctagatgatgtacaacacttcactgaagctacgatgaaaagaagacaaagatctctaacttcttgcatcaccgccaatgatcctgatcatataaccgctgaatcttctgaaattccaagctatattccttacgataacaatatagactcctcgaacaatctcaatatcatgaatgctcactctcctatggttaattcttatagaagaaaacataataaaggtacagagaattaa

SEQ ID NO: 2695 - DNA, 1299 bp, Cryptosporidium hominis
atggcagtgaagccgcagattaaaacagaaaaagatggaggaaaagaagaggaagaccagtctcgtcctcttgatcaagttgatatagatataatgagaaagtatggaatggggccatatgtgtcgaagattaaacaggtggaaaccgaggtcaaagatttaatgtcagctatttcaaagctgaatagtataagagagtcagatacaggtttggctcctccatctcaatgggatctggcagctgatagacaaaatatgcaaatggaacagcccttacaggtcgcaagatgcacaaaaattatagatgctggtacagaggaagcaaaatatatgatcaacattaaacaaatggccaagtatgtagttggactaggagataaagttgctccaactgatatagaagaaggaatgagagtaggtgttgatcgtaccaagtataagattcagatacctttaccaccaaaaatagacccttcagttgcaatgatgactgtagaagataaacctgatgttacttataatgacattggaggagcaaaagagcagttggaacgtctaagagaagttgtagaaatgcctttattacatcctgagagattcgtacaattaggtattgacccgccaaaaggagtattattgtatggtcctcctggtactggaaagactctaacagcaagagccgtagcaaatagaacggatgcatgtttcatatgtgttattggctctgagttggtacagaaatatgttggagaaggagcaagaatggttagagaactttttaaattagctagaagtaagaaagcatgtatattatttatagatgaagtagatgcaataggaggagcaagaggagatgaaagtgctcatggagatcatgaggttcaaagaactatgcttgaaattgtgaatcaactcgatggatttgatgcaagaggtaacatcaaggtccttatggcaactaacagaccagatactttggatcctgctcttcttagaccaggaagattagatagaaaagttgagttcggacttccagatttggaaggaaggacccagatttttagaatccacgctaaagtaatgagtatggaaagagatatcagatttgagctcctttctaggctttgtccaaactgtacaggtgccgatataagatcagtctgtactgaagctggaatgtttgcaattagagcaagaaggaaaagcatcagtgaaaaagatcttttggatgccattaacaaagttgttaaaggttacaagaagttctctgcaacagcaaagtatatggtttacaattaa

SEQ ID NO: 2696 - DNA, 708 bp, Cryptosporidium hominis
atggcaaaaaaaaagggaaagttagatttaaatatagcagcactaacagctagtgttggatctatggtacttttaatgatgagtatatttctatcttcttggctatataatgcagcaggaaaggggttttatccctacccacgttattgggggctcttaacagtaatagggagaaggacacagtcgcacaatgaggtttgggaaattgcatgtataacagcaggaaagcttgcacttggtttgacttgctcatccccattatgtatttggtactcgcacaagtgtgatgcatatagaatcgtaaagaatatctcatatgctacagctatagttctggcaataacatgcggaatgttaacaggagcaatgatttgctctttaaggagtaacatttcaagcttgagattatccacagccttcagtttcgctgcttttttgatatgttcactaacattatgtctatatgcattcttgatgaacgaagcatttggaataatcaatagtgttggatattatccagttccacaaccaagcgtctcatttgctatagctttgggaggtatatttctattgttggtagcttttattgcatatgctcaaagatatagaaagttaagagctgaaaaagattttgaggaggatacttggtatgaatatcaaaatcttaaaaacgagtattatggatacaatgcaatgaatgactactag

SEQ ID NO: 2697 - DNA, 1671 bp, Cryptosporidium hominis
atgtcaaatcagaatccaagtaagaaggatgaaacaacaaaaactcgttatcatggattggggttgtcaaaccaaggaagaggggtaataaagagtcaatcaatagcttttcagaattcaaaatggtcaaatattaattcaaagtcaaaggaaattggaattgactcaaatgtagcaccaggaatgacaacggtgtatgttgggaagattccagctcaagtcacaaatacacacattcgaaagttactaagtgaatgcggcacgattttgagatggagccgtcaggaggatccaacaacaaagaagctttcatcttttggtttatgtgagtttgattctccagaaggtgtcataaatgcagttaatgctttgaatggaataaagatttcaggcggacagttgttagtaaagtaccaacatggaattgacaaagaaatagcaaaatggcaaagtaatcgaattaatgagttgctgaagcatagagggggagattgcacaattgaaacgatacttaatgaactttcagcttcagattcaaaactgagaatatcaattcagcgtttattggcagggatgacatttgaattgaattcagaacaagaacaaacatctacagagcatggcgataataaaagttcaaacaatgatgatcaagaaagaaataacaagagaatttcatattcaaatttagatgactcagggataagttcacaaatgcacaagagcggagtactaattgggttcccacaaaacccaaaggagaaattaagaatgaaaagatttgaggaaaaaaataaaaagtttgagaaaaagttacaagaattagatgatgaactatatgaacttgttaagttatttccagaaaagatggacatttctaatgatttaacatttagatatttgcttgataccttacaagaatcttatcataattttaagttcatatcatcctccaataagaaaacttttgatatgatttctgagattattcaatctgataaagaattgattcagtcaaagcaactggattattctcattctgattataatattgattcagaaatttatgatcatgaaagcaatgctaactcaaagtccagggctgagtctatttcatttagccccaatcaacctcacaaatactttgaaaacattcttagtcccaataaatttactaaaaaagaagcaaataatactctaaatactggaactcaaaacaacagtgttttcaacaatactaatatggaaaggatttctattaatttacccaaatttcagaaacaccaatttgaaaatcctattgaaagtcttgaaaatattaataatattgatggaagtaataacaactcgtcgtcgagttcctctattaatctgatgaaagatattaatcatttagttaatagcaaagaagaggtattttctgcagaaaattggaaaaatatattaaaatcagtccaatttgagaattataaagaatatgttgaattggaaatgaaacgtattattggtgaatctgatcaaaatgctttaaatactattactaattttatcattgaaaaattctcttcaaaaaatttgattcaagaaactattaatattttgattcaaattcttgacactgaagctgagtcatttctacgtgggcttttcctcaaaattcttgatagttaa

SEQ ID NO: 2698 - DNA, 612 bp, Cryptosporidium hominis
atgcttcagcaattacttatggactttgaatacattattccaatctttgtaatttatagaatttttgaggttcattcagaagattgtaagtctataactgattctaatggacaaacaagaactgctgtaggaattaagacaatctttaaagtattgttttcattagaattcagagaatcaccgcaatcaatcaattggttttggaatattttagatctgaatgagacaggatatattgaccaatcagtaattagctgtttctggaagagtatggttgcaagtatcgaacaaatctattcaattgaatctttacctctttttgaacatataagtgatgagatttttgatatgatttgtcctggagaattcaatggtaaaatttacaagaaggcttttaaagattctcctatggcttcaacagtaatttcctatctttgtgacccaaaagctttcattgcaattgaaatgagagaggaaattatcgctcaaaatgcttcaagaagtttagaaggcaatcaaaccagtcttgatctcgaaaaacccccatataacgactctgagtcaaattcagatacaatagattgctctcaagaatctattagtgatacttag

SEQ ID NO: 2699 - DNA, 240 bp, Cryptosporidium hominis
atgttagtactaacacatttaatgcaattcgaattagcaattacgaaaccaattttagaccgagtaatcctcaacccagcgttaatgttaggattgcaaatttttctcaagttaataatttacctcataaaatgggtcaagcacaacaaatttctactgcaagacagtttaataactattcctctgatccaagacaaaatccccagtacccaaatttcgctccctctacatttaggtaag

SEQ ID NO: 2700 - DNA, 390 bp, Cryptosporidium hominis
atggagaaaatggatattccaatttccgaattggaatcaaagataccaaagttgttggaagaattccaaaatagactgttatttaaggccaaacaacgacagaatgaatctatcgtaagagttgatacatttgacaaagttatggatacattgaaccaaaagaagatggttatagctccttggtgtgaggatgtatcatgcgaggaagaaattaaaaaggaaactgcaagacttagtttggataatgaagacaatcagtccatgaccggtgcaatgaaatccttgtgtatacctaatgatcaaatgtttaaaatagaagaaggaaaaacgaagtgtttcttctgtgataaacttgcaaagaaatttacactatttggaagaagttactaa

SEQ ID NO: 2701 - DNA, 1464 bp, Cryptosporidium hominis
atgattgctcacaatatttgctattctacactaattcctccacttaatcttaaaaatgtaccagaagatttaagaaagacttctccaactggtcattcttttgtattatcttcagtcagaaaaggtattcttccattaattgttgaagagcttatagctgcaagaaagaaggccaaaaaagaaatggaggaagcaactgatccaacattaatctctattttaaatggtagacaacttgctttaaagacttcggcaaatagtgtttatggatatactggtgcagtggctggaggccaacttccatgcttagaactttcaacaagtattacttcatatggtagagcaatgattgatattaccaaaaatgaggttgaaaagatatatagaaaagaaaatggttattctgctgatgccaaagttgtttatggtgacacagattctgtaatgattcagtttggagtatcagatattggagaagcaatgaaacttggtttggaagctgcaacttcaataagtaagctctttgtaaaaccaattaaattagaatttgaaaaagtatattgcccattcttattgatgaataaaaaaagatatgctggagtactttttaagaatccacaattccatgagagaattgattgtaagggaattgagactgttagaagagataactgtcttcttgtacaaaaagtggttgatactgtcttaaagaagattctagttgataaagatgttgaagcagccaaacaatataccagaagtgtaatttcagacttactcaagaataaaatagacttgtctttgttggtagttagtaagagtcttggaaaagatgattatactgcaaagctcgctcatgttgagttagcaaaaagacttaaatcaagagacccaggatctgcaccaaatattggagacagagtctcttatgtagtaattaaaggtgctaaaggtcagcctcaatatgatcgggctgaagatccattatatgtactcgaaaataatctcgcaattgatacacaacattatgtagatacattaaaatcttcagtaattcgagtttttgaaggagtcatgaaggatcctgaaaaactcttttcaggaagccatacaagatctgtaactgttttgagtgttacaggaggcgctctagcaggatttgtaaagaagggtcttcagtgtatgaattgtaaaacaattataaaggaaggtccactttgtaaagattgttccaaacaagaaaatatggaatgttcggtacttattaataaacttcatgaattcagagaaaaagaaattgaatataattcactctggactcagtgccaaaggtgccaaggaagtgctttccaagatattatttgtacttcaagagattgccctatattctataggagaaccaaagttagaaaggatgtgaattctattggggagcaaatcaaaaggcttgatcttaattggtag

SEQ ID NO: 2702 - DNA, 2973 bp, Cryptosporidium hominis
atggaagatgaatcagaatttcaagaagctcataagagtagtttagagtcggaattaagatggtataaggagaattttgtacaaataaaaaatgatttactctctaaattgaataaaggcagaagttcgaactcagaaatatcatgtgtgctgcaaaatgaaacaaacaatatcggtaaaatctttttcggaaaacctatcagagacttttcctcgttttccaatgtaattcgaaatgtttcaaaaaaaattaccttcaatagtgatagctatgcatgcacacacacgcatgcaaacaccggtattgaaaatacatacgtggcagaaatttcggataatcatgtggacaacataattagcaatagcaaaaaagttgaagagttgtgtaaggaagagaatgaagatgaagttatagaattgaaagtattgggatatggaggaagggaagtagaagagagtgtatcaagctcatcttctagtaaggagaatttatatacaattttgaatatccagccaaattctgacttttcaaccgttaaaacaaagtccagaaagaatacaacaaagaaaagctcttcaaacgagaaaaagttattgaattgcaggagaaaagttcaggtcaatgagaaggaccaaaattgggaaagagaagactttgaatggtcagaggatatgaaaagaatcaatgagcaagtttttggcaatgaatcatttaggtcaaatcaaagacagataatgaatgcagtggtttctcaaagggacgtttttgttatgatgccaacaggaggcggaaagtcgctttgtttccagcttcctggccttttaaaatataataaccctgcaagtgtgacggtggttatcatgcccttagttgcacttatggttgaccaaattgaacagttgaatatactcggcattaaatgtgcaagtttgaatagtaatcagtctgcagatgagttgaatcatattacatccttactgaagaagggagatcctgaaacatgtcctgcctttctatttgtaactcccgaaaaacttaagcactcaaagactttgttttccctattaaagcaaattaatgatgaatcaagactattaagatttgcaattgatgaggcgcattgtgtttgtcaatggggatttgacttcagacctgactatattcaactttgtaaactcagagaagagttcccaaatgtcccgataatagcattaactgccactgccactcatagtattttgagtgatgtaattaaacaactaaagatgcgatctcctactatctttagtctttcttttgacagaccaaatctaaaatatgaggtaagagctaaaagtggaagtaaaaaaaagatgctcaatgagatctgtgagctgcttagatctccacggttttgtagatcaacaagtattatctactgtttaagcagaaatgagtgtgaagaagtctccaaagatttgaacaaggaaggaatttctgcaacatattaccatggatccatgaaagaagataagcggaatctggcacaaagaagatggatgaatgatgaaaagcaggtcatggtagcaaccatagcatttggaatgggaataaataaaaaagatgttagacttgtaattcatctatccatgccaaaatcccttgaaaactattaccaagaaagtggtagagccggaagagatggactagagtcaaaatgtatattatattactcttacaaagatgtctctagattacaaactttagcaggagttaacattgaaaaaccttccaaaaagtattatacctccaagaataactcctcaaataacaaatccacaattgatggacttttaggcatggtgaaatattgtgaagaacaatataaatgcagaagaacaatgattctaagccattttggagaggattttaaaggaaaatgtaaggttaaatgcgataattgtatgagatctgaactagaaaagccgactaacattaatgtggagggtcttgctcgtcaaatctttcactcagtaagaatgagccttcaagaacaggcaagagctacaaaaacctatggatttttaactctatctagcttagcagaaatcttaaaaggaaagaaaaagaaagataagcaatcaaaaggctcccttaaagactgtattggtcttcttaatgatacaaatatttggaagccaggaaatctgcaaagattcctacatttgtttattattaatcagcttttttctgagaatttggttcaactcaaaaatggagtatcagttgcttctcttaaaattgataaacaagcagaaaatcaagatatctatgaactcgacttttcttgtttcaaagccttacagttagagtccatctactctactccaattccagaatcaaataatgtgaatttgggccataatattaactcatctctttccttgtattcttttaactcgaaacaatcctcttcagatattaattttgctaataatgactcaatgtctaactctaacaacatagagaacttgactcacgataagaatctcaaggaatccagaagaaaaagacaattcattgataaaggatctccccattcaatagttaagaagaagcaggcaaatttgatgtatcaagaatctaacagtgaaaatgaacagcttaaagattttagaaatcaattactttcactaagaagaaacttagctgcagagtttggaatctctaataccaactctattgcatcaaaggaagctatcgacgctcttgttgagaatctcccgctttcattgaatgctcttaaagcacttcctggatggggcgcaaggcaaaaacttgaaagatttggtctcagattcatctcaaaggtcagagattttgttgattccaagtcaaccaatatgttttataccgaaaagaattatacttgtccaattgaccttattaatcctgaagatctggacaaagaactagatcttatttggcaataa

SEQ ID NO: 2703 - DNA, 1005 bp, Cryptosporidium hominis
atggagatttctgacaaaatagcttttgatggctataaacataacaatttagttttacaaaagctcaaaaataataaggaaagaaaagtcacagaaagctcacaaaaatgcagtgaaaggattgaaaataagcttggaaatatattcagggaaattagcttgagaaatgaatccaatgcttataaaataacaatgagtagtgaaatacaaagaattacaaacatgaacaaacttgatgcttattacaaattgttagtactttcttactcaaagatgtttcttgctttcataagtcttaagaatgattgtgagttggaggatgtccactttcatacacttgaactaaggaaattaaactatattttcaagaattgtactcattttaggattagttgtaaacttttcgaaggaaaaagtgactccaatcttgttaaaaaaacaaataatatgttgaaggaaatatcaatcttaaagaaagaaaagccttctcaaaaagataaattagatttattaaacaaaatagattcactgaacagctcagcaaataatcttaagacaaaaattaaacattatttctcgaataatatccaagaagaaattaatgtttgtaaaaatactcaagtaaacgaggagccaattttattaataaactcagaatcaaacactgatctttgcacttctgattcaagctgtttagaagtttctaatgatgagaactcctccaatagtgaagaggagactaatttacttaacacaaataaagatcgaatagagcttgagaccaaagataaatacaattttagacatcgaagatcaatagaaaccattttattcagaggaaaaaagcttgagaattaccctttagtagagttctctccagctccaaaatatcatagtagatctaaaacacaaaataccagcttcttagaacatggacaatccatcaacaaactatgtgtatctttcaatggaatcttgttgaataaacaacccattgatccctaa

SEQ ID NO: 2704 - DNA, 1251 bp, Cryptosporidium hominis
atgtctgaaaagaatattataccgtttcaggaggaagagacgaataatgaaaaaaagttgggagtttatgaaaaacaggatttgagtgaaaggaggaaagagctttggataatttcaaaaagtcttggggcaattacattggtatctgcagtaatgaatctggttttagttgggataatgatatttatggtaaacagcctaattaaaggcataatatcagaacattccaggcaaatagcaattcaaaaggggatgttatcaaactttattgaaaggaattcaagaatagaaaaaagtgttcacaatgaaaggatgaattttaacgatcattggaggaaaggagctggaatacttccattaaatatgctttacaatgcaccattaaaaagcctagagaatgtagatgctatcatactagagtttgatgaaccagaacaaatcgaatctggaaatcaagaaaaaaaaattaaaggaaaaaggcaccaacatatgtatcatgttgaatccattacaagagaagtttcagtagaagagatggaaggaggaaaacctcgaaaaaaggaggaagctgtattaaagtttaacttgaccaatgaaggtacactcactgtttataaggataaagctattttaagagataggttaggaaacaaagtgcatgaacttttctttgaatcagaaaatcaaaatcatgaatatcaaagcaaagaaacggaaaaattgcttagatccgactcaaaagacgaggaaaatgaaaaacaaggacaaatacaacctaataatagaaagcttatatcttctaattcacacaagcactcagcatcccattctttgaaaactcaaagtggttatatggcagctgtatgtaaatatggatgcggagaaatgggagtaacctacccctattactatcgccccttctttggatatggatttcctttactaggtactgaaccgtatttccaaagtggatacggaggtaatgttgaaactgccatgaataataatatgttcaaccctgaatcagctggccctcgtcctccaggagtacaagcaactccacaaacttcaccatttgcaatgggtgaaaatccatatagttatccatactcatctagcccaggaggaggatactattattactataacttctaccctccacctcccccaatgcaaccagaaccattcccatattacgaagaaagctattacaatattcctcaaaataacacagaagaagaagaagaataa

SEQ ID NO: 2705 - DNA, 288 bp, Cryptosporidium hominis
atggagggagaaaaggagaacagttctattcaagctattgaaaaacttcaactactccaaagagttgtagaatcacagaaaatgatggcaaagttgacttctaggtgttataagaagtgtgttgtgggaggatcgagaggtggaggaaagagtttaacgaggaaagagaaactttgtttgtggaactgtgcccagaactttcttgagagttcggaattcgttgcttcaagaatcacaatggtagaagatacgtctttatccaatcaaaaggactcggagaagttttaa

SEQ ID NO: 2706 - DNA, 5274 bp, Cryptosporidium hominis
atgagacttcataatagaagttcagaactcagattaattattgctcctttagctttagctttagtaccagttggagaagttaaaaagattatttctgaaaaagttggtgaaattaagatttcacttgattctggtgatttaaaaacaattcttcaagccattattacatgtaatgaacttgctgttactccagaaggatgcaaatttacaatttctgaaggtattccagctttaattccaagaattgaagaattagcaagttcaaagattaattcttctgaacatggaattgtagctcaaaatatattatcagcttgttctacactttgctctttattaactgcttctagaccaggaaaagttgcaatagttaagaacaatgttactgtttctcttttaaatatgtacagaaatcttgcaaattgttcattaaatgaagaagttgaaacaggattagttgacaatttagtagctattgctaatattgtcaaatttgatgttaaggcagctgagacttgttttgaaaatggagcagtacaactaatttgtactagtttagataacttccaagataatgagaagattttaggatcagcttgttctgctatagcatcaatggcaacttcaccaaaaagagttgaaatattattagctgaaccatcctttaataatttactaaccaggcttgttaatactgttaatgagagttcaaaagctgaggttagaattaaatgtttgaatgctattaatgacttaatcagtagtcatgatacttctataatccaaattactactgatgttggtagtattgttgcagcatttggagttgttgataaatatccatcagaatcttctcaaattagagcagcttgtagagttttgaattcaattggtaattatgttgatattagagcatactttgaacaagatcttcatagatgtgtagaagtagttctaagagctttagatgctcaaaagaataatgaagaagttgttgaagatttattaattcttcttaataatttgaccaattcaatggataataccattttaagagaatgtgcaataatagaacttatgcagaatgtaatgatggtacataatgataatcctgcagtaatatcaaaatgtggtgaagttttatcaaaatgtggagctgatgaaactattaagagtcttatggtgagtataattaatactcaacaagaaaatggaccagattgtgcaagagatcttgatcaattatgtcgtcaacttgcagtatttgtagcatctcaaccagagaatccagaagatgcacttcaatatactgaagcttgtttacaatctttagtagcagcagcagcagaatatccaacagatattagattattatcttcaattgcagtattaacacaaagaattactgatagagcttttgataattctgaagattcctttggatcttgggcagtagcaacatcaggaatgatgcaacatatcgaagataatttagaagatacttctggtaaagcagtatcttcaaagagatatgtatgttctggaattagagttcttagtggttgtttaaacaatccatatacaagaaactatgttcttgagagatgtaataatggtactttcttacctcatattggagagatcttggaaaaatatcagagtgattcagatgtagcagctgagacttatgaatttatgagaattttagcagaagatccaacaggagctcaatatgttgctcaaactccaatgggagatatttcaacgattatttcaacaattaagaaacatcgtaagaacgatactgttgctgtagaaggaatgaaactcattggtaatcttgtaattaatgctggagcagattcttcttatatatgttcagtaaatggacttaatgaacttcagggacttactgaaggatcaaacaaagctgatattagagatgcagctctttgtgatcttatgacaaaactgatttctgctggatgtcaatttgaagataagtcattagtatcacgtcaaattaggagatgcagagcttatgatgatgatcaatcattagctgaagcaagacgtgaaggagtagcagtagcaatttcaagattgatagcttcagcttcagaatcatctgaaaatggtaagatccaaggtatagattctccagctgaaatcttatcaatgattcaaacttacccaacatctccagatgttgttcgtgaggcaacaaaagctttaactccaatgcttaaagtaaatgaaaatgcagcttctttaacttataactcagtactcccaattcttgcaacttctgcattaccagtagtaacagctgatccatatgcagctgatgcagttgctgatttaatgcttaatctcgctcagattcaaggaatgggtgtagagatgtcccaaaatcaatgtactgatgatatacttaatgcaatttcacagcttggagattattatggtgatgaatttggacaagctttgaaggcaaaggttgaagagattacaaataccatggcttctgatataccagcagaactttcactcaaggttgtatatgatatgctcaaacgtagagaagctgaaggactttctctaagtattacagagtcaacagctgtagctgagaagttggaatatcttgttcaaacaatgtctcagcttgttactcaaaaaatggatggaccaacttccattgattttaaatttggatgtatggctgctcaagtaatatcaagtattcctgaagatgttgaatatttggttgataaccaatggccaaaaactatgttattgaatattcaaaatcaagattgtgatacaaaacaagccattgcaagtggtctcattgatattgcaaagtctgataaagcagcaattcaatgtgcaacagcaccagggactgctcagatatgttgcgattttgttcaggaaatccacgcaagttcaatggatgaagcaaaaaaagaagaattattgattgtacgcatccaactggttgagaaaattgctgttagcagacaactcttcgtagggacctcaatgcttgatatattgctttcaatttgggaagcctatgataataaaaagtattctttaaatatcttgagacatgtatttagagctttaagaagaattgtatctgatgactttgttaccactttattgaatgcgaatgtattaaagagattgattgcaatcattaaagcaaagaatgatattggagttcttccagatgttttgtatttattgggttctcttgcaattattccaaatattaaatcagaaattggagagaatggtggtattgattcaatatgtgagttacttagagcttcaatcaagatgccaccagaacagatttctccaacagtaacaaatggttgtttggctttagcaaatttaacaattcaacataccaataataaacaaatctttaccaaatcaaaaggtccagaaattatcaaatctttgtttaattcttacattggctattgggatgtaataaattctttgggtgttttgattgtaaatcttggatacaaaaaagacgaaacaaagaaagaacttggatcttctggtatccctgcattaattgttcaattcttaaactcttataatggagagcaagaaagaatcgcaacaagagcttttatgtcagtattaaaagctgtagcaaatatgtgtctatacactccaaatatcgcagtcttcgcttccagtcatatagagaaagttttcaatcacttattagaagtttcttccaacttaccaaaagaaacaattttgatggaattacgtactttatgtaatattgcatctgagaatgaggcaagtcaattagcttcatttaatattttaattcaaccattgttgaatttagtattaaacgctccaggagatgattcagacatcaagagattatgtttcgatgttctttcaatgctttgtagaagtccaagtaatgcaggagacttctttaaagcaaatggaactgatatagtaattaaacaattactaaagaacgattatgatacgggattaatgacttctgctattcatcttttatcatatcagacttcagttcctgagcaaatggattacttggtttctgctggtatatatagagttattattagcattgttgaaggtaaagaaggaagttcagatcttaagatcgcagctttcagactccttcgtcgttgtatgtcggatccaagcaatgctttagacttccttagtattggtggagcacagtcaatttgtgaatctataaagaatagctcagatcagactcttgtacttgtagaagctattcgtgttttgcttggacttctttattcaggaagcccagactcagaatatagtgcagctgatgcaccaaaaggataccaagtttgccagttggatgtaaatgattgcaatgcaattgtaaaatctgtgaatcatgcaattcacaaggaggagaatggaagacatcttcgtttaatgagagctggatttggtattatggcttatttactttctgagaacttatgtattgaatcaatagcaagcagtgaaactgtgaatgtaatgagcaaagtaatgacaatttttgcttctgatatggattctactgctttgatatgtcagtatgtttcattcttgagcaaattcgcgttagatttagttccaggaatagtaaatgatgactttagaaatgctttagaaaattcagcttctaaagcaaaaggagcaagaaaggacttcgtcacaagtgtaagcacagccataatgtctggtgattactcagctttatcagttctttgtggtgaatttgatttcgatattactcattggaatgttgagccttatccaaatggtgtacaagatttgccaaaggagaccaaagacttcttgagaaacggtggaaaacttaagatagttttggatggaaagtcaagagatgagtttacatggagagcttctcaagacttgtacaaacttgaatggaagattggtactaaagataatgatttcaataactccttgcctattggaaagattaggaacatttggaaaggtctccaaagtacggttttgaaggctgcaaatatggtagaaccaagaaagattactggacctacctgcttcgtagtagttgggccaccatcagaagaccagccacagggtatggaactttcattaaaagcaaaatcaaagagtgaaagagatggaattattgagaactttgtcatgtggagagaagccgcaacataccattga

SEQ ID NO: 2707 - DNA, 996 bp, Cryptosporidium hominis
atgttgctgttttcactcagatcccttagtgatttatgtgtacctccaacattgctatacaaggaaaactccttggatgcaatgcaaagaggtatattagaaattatgagtgaagcattacaacaattccctgatgatgaagatatttcaacaaattgtgttagaattatgtttggtatttccgagtttatgaaagaatcacaagatgctgagttaactaatatgtttatttcaagaggaggatccaatactgtcgcaatggctgttaatggtcttgttgaatcaaatgattccgccatattagcttctatctgtgccacaatcgaaaatctattttgtattggtgctcttgattctacaactgctgcaagttgccttggtaaattctatgaaagtaaatatcttggaagttctgaacttgttaaagttactggtgcaatttgtgctattgctcaccaagaaagtggaattgctgcattagttcaagcaggaattggatcaaaaactcttaattttgctcataactggaccaaatctgataatgaatctgctgcattaatagaaaattgtcttgaaattgttagattatgtgctagttatggtgatgtaccggaagatgcacttaaagctgttgtacatattattgatttatatcgtagtagaagaggtatcacagaaaaaggaggtgcctgtttggaattattaatgaatccacaaaaacttatggaatgtttagttgttattaaatccccaaattctgatattactcaaaaagatgattctttgacaatgctttcagctatggcttatgtctcatcatttgctgatgaaattgttagacaaggaggtatttctatggttgttgaagcacttaaccaaggtgttagtgaatattctcaaagtggaaatgaagaacatacttccaaatctagtcgtattattattggatcattacgtgtttcttgccagagttgcttcaaatccttcaaatgttga

SEQ ID NO: 2708 - DNA, 2178 bp, Cryptosporidium hominis
atgtatagacttgtattactttttagtttattctccctcttgtcaaggaaggtattgtcacaagataatggcttcatatgccaatgttactgttctgtttctcaatatatttttgagaatggaaaaatgagcttggattctgtggaatattttgctgatattaagccaatttctttaaatcaggaaggaaaagatggtatcttagacttttctgatagtcagccaaaattgagatcattaaatggtgcagtttctgaatacagaacgggtacaattgcgctatggaactcaggctttgacttgaaatctatttcttcagtagataaaccaattggagatcattcaatggttgatttaatttcatcgtttgatgagatctttttgaatgttaaccgcattccaaagtctgcaatggccattgacaataatactccagctgttttaatatttaagaacaaagaaggagaaagcactttcaatgatgaggaatatcgtcaaagatactgtgagaatgcttgccagagaccaatttcaaatttgaagaaatactcttattccaagacagagtttgttgaattatcatacagaggaaatatcttcaaccaatatccagctaaagactccagccactattcaggcttaagcgagtcaattaagacgaactctggtaaaggaaaatgtgaggcagttgcttcctcaatgtcaggtactgaaacagcttggcatttaatatttgaaaacatcagaaaggaaaagactgagcagcttcttaaagagaaattcgttcagatctatccagttgttgccagaagtgtttcttctcctgttgcaattgaactcacagcctcttctaaggcagacttctcaaacactgcctcagcaagagttaaagcctttgagagatttatgaagaaaaagtacgaagttaacttctttgacttaccagaaaatatgccaaccactcttgagcaacagatctctccattattccaatttagagctaagttgtacttcgagggtaatacatggaaggtcgatgaaatttattctggctctgagactttatctcaggattattcttatgaattcttgaatcttctcctttctaaggaagagacagacagtttggttgcttcacaaaaagaagctattgaagcatgggcagaaaaattctggaattcaggtcatgctgagactcatgtagttttaccagccccattggaatcacttgaggagatttcaagaaaagataataagctcaaggatttggaaagatggatcaaggcaaaggaacgccaggtcagatttgctactggtgatattccaatttcccttttacaatttggagaaaagaagtctggaattcagtcttcattgaaatcctccgagctctctatttctacagaggaagcaaatatgaatgaaagcgcaccagagagtgatcattatgaaattgaagagtcaccttctccaattaagcaaggagaagagctccatttaatttactatggtttactcactttaaactgtttcactcaccaaactcaaggtgaatcagaagagagtttccatcactctaacatggtagcattcaatattttcccagactccttattaagaagaaatggtgataattcatttatgagaatccaaataccaaagaatgagaagagatggagaactattggtggagtattcgacagcgaaaattcaattaacaacttgattaggaactcttcttacagcttcgtcttacaactcgcaaagcacaatcctcaattatatttaattttattcagagacttgaagcatattttcggctttggtaacccaaagattttctcattaaacacttgccctgttccagttgctaaacatcatgttgagatcatttctgaaaatgaaaataccttacaaaaatccattaacaaggtcttattctcagatccattccacaacatctccacaacaaagatcaagttttctgatgtaaaccatttcaactcccttgttaacacaatgtcaaagtgcttaggtgttgtacctccaactgccagaattagagtgaacgatcactttaaacatccacgctctgttattagtgactatgtttgcgctattgatggagaaaaccaagattatttactccagttatattccaagtacaatattaactaa

SEQ ID NO: 2709 - DNA, 1491 bp, Cryptosporidium hominis
atgatggaaatagccaagtatagagggactagagattccattaagatcgagagcccaaaagagaaattgggaattaaaagtggagaatatatggggagtatagatggagagtttgatgaattaaatcatgagatttatgaattcattcaccaatgtttaaacactgacgattcagatctgttatttccaacttttgaggaacagttacaaagtacttgtattagcaatggtagtgaaacagttaaaactgatggcacatatatggatgtaaatcctcttcaaggagatagagagtcctttagatttgggtttgagaacgaaaataattctcagtatgtgaatattaaacaagaatgtatgaatacaacaagtaataatgttgggggattttctatgtcacttgaaaacacttttgatttcaatggaatattactaaaagcttcatttcttggaaagactgacattattaaatcatgtttagataatggagctaacgccttacataccgataaggttggacgtactgcattacattatgcatcagcttgtggatggcttccaacaatgaagctgcttctcaagtacaattgcgatataaatcgtagagatcacaaaaattggacagctctccatattggagtttcaaagaaattcccagaagttgtggaattattactttcttctggagcagatttaagttcgggactcccacatacatgtgcaccatgtagggggggaccaatttctagtaaagctattcattttgctgcaattagaggtaatcgtatgatcacggagatacttttaaagtatggggctgatattaatgatgtagatgaagataataagactcctttacattatgcaagcttcagaccaaatttagattacgccaaatgggtaattgagaaaggagctgatgtaaatgcaaaggataaatacgggaggactcctctccatatagcatccttgtctggtaatcttgaaattacgaagatacttatagaaaatggatctgaagtccgagctagggatatctgggatatgtctcctttaagccttgcattaactagagaacatcctgaaatggtttcttatttggagtcaatttctggcgaaaagtcatctgaaatctctgttattagaggatttgaattagatacaatggaatctatagtattaaatactatagttactggattacaagaaccaaaaaaagaattcattgctagagtgattaagactattgggccacaaagaagcctacaactttacgaaaacaccatgaaggttgagaattctggcgggctcttgacagcggacatgtcaaggagaaaaactattggaggagtcttctgctacctccttaaacaacttgttgctgaagatcaaattactattcaggaatggaattatattcgacaagaagagaaggaaagaattaacgctaagaacattctaaaacgtaataatagacgatgtcaggtctag

SEQ ID NO: 2710 - DNA, 642 bp, Cryptosporidium hominis
atgagtatttcgaatagaattcctgaaatacagccaatttatgaaagaaaccaggaagccacactgtattgtgggaatttagaaaacaaagtagatgaagaaatgctagcggagctattttcacagtgtgggcctgtaaaatcagttcatattccaagagataaagtaacaggacatcattcagggttcggttttattgagtttgaatttgtttctgatgttgagtatgcacaaaaggtaatgaactcaataaagctatttactaaacaaatcaggtgctgcaaagcttcaaacgacaggaagccgctggatattggggcaaatttatatgttggaaacttatctccggaaatagatgaaaaattcctcttttatctgttttctaattttggcaagatcttgtcactaaagattgtaggcaatgatcaaagcagtcaaagccctaaaaatagcgcttttataaacttttcgtcatttcaggagtctgattccgccattcaagctctaaatggccagttcttctgcaaccaacaaatctcagtttcttatgcatttaaacaaaattctaaaaacgaaaaacatggaaactacgctgaaagactattggaatccaagtcaaagactaaacccatacaagaatga

SEQ ID NO: 2711 - DNA, 2880 bp, Cryptosporidium hominis
atgagaagattattcttccagtttgttatcttcttctgtgtggtagctgttagtttgtttggtgtgagtaatagtcagccaatttcagacaaacaacattataagctatttgagattgatcatgaaggtaatattaagatacctattgaatccattgaaaaaattagaaaaattgaatctccagtttcatttgttttatcattaggtctggctagatctggaaaaacaactttggttagcttgatttcaggagagtcaccatcctttgaagatgtaaatgagaaggaatctgatggagttagatgggtccaaactaatggagatggatccatatttgctaattctccaaaaaataatgattatattcttttggatactgagtctttagtaattgggagggggatcaactcgtcaattaaattagcaatactggctcttattctttcagatcatgtcttagttaattcaattaatgagatagatatcctgcttattgacttcacaaggcttttaatcagcaaagcagtgatgttttctagcttatttgtaagaaaactcaatgagtcgagtatcccgaataaaaagagcttaaagaaaaacctcatttttttggttgagaatcttcataaaacaaatatttcttggattctgcacaggaatcttgatttaaaggatgaacaagaaccagcaaagttttctagaaagtataaagacttgctcaagtctaaattagaaaagtatatttggccagaaacatcccaaagtaagatatttaaaaaccttgattcatttattgaaagattcaatttttataaaattccatacttcggaactgaaaaaaaatataatgggtaccggtaccacaataaaattgatgatcttgatcttgatcaagatcaagatcatcaatttgggaaaggaaacaatagatccatatttttagatatctttaagcctagctcaggtgaggaacatagattaactggagcagaaattgcagatttactggaactattttctgaacattcgtatattttcaattcatttaaatctttgaactttgggattacaaaaggcgatctcaaaacaagtaacttggttgagaacacattacttatttttggtactaggttagaaaaccaacttttgaatgagaatatatatcctttactggagatagaggctgatgcaatatataacaaaactttgaaagatatcgaatcatattggtcatccatttcggagtttgactattttgactttagtagcttgctaaagagtgtccaacctcactttgagaagcagtataagtctattttaagtaaaaattgtgaacgaataagatctcactgtagtgatgtaattgatatccatatttctcatgcaacccaccagattgaccagttccatgagaagattccaattccgcaatctatgctgatagaatttaccaataacttggtagctagtacgctgaatgatatagaaatggccttaaataaatcttttggaagttttgagtctgatataagttcctatagaaatagtccttgttgtaatattgatgggtcattaacccaagaaaagattgaatcagctctttcaaaacttaaaaagaggaaccaggaagagattgagaagattttactggatgacttcgaacaagctttgaatgtgattagatctctagaagaagtggacgattcttattataaagttagcaaggaagactttgaaaagaagttggagaaaatgaagaattcgtccaaacttgtctttaatacccatattaccataattaatgagactgatcttcattcaaaatactggaagaggcttaactcagaactggatgaatttattgaaagaaaaatggtagactggaagaaagtttgtagaaagtactcatacaactttgctaaatccattgcaattagaaaaaacatctcaataagaaataaattgacccttcccatagttgattctgtcattttagaatctttcgaagatttaaaggataacgtcattaaagagatgaatggtatatactgctcaaatgaggaatcctggaaagatgccttaatggagcttatgaacgtaatagaggatgataaagagcagttgatgaaggagaatttaatagctcttaagaacttactccatagacctctcaaatacgctctcaaaaatgcaatagaaattgccaaacaacattataattggatgaactttgtaagagaagccacaattttagctcaaaactctcttgaagactctgataattggggctccattaatttagacagcaaaactaaagatagagtcgttgagctttggatagaaatggacctttctgggattcgaaaaggattcgtaaggaaccagattttcatgattgtgcgatatttactttattcacttatattcacaataattacttttattaccctctttaaaaataactccaagctagtattaggagtagtatttctatcatttattgcttcagtactgctattttcttcaatcgagcttggagttgctggcgaaaccatctcacatcacctgtcagacctttttgtatactttggcatttcaagattcactctttattacattaaacacaatattgcgcttatatttgctattttagtcgggctaacatgtgcaatagtctatattagtctaaactttaaaagtggtaaccccgactcgaattccgtgttaaaacccaattcatttcaagagaaacgggggccagagatttcacctaggcaaaaagtcaccaactcaaactcccccgctgcatcaccttctctgagagagaaacttaagaaccaaaataaatcctcaaatgcagtaaggacatttattttttag

SEQ ID NO: 2712 - DNA, 1947 bp, Cryptosporidium hominis
atgagctcggcaaatgctaagagctccatttcaagtggtcctgtaaaaagtgattccatcaatgatgatacgaggattgaggcagagctcgtacaaagagggaatttagttggggaggcatcactggaatggtctcttaattttctgactcgaaattgtgattttttaaatgaaagatcaatgtctccactttcaatttatgcagtccatgtatggacgggatcacagaattgtgaatttgctaataagctttcttttcaaggaaagataagaaatatgttgtttaagttgttaattcatcctgttcacgagttagtaaacaatttaaagactaatgcttattatattgcagctttgagttccaaaaaaccttttgattttgaacaaaatatgtcctcacatgggcttgagatccccttaatatcgggaaaatactttgatggagattttattctgaaccagatgaagtggatctacaagttgttccataataaagaggaggatgtaggaaagctgtcattagaactcgaagaagacgatgagttttttaatattacgttttcagatgatttaatagagtttagcaaggttttcagctcaaagttgatttttcattggctaactcaccatattctcacaaactttttgtataatcctaacggtcctatttctcttctaagcttcaacattctaattgaaaagctttcacccttcttttccaaatatacagagtgctcacaaattatgtactcggatattattgctttttttgactctgtttgtgggatttggagaaatatgaaggagaaaaatatcaacaacttgctttcagttgctaattgtttagaaaaatatacctcagagagcgaaaccttcatgaaatgtcttactgatgttgttttaaagcattcccttgatgagctacttgacaatctttctgagtttattattgcaataaatgacgcactttcatgtacaaatttacatgcaccactgcccagctcagcccgcccaaacacgtcatctatggaggataaaaaaaaaacaattccccctgacgtcgatcccaaggagccatttaattcaatttttgaggcaactgggtttgagcgagctgtgtcagtttgcagagagtttccagatttgttgagacccaaggcgaggtacagtgaaaaggtcgtcaagacgacgcaattagttttgaactactgtttaagaaataacttagcagaccttaagtatataagaaatatgggccacagaaaaaagatagatggggaaagctctagtgatacttcagattctcaaagcagcgctagctcctttgaggaattagacaacaaaagtttagaggaacagaatactgttttggatgagagtgaggcaatcagacaatatttagctggtggtacatcaaaaaatagtttgaatagttctagtaatgagagaagtagagttcttttagagaagagtagcttgaagaggaaaagcatttttaaggacgatgacctattagagtctgaaaggtcaaagaggttgaatttgtattcaaatgataaaggcaagactgggaggaagatttccgtaaggggaatttctgagagctcagactcatctgaagactttaccccaaagccaatagtttctgaaaagagaagaaacgatgagcagcaatctgttccaaaaagagtccccaataaaagagcttcatcaagtcccaatactggagtttcaagacaataccgtcgttggagtgatgaggagacaagcttgcttattgatggtgttaataagtttggattaggaaaatggagaatcatcctagctacctccaaattgaccaaccgtgatgaagtggggctcaaagatcgttggaggaatcttgtcaagggtggtcatgttacttgggatccccaaactaagatgtatcgctctgttaaaggatag

SEQ ID NO: 2713 - DNA, 1521 bp, Cryptosporidium hominis
atgtctcagagttcaacactttggaaccaatcctactctagggagttaataatggatcattcggaagggattgattggattagtggggatggtttcctggagaatattaaagattcacattttgtggattatagtgatccaaatcaagttaatatggaagatcctttgggaaataatttttatgattgtactgatcttgatgatagcttccataattacttgatgaagggtttactgggtgaaaatgttgaaggtggctcaggctctaataatttgaatgtttcctccgtgaacagcatcagaggtcaaagtaatgtcggtgttactattagtcacaacaatgatagcatttgccacaacattgaccacagaattgatagcgttggtattggagtgggatctcttgggggggaggttggaggagttttaggggtgggtttaggaggagtgggaggaggaatagagataggtttgggagtacaagtaggagaggtgagaaatcaaggggagaaggagtttgagaacataagctgcagttacacggggaactctcattcccatcaactggagccaccaaatgaagatcttgtagaagatcagagtaactgttacaggatatcagcaacttcaaacaatttgggtatttccagtaatcatggactgttattgggggtatcttcctctagcaaagccttgggagctacgccatcagctcaaatatcatcttctttgtcatcctcttcatcatcatcctcttcttcgttagcttcatcctcatcgtcatcgtcttcatcaccatcattaacattgaattcagggcttccaccaatatcactaccgccacgagctatacctcctataaacttatctcagagtttgatgactccaactacatctgcatcctcatcatcagttagcccaatttccttctctccaaattcaattcaatcaggcccaaagctgatgggatttgatcattcattctcaatggaaaacacacaaaagagagttcgaatagagccggaagaaaggattagaatgggtattttcgacgatagtttagtggaatctgatgtcaagtttacagatcaccagattgttgagttggattcgagtaaaggaagaaggtggagtaacaattcaacaacttcaacaatttcttcaaacttttcaataaatacaagtgatggcggatgtgttagccatattaatgatagcgtaaacaatgagaatcttggattaatgagccatgattttcagcaagacaagttttgcaatacagaagatttaggatctcagaagccgaaaatggcggaccaaagctatgaaatgggagtaattgaagacgagaactattcaatgggaggccaaatggagggggaattttttatgaactcggataactacttaactgaagaggaaaagctcaagttaaggaggcgaggaaggaggagaagaccaggtaagttaaatatttctaaacaattaacaaaagatctgactttttattgttttaaatag

SEQ ID NO: 2714 - DNA, 2400 bp, Cryptosporidium hominis
atggatgcggagcaggatggggaaattggggatgtagagagttttttaagctttgatagtgaatttgagaaaaatgagatggaagaggggattattggcaatgctgctgataaattgaacaaagtagcagtaggtttagatactactcgggaaggtcagaccgaagacaagcaagagatagtacgtagtacagaaggagtgagtaaaggaaaggctgatataaaagttaaaaagaggacaggaaaagaaaccaaaaaggaaactgaggcaaaaagagatgcagaagttgggattgaggggaaggagcaccaccatgtggctcgggaagctgttcatccaaaaggtgaagctaaagtaatgggtgagaagaagtctcaggagaaatccaaagcgtctggggttagttctttggggagatcgaaaagaaaaagcgaaggagaaagcgaggatggcgaaacaaccgcaagtagtaataatagtgaagagaagaaaaacccagaaagcggagctattgaggactcagataccttatctgacaaagctaagataaagacggaaaatgttcatatgaagaagcatattaaaacaattcaaactcctggacaggaatctaaggagggggaccaaacccaaaatactccatatgtttcagtcagtgcaaatgactcagctaacgctaataattcggctagtgctgatattaccggttctgtttcttcagtagttccgattatgaaggctgaaacagatttttatacaaaaaatagcaatgaaactttaaatataggagctgagagttctgggaaggttgctgacgctcccagtgaagcaacagccttaggagagggatacgtaggttctgaaaagaatatcacaacagaagcgactagccagggaccaaacactaatatcaagcaaaagtcactaaagaaagcagtgtcttcaagtagagataaaagcaaaagaaaatcaagcaggacggaggattctgctctaaaaaaggtttctagagaatcaaataaaggggagggcctggaatctcctaaatctgctcgtctaggatctagtagaggagatcatcccaagacgactaaacacagaaagcataagcaatacaaagatttgaaattgcattcaaaagaaatagaagattctgaagcacgtttcaaagacaggtaccgatgtttgaatgtaaatacaaatatttttgagtccctaagagttttagatccttattctaaccagacttgcctagcaaattcagagtttgatgatttgaatgccacgagaggtcgcacagaagaagatgataaagaacaaagaaaggagtctaagcagagcttggagcatttaaagaagatagaagcagaaaagaaaaagtgctctttttattctatttggcaggaatttaccaatcaagtgaataatatgtgtacccaattagaatataaaggcgattctagttcaaaaaaaccattaattgcggatctacagacatccattgccaacataaccagtaacttaaacaatactgctactacttctactacaacggtagcgtttaatattacagaaattacgactgaaaatatatctgggattagagaaaagaaagaaatcaactcctcttccactgaagagaaaccaaaaatattgaatcttgctggtactgaaaaaatggtggaagttccacaaaattattctactccaataaagtcagatggtgcagaaggtgagaggattaagataaattccaaaagtaaagtaagctggacaagagttcttcagaagattagaatattgaatattcctgatttgtatattcaagctactgctaaaaagatactcaagttcaatatatatatttacaggatatatacggataaatacaagagaaaaataattaaaagagttcagggaattctgagaaatttaaaaatagtaaataagtctcaaatgattaaagataggcacttcttgggagcttacacgatctttggatcactattaactgcattattactcctatctattgcaacatttcacgaaagacaatatgctgagaaatctgaagatatactggttgaggcagaaaccattaagaaacttggatttgtgggaggcaaaattaagatgataagcagccatctatcaaattcagatacaggaattgaaagagtggtattctctgatgatccaagctctatctgtcaaatgatcttgaaaagtaaatcaattgtagcccagaatcctagtaatattgattacactgaggagataaccgattctaaagacttaaattctattttgaacttaactactagattggaagagaataatgagattttactccatctctcaaatggattagctaaatgtgctcagtctcttacaatataa

SEQ ID NO: 2715 - DNA, 972 bp, Cryptosporidium hominis
atgaattctggaggtttgccggcaagctattcagctagaaaacgcaaaaatggtgcgtgttttctgctattcattatgactatgattgctttgctgtatgcttgttattttgtgattctattacagccattgtttgagatttactatataggagcatcagtatcagcagcattccatcttttttttgctttgtttttgatatctttctaccaatgtacaaatacagagccaggaagagttccagcaaaatggggatttagagttggagatgaatccaaaagaagaagatattgcaaagtctgtcaggtttggaaacctgatagaacccatcattgttcagaatgtggaaaatgtgttttgaatatggatcaccattgtccatggattaataattgtgttggattctataatcggaagttctttattcaacttttaatatatgctcaactttctcttttgtttttatttgttcaaggtacaatgtttctagttgagcaatatattactttatggccatataatcatggtactgatccaactccgcttggaagatctattgaagccataaagcttacatctattattgttatgttagtttttgttacaccactattacttgcattattccccttctcaagactacatattggctttattgttcgaaatttaaccaccattgaaagcttaagccctcaaagtcctgaatatgggagatatgatctagggcctgagagaaatatacaacaagcatttgggcataatcctatgcaatggttttgtccattcaacactaagtcatcaaggcctgttggagatggtgtaaggtggccagttaggtgccctgaagtagatgatcttgaaatgggacaaattccaatttatagccatcaaaatattaatgatagaaatacttatcatggccaccagaatctttctccctataataatagtggagtatatcatcaactatag

SEQ ID NO: 2716 - DNA, 2763 bp, Cryptosporidium hominis
atgaatgaactttttgaggagtatttgaagcttattgtaagcaagatagaaagaaaggatccggtttacaaagcacaatgtcaattgtcatttaaggattctttctctgaaggggggctttacgttaatttgaagaactttgaagcatatagtagggattttcttgaatgggaccataatcagagtggctgtaggctttacttgagtattaaaggcactaggaaatatcactcagaaaatattgataatcccacaaatttgtcaataggcaaagaggaaggatactttccagagaagtcattttttgaggacttattccaatacggtttggtatcttttccagatatggaagtgatggaattgacggatagccgggttcataaagaactttctgaaaagcttaattatataatccaatacgaccagaacatggaattaagcaaagatacggactctttagttgcctgggctgaagaaagaaaagtttcaaggcatgctgagaatctttttcaggtatcttcccctaagcaaatttctcctaaaggttggacatgtgagacttgtggagcaagtacaaatttatggttaaatttatcagatggatttattggatgtggaagaaggttatatggagttggaggtggttgctttgatggaaaggatgaaggagcggctctactccattatcaacaacatacagaaagacctttggcagttaagttgggaacaataactcagtttggaaatgcggatgtattttcctacgatccacaggaggatgatttggttctggatcctcatctagtaaaacatctttcagtatttggaataaatgttgggcaacttgaaaagactgaaaaaagtttaacagaaatgcaaattgagcagaataacaagttagatttgacaagtggaacagaatctgaagaatgtggtagttttttaccaatgaataaactatttaaaaaaggtgatttactaacaactcttgtaggacttgagaactctggtaactcttgttatgttaacgtagttttgcaacttcttgcatctattccagaagtaggagagcttttttcaatccattttcaagatttactggaaatttactcaaaatattttattcaaaaaacaaggccaagagaaagcattgtaattcagttttctaaagtaattaaggctttacttacaaatgatgtaattaatgatcgtaattataagatttcatctcgttctgaagatattcaaaaagctatttccgagcttaaagagaaaggtattaatgaaaatatcattgaatctttaacagaaagtgaagtcaatccttgtttagtgcatattcttccttcaatactgaaaagaactatttctaaaggtaatcctgagttttcttcatcccatcagcaagatactcttgaatattttactttccttcaagaaaagctatctgatgatcttaaaaagtattataatcattcttcacaggaaattcagaagttaattcaacaatttattaatcttttcagtttcttcattggagaaagacttgaatgtaaacaaacaggatctgttaagcttacttctcagttaaataatgtattatcactaccaatacctaaggatttaattacttatagttcagacactaggcaaatcaaaaagccaaaacatgcctttggtgaggatggtgaagatttagctactcctaaatctaataatgttaaagaagaacaagatatgagtgatgatcacgaatgttttagtgatatttccctcttactttccaattggaggcaagaagagatagtagaaaattttctctctccttgtacaaatcaattgggtaaagctggaaaatcgaattttattaaatccatgtcaaaatacctcattatacatatgcaaagattctatttatcagaagattggagacctaagaaaattaacttaagtgttaaagtcccaaatttcttagatttagaatctttaagagattctgaagagctaaaacctggtgaaaagcctttccctgaaggagtagatgaagttaataaatctttaaaagaagaagtccaggttccagaatctctggtgaattctgttttggatttgggattcaccaaatcacatgctgaactggctgttaagaataccttctcaacagatatagatatatgtattaattggatactgacaaatattgactcaatcaattccatggatttgacttcatccgattcatcatcatcttcttcctcatcttcctcaaatacttccaaaaccaataattcagcatctcatcaggatctagaagctatcaagaatattatttcaatatgttgttgttcaagagatattgcagagaaggcattcaaaatttcaaatcaaaacttagagagagctatccaaatgatttttgatgatccttcaattattgaaagttttgaagacacacaattacaacaagtatcagttgggccagatctttcttcaaaactcatagaacttgatgatggaccaggaaaatatgaattaattggagttatttgccatctaggaaaaagtgttcatagcggacattacatatgttataataaaagaaagattgattcctctattaatccatctagccagccaacagaatcgtcctgtccttcctctctatgggtaagatttaatgatacaaaagtttatttaagtaaagaggatgattttccccataaggaaaaagggtatatctatctttatcgcagaactaactaa

SEQ ID NO: 2717 - DNA, 1989 bp, Cryptosporidium hominis
atggatgaaattggcgcaggttcagttgatgaaaataacttacaggtattcacaattgagttatcaaatatcccaggagcccatgtcatctcttcacaagaatatctaaaaggtgcttgctatggtccagaaggttctaaccatagagttagggaatcaagtgttggagagagatggccattaaatataatgagcattacagccttagaagaagatgaatctcgtcaacaaattgaaagctttctaacaagaacaagagttgcaatttttgtttatgacgtggcaaacattgaatctttcaaagctttagaagaaggtactggtaatcatgattttttgatatttagaaaagctatagaaaatggatgtaaggtaattttgtttggaagtctatatagagtaatacacgaatcagcaaaaatagaggttgatattgaacaagtaagaaagatctccagcgatttagatataatatcaatagagtcagattcaatttcgtctttaatttcatcaattgtggggattattaataccagaaatcatttggatataaaaattacacaacaaactgaaggaatcccatttggagctgaaaataacaccctcagagatgaaatggttgataaagataaactggctttaacactagaaagaaatacaatgcaacaaaaacatttaaataattttctcttttccaaatttaatgatggaattagagcatttggtcttagaattccaaaattcccggtacctaaaataacattagatagaaatgaatttctaattccaacattagacttggaagaagcagctaacattactcaagttgaaaaacagggaggaattggaccagttattaatattaaagatgatcagaatagttcagttactcatattgtattttgtagagatataccaactgagccacatacaatgcttttggttgcaagaaagaatggggtaattcacgcatattattgctacaagactcgtttagaagacaatattgctgatgaaaattcatctttggagtggtccggaagagtagaagaggcatattcaagaaaagcgcataatagagcaatcacctctttagctctttctccagatgaatctgaattcttatctacatccattgatatgacagtaaggagattcctaacagctactggtcatgctattagcttattttcagacaactctccagtacttgttggctcctacttaccatttctaccatctctatttattgtttcatcttctaagccactgctaagaattgtgaatgtagatgttggagttgctcaaaagattaaaactgattcaactatcagagctttatgttttgatagtactggaatttactgctttgctgcatgcaaagaaggaaggatttatgttcttgtaaacatagcagcaaagtcttcatcaagaacttcaacagaaaccgatttcagatttactgataagaggggaatgcaggtttgtagcagagctataacaaatatgctttatgtccatggatcatctgactattctaatatcagaaaaacgcatgcaaatagtgctatcggcgcgggatttggcgggctctcttcattattaccggtattagtggtaaatgcagcagattcaacaataactataatagatattcggttgcaagctccaactggtcagatagatatttcgaatgttcctcatgtagttttacaggtgaggttcaggattccgaatcctcattcattgatgcctttgaggtcatgtttttcatctaggaatggtctatgggtagcatctgcagcagaggattgctctgtaagggttttccagttaaataatgattcatgcgaaaaagagaatttagctttagttggccactccgctccggtaataagtactgcagtgaatgcatcatcaacactgttagcaagtggggatgcggatggaattgtcataatttggagaaggttttcttcaagatcataa

SEQ ID NO: 2718 - DNA, 2607 bp, Cryptosporidium hominis
atgaagaaccccagagatctggactcagggactggccttttcgggccagggtcacttgtatggattccatgtcccaaagaggtttggaggcctggcgttgtctctagagtagatgattcacagatttcagtcaaagtttcaaatgtggttgatgagttaacacttgaggaggtttcagaggaagttgtttttaaacttcctttggaggttggatctaacatggcgggggggcagcttcatattagagcagctgagcaactttcagattgtggtgtggttactccggacgatctttgcgaacttactcatctccatcagccttcaattttgcatgcgattaattctaggtttgatcttgataagatttatacatttaccggcccaattttaattgcagtaaatccatatagaactttggaaggtttctattctatggagatgattcagaagtttaggctgaagagtaattccgatattccacatgtgtttagtgttactaataaggcatatactggagtttgtactcaaaagaagtctcaaacaatattaataagtggagaatctggagctggaaagactgaaacaaccaagtttgttcttcaatttttgacagttgttgggtcatctaacaatagtgttagctctggtattgttgattcaggtactggaaatgagaaaagatattcatttgttgaggatcagattattcagagcaatcctcttttagaagcttttggaaattctcaaactttgagaaataacaattcctcaaggtttggaaagtttattgaaattcagttctctgagttgacttctaattcaactttggagtctgattcaagttcaatgtgcattagcagtgcctgtataaatacttatttgcttgaaaaagtcagagtatgccaccaacaaaaaggagagaggaattttcacatattttatcagctttgctctgctgctaagcatattatttctcaaggatcttctcatgaagggaatctgatatacagattcccttcacataatacagagtccatattattttcgcgtaaaaattcagagaatattgtcttgaatcctcatttggcacaattaagggagcaattattctcgaatcctatggaaatagatctctctcacatagtttcagagaagaattttaagtacttggagggttcagaatgccaggaaactgacttccaccaatttgaaaggacattatatgctgtaagaactatgggaattacgaatgaccaactttataatatcatcaaaataattaaagcagtcatgttcttgggtaatattacgtttatagaaaatgagggagagtcatcaattcctcatgaatcatgtttccaagacttggaaattgtttcttcattactttctatacctaaggatggtattgttcgtctattaactcgccgaaagattcagttgagagaaggagaaatattgaaacatttaagcgtacaagaagctgaaacaacaaaagatgcagtttcaaaagcattatattctctagtatttgactatatcttgcatttagtgaacactcaaatatctagagcaagagaaaatgaagctaatgatgctcaccaagaaaaggataaaaaggatttgtattgtgggattctggatatttttggttttgaatgctttccaaataacagttttgagcagctttgtattaactttgcaaatgaaagattacaacaaatatttaatgattatattttcaacattgagcaagatttgtatatacaagaggatattagttgggatccaattgattttccagataatggagattgtgttcaattattacaacaacaaaagccagttttgggaattcttccagcaatagatgaagagtgttttgttccacagggatcaaatattggattattgaataaattagtcaaggaatatagcggaaagaataccaggtttgatattgttaaaaagaagccaaacaactttgtggtagtccactatgcaggccctgtttcatactgtgttgataactttatagagaaaaataaagaccaactttctcattattccactgaagttttatcaagctcagagaatccttgggtttcagatttgataaaagctaaattctcagatcatgtcttagattctgaatcaaacaccaagtcaaaacgtcaacaaactcttggatcatcttttagaaaccagttaaacaaactaatttcaactattaagcaaacaaatcctcattttataagatgcatcaaaccaaatagtaacaactccccagacgaatttgatagaatttctgtctcagaacaactcaagtatggtggggtactacaagctatccaagttagtcgtgctggatatcctgtaagatttccacattttgaatttctacttgattatatgatacttttttcaccatgtggacaactttctattagtaagtctagagatgaatatggtaaatggtgtagaagtatattaaattcaggtaaagttcaagaaacaaagaatgtaacttctttgtctaaatcaaataatataagaaagagtcagatcattgagttaatgggagaatttaaattcttctgggtttga

SEQ ID NO: 2719 - DNA, 1446 bp, Cryptosporidium hominis
atgaataacttcaaagtttccagtttcgtatgcagaagttttgatgaactttactccgctattcagacggaaaatattgagtacttgaactactcattttgtgatacttttggatctcttcatcatattacaattagttcaaattcgtttaaatctggtaaagatatgcaaaaaggaattgcattcgattctagctcagtaagagggatgcagtttggagacttctcggatatgatcgtcgttccagactttgagaaggtttggattgacccattttttgacaggaaaaccctccatgttgcttgttttgtattattccatactggagaaccttcccctggttgtgttagatcaatctcaaaaagagctcaagaagctctttcattgtccgggattgctgataaatgttttattggaccagaaattgaattctttgtatttgagtctgttagttataacaactcaccaaaccacagctatttttgtttagatggcgatgaggcttattggaattctggtaacaacgcgactttttaccaccataatagaccaaatcttgcaagtagaagacctctaaaacaggcgtattgcgctccttatcccgtagatagagatttatcattgagaagtgaaattcttgaagagcttgagaatattggagtaacagtagaaaagcaccaccatgaggttgcaacttgccaacatgaaattggtgttcattgctcaacccttgttcagtcagctgatactgtagaatccatcagatatcttataaaaggaattgcacatagaaataacaaaactgccacatttatgccaaaaccacttggaaatgataatggaagtggaatgcatatcaatatttctctttggaaaaacgaaaaaaacatattctttgaccctgaatcaagttattataatttatccaaccaggctctttatttcattggtggaatactctcccatgcaaaggctattatggcctttacaaatcccacaaccaatagttataaaagacttgctactggctatgaaactccaactaagctttcatatggagctggtgatagaagctcttctattagaatacctttgtcagggttttcatgtacaaaaacccaaagaatcgaatttagaatccctgactcatctgcatgccctcatttggctttttctgccattttgtgtgctggaattgatggtattttgcataaaatacacccagctgcctacttgaataccattaagtctcaaagtaacgaatataatttgccaaaatcacttactgaggctcttcaaaaccttgaagaagattacgaattccttattaaagatggagttttttcgcatgagtttattctcaactacattaagcttaaacgcgacgaagttgttctagttgagtcttttccaacccccaaagagtttgaactgtattatgactga

SEQ ID NO: 2720 - DNA, 960 bp, Cryptosporidium hominis
atgagtcaacctgggggtgctgggggcagtaagacgcaaattacagctgctatattgcaggaggcgtatattcatggctgtcaaaacaataacgagctcagtcctgattctttgaaatcgttaggctgggacaattctataattgtacgagtactgaatatttttactgagaaaaggctttgctctgtaaaaaaaaataggccatctggattattaagctctgtaaataataaagtagtttttcaattaagaactgaagaagtcgcatgtaaacttaataaactctccaatgaggagtatatcgttttttgctcaatagaagatgcaggtaaccaaggaatttggaccgctgatattagaaaaaatacaggtttacaaacacatgttgtacaacgagcagtaaagttattatgcaatgattggaatcttatccggccagttaaaagtattcatgttaagaacagaaaggtttatattttagcttccttagaaccttctaaagagctttctggaggtactttctacgaaaacggagagtttgatatggcttttgtagatagtattaaagaaaagattatatcctttattgacagcaaaagaaagtgtaccctccaagaaatacttgaattcatcaattatgatatgaatatggattcttcttccgcaagaaagaatatatcactctcagatctacaatccgtaataaatatgctcattgttgaacttaaaattatatgtgtcaaaggaggaaattctaattcaaatgaaaattttttcatgtgcttaaaatggccagaatccctctccgttactccagaggcagaagatgttccttgtttggcttgccctgtttttgaaacatgctcctggtcatttgaatctcaaatactcccctgccctcaattatgtaaatatattgattactcgctaaaaaattgcaaacctctatcgccagaataa

SEQ ID NO: 2721 - DNA, 975 bp, Cryptosporidium hominis
atggataatcaacagtcggagctagaaagcactaaatacagtgaaagctcatccaatacaaaagctttagctagccttaaaggaagcttaccagaggactgttattatagtgcagatgaggatttccaacttgaaaatgaggaggcagtgaatacaaatctgatagctccaagtggaagattttcaaactcgaacaggagcaatggattaaagacattagggaatagcaaccaagtttacaaacaagataatattcgaagccaaaaactgccttcatttgggtttgagaacagatttcaggataatattaaaggaaagggaaggacttctggtagtatttatcggttagataagactgagagtgaaaaggatacttgccaagtttgcgagctagatacaaactcaagcttgtcagtattgtcaaattctgaagataatatctcagaatttagtatattaagcgacactgatgtattttcacttcctgctgaaagacaaaattcattaatacttaaagcttctaagattgggaatcttcaattagttcgtcaactaattgcatcttccaaattcaatgcaaatgctacaaatgaaaagggattttcttcgcttcactgggcttctcttaaaggacatagccaagtagttgaagaattgttaaatgccaatgctgaacccaatactaagaatgttatgctttgtactcctttgcacttttcagcaagcaatggatttgatgagatagtaaacaaactattaaatgcaggagcaaatccaaatgctgtgagcgctcttggagatacacctatattttctgccgcttttatgggtcatgaaaatactgtaaaaacattacttaagaatggtgcagacccaaactacaaaaataagcaaggcttaactcctaaggacgcagctgaatcacaaggtcactcagaaatcgtaaaaatcctggaaggcgcgtgcatgcaataa

SEQ ID NO: 2722 - DNA, 549 bp, Cryptosporidium hominis
atgaaaaatcttaatggtaacaatatctgtaatttcgaggaaaacgcagagacaaccaagattgagacaaacgacttcaaagattaccagttccaaacaacctactatggcaattctgtggctaaatttaatgcctcaaagaaaagaacatattttcctatagttttggtttcaggaatagcctatattgctactcaaatccttaataaaggggtttttagcctttcaacttggctgagagtcatcccaattttaatgattttcttgatatattatagaaaagttagagttagacgtcaatcaatcttgattttctatggaattggagtccaactagagacggaatatctttttggaagatcctgttctttcattgaaactacaaagataatctctgctgttatctacgacaaaatgacttatatggaactttctccatgtattggactcataattaaagacgaaaaatccctagtagttccgttttctgatttcaaaatccccacaaaaaagaacataattatctacaatgcattaaagatgatttaa

SEQ ID NO: 2723 - DNA, 936 bp, Cryptosporidium hominis
atgggcggaaattctgtcaacactcggtttggtaagtttctgatttcccctaaagtctttaatgacttactaattgtctttataggagcttcttttcagcattctgcaccagttttggactgtgccataagttcagatagcaggtatctcttttctggaggatgcgataatgagcttaagatgcatgatatgtcatcaagacaaagtcaaacaataggaagacatgatgctcctatttctaatatattctggtgtgatgaacaaaagtttgtggtaacaggaagctgggacaaaaccatcaaattctggaatggacaatctcagaatccaatttattctctaagtataccagagagagtatatgcaatggacctcaagtatcctgccttggtagttgcagcagcagataatgcagtatatgtctggaatctccagaatattactccaactccttataagagaattcaaacccagcttaagcttcaaccaagatcaatatctcttttcccagatagaacaggttttgctattggctcaattgaaggtagatgtgctattgcccacatagaggagtctcatagagataagaacttcccttttagatgtcatagagtcacaagtagcagccctgatattgcttattccataaacagcattgattttcatctacagtatggaacgtttgctaccggagggagtgacggtgctatagccttttgggataaagataacaaatccagattaacaatcatgaagacaatgccagctcccgtaactgatattaaatttagtccgtctgggaaactccttgcatattctctaagctatgattggagcaaaggatatgataatactgcgattaacaacagctgcaacaaagtcttattacacgtaatgaatgatgagcatgtatgtcccaagggaaaacgtagctag

SEQ ID NO: 2724 - DNA, 255 bp, Cryptosporidium hominis
atggtcattagaggttccaaccatgactacgagggagttgttactcgtgttcacagaaagaagtttgtcatcaacgttgagagaatcactagaaagaagacaaacggagagtctgttccaattggaattcacccgtcaaatgttgtcattactaagctaaaattaaacagagacagaagggaacttcttgctcgcaaaaatcgctcaactaagaaaggaaagtacacaaatgctgatgcagcagatctagactag

SEQ ID NO: 2725 - DNA, 627 bp, Cryptosporidium hominis
atgggtattagcagagatagccgtcacaagcatcgtgccactggtggccgtatgccaattgttgttaagaagagaaagtatgaaatgggtcgtccagcctcaaatactaagctcggagcctctccaagagttagagttgttcgttgcagaggtggcaacaagaagtttagagctcttagacttgatagtggaaactattcatggggatcacagggtgttaccagaaaggcacgtattatggaagtcgtatacaatgcatctaacaacgagttagttcgtacaaagactttagttaagaatgcaattgttgttattgatgctactccatttagacaattctatttacaaagatatggtgttgagttaggtagacgtaagaatgctgacgaaaagagtgatgaaaaggatgctcaaaaggccagtggtcacttgcttgcaactagaaaggccagattgatgaacaatgttatcgacccattagttgaggagcaattcggaattggtcgtcttctcgcttgcgtttcttctcgtccaggtcaatgtggtagatgcgatggctacattcttgaaggtaaagaattagagttctacaagaagaagcttgaaaagaagaaggcagctaagtaa

SEQ ID NO: 2726 - DNA, 378 bp, Cryptosporidium hominis
atggtacaaacaattttaaaagtactttatattttgagttttgtaggtatttcattcaatcaagcaacagtttcgaaaagtaatggcgatgaaaactatttcaaattttcatatttgcaagattggatgccagaatggacaaggaataatgatagatacttatttaacacattatattatgatcaagagagcaatgaggatgatgagtttgaattgggaactactgtaacaaagcaaattcaatgtagaatagtcattttgactgcaggagatgaggattttaacacattagtagagctagaaagaaacagaatcgagtattcaagaaaacaaaaatattgttatcttcacttcttttgtaaaaagactaaaaagtaa

SEQ ID NO: 2727 - DNA, 2466 bp, Cryptosporidium hominis
atgggtagaaggcacttagggggtgctggccatttagaagaagcaattgcacaacttgagcgtagatatgagcaaaaagaaggtggagaagtaagtgaggttgagcgggagactgaatttggtagttctgaggtaacaagttctgtacaggcttgcgatgtacttccaacttcaagagacccaaaattatggcttgttaaagttgaccgcgctgggcttgaaaaggatatttgtattgctttagttcaaaaagcagcagaatgccaaaaacaaggcaaagaattgccaattttatccgcatatgttgcttcaagttatagaggttatatatacgtggaggcagaagcaccaaattttgttaatgaagcacttcagggttttacgggagttcgcctttcttctataaaaattattccagttaaagaaatgactcgagtattttctgtggatatgcaggaaaaggagcagctgatgcgtgaaagttgggttagagttagaagtgggatttatggaggcgatttagctcaaatttacgaggttgatgaacatgaagctaatgtgattttgcggcttgtacctagattggatgttcctgcacttataagaaaatcccagaattctcaagacgttagcttttctaaatccagaatcagaccaccagcaaaactattcgatagagataaagttgaatcacttggtggagtagttgaactcactcacttacgtggaacagtgaaatttgcaaaccagctttttgaacaggaaaaaggatatcttctgaagaaaatgaaagcaaaccgtttagttgttggggatgcggttcaaccaacaattgaggagatcaagagattctttggcgtatctgatttatcagaggtgaatattgattcaaaaactcttcttaaaacacagaaatccacctctttctttgttggcgatactgttacaataacaagaggcgagctgataggaattaaggccaaggtagtagcagtaaactctggaattaataaatctttggaagttttgccaatagacaaatcattgggaatcactgaaccaattctcactcaggttgatcttgtttgtaaatcattcgatgtcggagactctgttcaaattgttgaaggcgtaaatgagggcgaatctgggttagttacaagctttgaccaaaattatacagttgctataatttatccattaaatggagcccaaccaataagatgcccaaccaattttcttaaaaaagtttctcaagatgttgtagttactagtggactttcaacagtggatggtttttctcttgatgacttggtacagctttataatggtaaagttggagttatagtatttgtaggaaggaataagaatctgagattgttaactagcacaggagaaaccatcacaattaagtcttccgaaatttcatcaaaaagaaatacttctctcatgcatcgtattcctgatcataacggtaatatttttggagtaaaatcgacagttcaaatcttagaaggcgcaaactctggaaaatctggcaaagttgagcatatctggaaatccacttgctttatcaaattacaatctaagcttgatgatggtggatattttacttgcgaaggacgacaacttttgacattaaagacggctgagagcagccgaatggatgctgctataaaacccacaaatggccctaagaagggcaactctggaggtgggaattcaggtggaggttacagaagagtttatggtatgggcttgcattccaacagaagaggcggaccagatgatgcctttattaatcaaaaggttagaatacttagaggcaaacataaggctctccttggctccatacgtggatttaaaggtaataatgttgaagttcttcttgacattggaccacacacagttcttcttcgcagagaagatatagttcttgttggcgctacaattggaggtggccaagcttccagctttggtggtcaggccaggcaaatgaacacccaaccttcgtctcaagtaaagcaaccaaattggacaggtggaaaggagctttctcagcaaaattcgggccatactgatgaaaactctagcaatcaccctctattttgtagaagaggggtggaggtaacagtaatttcccaaggcgaattctttaatcaaaaaggaattatatcagacattttattcccacctgaagttcctcaagtaacttgctatattattttgataattaacggtcaaatatgtcctgatgaaatgattgcaattgctcctcaaagtattactccaaataagcctgttcctggtgaaaattctatttctgtttcccctcaaactggagtttttactggaataatagattctgttgaaggagatgatttcctcattttggatagtaatagacagtccactacaaaagtttctggccaatttgtattcaaatatcacactcctccagaataa

SEQ ID NO: 2728 - DNA, 1581 bp, Cryptosporidium hominis
atgcgtgcatcatctgaaactaataaaggtgaaggttcaaaggatgaaagtagtggaattcaaaataactggggaagaacaattctttctgaagcaacttcaaaaggtccagtattattttctggtacagattgggtagtagtaccaatggaatcactttctccagaaagaagagcaataattcacccaataagtcaaaggcttgctggagtagagaatgcagctcttgttgatggattatttggaagaatttgggaatttccaaagtgcgagaatgttagagaacgaaaagtaactagaggtgaccagtttgttggagattcaagaattgattttcagtggaataaaactgagagaactttgtgtagagtgtgtggcaaacacatattaaaacagaaatttgcaacagagcattaccaaagatctccaacgtgttggaggcttgtaatgaggcatattggaatcctggattttgactcaaatcaaaatacaaatatgcatttgtcatacaaagctgaagatggaggatttaattccccccagaaatcgatgctagagaagaggataggtcctgtcttctctagaaatattaatggagagaaaagtgatggtacctatctttcaagttcaaatcatgaaacagaaggtaaaaattctgtattcattgaaagtcttgctcaagatggttttaacacaggcaatatgattccaacttcaaatgtcgaatatattctccagaataaaataatgaacttattcagagctgcaaccaaacatgtttacgaagaactcattcagtttaagggctccaatacgcaaatcaatattcacccatcatttaacacttctaaccctggaaatggatctaaattcgactcttccattgtagaaaatgtgatgagtgaaccaaaaggagatgaatccacaaataatataagtaatccagaagaaccctttttacttatatcttctgtgctcccaaatatattcccatcaattagccacagaccacttccagtgaatgtttgttatatcaaactcaccttcaattggccaggagctagacttgtaagggatttatgggcacttgattgtgaattacttgttgattggggagatggtgtgctcacccaagcaagaagattcactcttaaagaattaggagagcctcctgaatctgataatgagatgagaaatatttactctcaaggatttgcatatctcaaatgctttgttcctcataaaccacctgggagagctgatttgaaaattcgtattcctaaatcactctgggaatattgggaagcatttgccaatgacaaaaacaataccgtaactttccatactccagaaatgtttgcttctgagattcctcagaacttccccatagaaactaatcctgaagcgattttgcccaatattaatataaattgggatattaaatctcgtagggatgagaccgcaaaccaaaggtcacacccttattctcctactgtatctcatatacattctccgtcttcatcttcaaggtctattggaaataacgcgaatatgaacccacctaaatcaccttccacatga

SEQ ID NO: 2729 - DNA, 849 bp, Cryptosporidium hominis
atgctatcagactggagagttcccacatgtgagatgctttactattctaagcctttcgataagctatttttttcggaagggacttacaattctcatgttaaaagtaagcattttagtagagaaaactccaaatatacgggacttcctaatgaggaaaaggatagattaagagaagaaagcttagaaagagacaagagtatagctagaaaagaattttttgtcagcaagttttctcaacttctctcagtacaaagaagagaagcaattgatcatgtaaataaactacagagcagcactagagaggagttggagatagataaacagctagagatggaaaatggtggcttggagactttaataacagaactaaatgattgtttgaacaaaaataagtcaaaaggggaccgaaattcaagcaaaatggagtttgatacagattcagacgatgactttgatgaacttcaagagaaagtatataatcctttaaaacttcctcttggaccagatgggaggccaatgccgtattggctttacaagctgaatggtttgggaattgaattcaaatgtgaaatatgcggaaactgtagctactggggaaggagagcgtttgagcgacatttttcagaaactagacacgctaatgggctaagtgctttaggaattccaaatacttgccactttaaagagatcacaaaaatttcagatgctcaagaactttactcagctctttgtaagcaggcaaaagacctttcatttgacgatcaaaactacgttgaaatggaagattcccaaggaaatatcttgcctctcaaatctttccaggatttgtacagacaaggacttatatag

SEQ ID NO: 2730 - DNA, 1674 bp, Cryptosporidium hominis
atgaaattaggaggaattccacttaaagaagtattatttcagagatgtgactctgctttattaggagcgtttctttttgtggctgggagtgtggtctcaaaactttcaagctttgttcttaatatttaccttgcaaagaagatagatcctgagttatttggaattggatttgtaagtattgcgctcattacaaacttatctcaatccctgaacaagaaatgcttccgaagagtggctctttctgaacctattggttctgttacagaagaaagccttcgtcgtgcaaatatccaaagtagcatcaacatttgttggctttccattgtatcgacatgtattctttccctaatattgagtctaatttggatagctcatcctccttcaagcataattttagaccgtggacttgtcaggcagttcaatatttctgtaattctgacaggattctcatctattgtggaatctatctccgaacctttgatctttaatctaattagaaaagagcaggtattcctcagaagtatcattgaaatactatccggaacttctaagagcatattactcatgtctatcgtaatgttcaaaagctctaatttagatatcctttactattctattggacagtttatatattctttgatatttctttcttcaactttatttgcttgtttcaagacttttggccagactaaggaaataatccttcttccaaggtccctaggatcctcttctaagtttcaatttttcctagaaaaccacaaaagcatccttaaacagcaaattcttgttagtatacaatctactgttttacaagaaaccgacaaaatccttgtactacaccttttctcagccaaagaatggagtgactatggggttatttccaacctcgcaaacattattacaagagtcttgcttgctccaattgaagaaatttctgcagaacgcttcaaagaagtcaaacttgagactaatcataacaagtcactaagccacctacaaacaaatctcgccccacttagggaactcttattcttttcgacgtccattggattcattgcaatatgttttggtccgccaatctctaaaagtcttatcagcattctatttggtccaaaatgggtaagacctgaaaatattcaacttttttctgcaaatatttacacccttggaatactctccatacatggaattcttgaaacttttatgctttctttaggcggcaatcatcaaatttctgcataccggcgtttttctattgccatgtattgcatgcatgtgacattcatgctggttttccgcagtggcggttgcatggcactcttgattagtaatggacttgttatgcttttgcaagttttctattacctctcatttatatttagcctaataaatccagtacttcctaatcaagagcccagaaagatcttccattccttcttgaacctccttgttgaaaaaggctccagacgtatttactttgccttcctatttgggggactgatacaaagatgcctaattcaccaaattagagcgtattcagagctcaagaaacttatccgaaatgacttcggcgaactgttggttagctctctgattgcattatgttctctaattatctccattccttcaatcctccaaattctcaaaaaatcacacactgataaacataaatga

SEQ ID NO: 2731 - DNA, 2076 bp, Cryptosporidium hominis
atgggaaaattgattccaaaagaatatatgaatcaacaaattccgggcgaccagtcatctctaattactgggtttcgtgttggtaatagagctattagaggttggaatcagcctaacactggttcccaagcctcttctatgcaaacagtgtctcagggagcccaagacatacggaatactgatgcctctaaccaaggaatcccgacctcaacccagaaatctttagaagactggtacaaagctcattattacgattattactttaaggcatacaagacaaatggtctggatgatgctacatcttcccagtacgctcaaagttgcgtgaatgagttagaaaggaccggttacattaaaaatgctattcaagcacaaagtgaaatggggcaacagcccacctcaaaccctagggagtttagggagcagaaacaaagacaccaaaggaactctgtacatgctgaagaggtgaaacaatttcataattcgctaagtccagtaaataagtccaaaggtttacaaaattggatatacagattattcagtacttatagatcgaatggaacatcaaaagaagatattgagtggaatcaaaagctttccgcatattctcagcatatttctgaacgctataggaactccaataaggtcattgattgggacctgcaaaatcttcccaagagagaagtcattcagaactttaaactcaaagctcctgatcaaagtgaggattctaactccaccaacgaagctatatctaatctttcaaatgtaccaaaactaaccccgtcttcttcaaaaagaaggtttagccctcaacttgagactgagcttaaaaaagatgaagcgaactcttccacctatataaacgaaaaaaactttcctcctctcaagagtaaaagagtgaaagaaacccatattactgatcaagagaaagatacaaagcataataaacacttaaaacaaaaaaaacatggcaaaaatgctggtaacttaaatggtaatgagttggcatcccctccaaataaaatagagtctggctcaaaaggctttagtttctctgcacaatcatcaaaccaacataattccctttcaacatttggttttcaaatttctccgaatattcaatctggttcttctgagggagatggttatattttagatgcaaatggtaataagagactttcttggcaacaaattttggctcttggtaaaagcactgagaagattgttggactctcaaatgttttagagaagcaatatcttagacttacatcttctccagaccccaatttagtcagaccagaacatattttaaagaaatctctcgactttgtttataataattatataaaatattccagttccaaaacctctttaaataaccaaaagcagaaaaagtacgattggaaatacttagaagagcaatttagatctattcgccaggatttaactgttcaaggaattaaaaatctattcaccatccaggtttacgaacttaatgcaagagttgccttggaaaatcatgatcttggccagttcaatcaatgccaagcacgtctgaaagaactttattcacttggaattgtggaatttgaaggttcaaacagagaggaattcttgtgttattatattatttacgttactcttcaaaatatgaaagctgatctcattcgtgttttagatgaagcacaaccattcaagaattgcaaagggattttatttgcaattcaggtctgtaaagcaattatggaaggtaactactgcagatactttaagctatgcaaaaaagctccttggaaatccagatacttatttgagatcttccgtaatagacagcttattatagctctcactactatgactaaagctttccgctttattgagatctctgtacttacttcctctcttgggtttgagtccaattttgattgtcataaattcttgacttctcaaaaggccgtttttctccacccaaattcttcaattaatgaactaaagctcgactgtaaagcaagttttgccgtattttcatcttcacctcttttattaaatagaaaggtccaggcccttggataa

SEQ ID NO: 2732 - DNA, 204 bp, Cryptosporidium hominis
atgaaatcaatatattcttattctaaaaagaagaattcaaccattcttttaataacccatagactagggactattcaaaattgtgatcgaatatttctgttaggtgaagatccagaaaatggaggaagtacaatatctgaacaagggacacatttggaggtaagttacaaggcctcagtgcctgagaaaatattacaagagtaa

SEQ ID NO: 2733 - DNA, 3852 bp, Cryptosporidium hominis
atgaagccattagaagttgaaggagcggagtcccacgttcatgttaaggataataatgaagatgctgaaggcaataaaacctttgagaaaggtaatgatttaggagagaatgataatattgagaacgaaattaagtttgaggctaagttttttagcttaaataacttttggaaagttataataggctttattatgagtgtattgagtggaatctctattcctctatttttgctttattttggcctagcattacaaaaaatacctctaaccccaaactatactgaagaccaatataatgattttatgcggtatatatactatttaatcggagtaactctaaattcattcttttcaggatggctctcaattgccatttttgagagtcttgctgaaaaatttgttaaggatattaaaagggaaagctttcagtatattttacaaatggatgaggactggcatagagataatgactgtggttctgtatcttctaagattatagcaaattgtgctttaattagagagggatatggaataaagttttcccaacttatatcaaatgtctcacaatttttatttggctttattgtgggtttctacagaggatggaagatggcacttgtaatgtctgcttctcttccaatagtagcagcagctggattcttaataactaagatacacagatcttggggaaccactactcagagagtctattccaagtctggagctttggcatttgaagcttttaataatattaaactggttaaatcttattgtctggaatcttttatgtttaacaaatactataaagtaattacagaagttgaaaatgtgggtcaaaaagcgtccgtatttgtttcttttggaattggtattgtttctttggtcatattctcatcttactctcttggattttggtatggaggagtgttagttgcagattctatggattcaggatgtacttttttcgatgatttagaatgctttactgttgcaaatgtatttagcatcttttttgtcattactaacgcttccatcgctcttggacaatctactccttccttagggagtttagtaaagggttcagttgcttttaaagaacttggaaagttattcaaaagacccaaagttagaaatcaaaaagaatctgtgaaatttaaaaagataaatggagagtttaagtttaaagatgtatcatttagttatcctggaactaataagattatactcaaagacttcaacttagaacttcaacctgggaaagctacagcattaattggtggaagtggatgtgggaaatcaagtattttaaagctaatacttagactatatgatccagataaaggaaagatacttctagatggattaaatattaaaaagtatgatttggcttttctaagggaacaaatcacaattgtggatcaagaaagtaagttattcaatgatacaattcgtcaaaatattttgtatggaaatgaaaatgcaactgaaaaagagattgaaaatgctcttagattgtctcaggcttgggattttgtcaattctttccgggatggactggaaactcttgtaggaaatgaaggaagccttctaagtggtggacagagacagagaattgcaattgcaagagctattataaggaattcttcagtcatcatcttagatgaagctacatctggattagatgtcaaaactgagtcattatttacacaagaattccaaaaacacatatcggagagaggaataactgtaatcatgatagctcatagactacaaacaattggttttgcagaccagttagttgtactggatactactccaaataatggtattagggttgtagaacaaggctccagatctgagctagcaactctaagcaatgggatttattctaatcttattcttaaattaaatgaagggagtttggatggttggacccaaaacaaacctcaattattgacctcagctagcgataaaacattccagaaattagcaactttctactctaataattccagcaaaagcatttttaggcgtcaatcacttagcagctttgagagtctcaatcaaggactatgtattgcacataaagatacaagagactacagtttaatggtaaaagaccttttaaatgataacttgaaggctttgtccatgaaacttccaaaggtttcatccttcaagctattattattactcaaaaaagatattcattttctcattttggggattatttctgcttcagtacaaggtgctacttttcctcttatgggatatttgatcgggaaattcgtgacttcaggggtccttccaacttcagaattggttagaactgagacaggtaaatacagcctttactttctctttttagcaatcctaatctttttaacaacttttgcacaaaattcattcctccaaatttcaggagaacgtctaattaagagactgagagcagaatgcttctattcaatgttataccaagatattaaattccatgagcaaccaaatcaaagtgcaattaagctctgtgaggttctagcagaagataccagattaacaaaaagtttagttggggagaatattggactctatacccaaaatattgtcacagttcttcttggtcttacgatatcttttacaagttcactagaacttacaactgtcattcttggattttttatatttttaattccaacaggatatgctcaatctaaggttattaaaggaagtacaaacagggattttgaaaataccaattctgagggttctcgaaaacagtctattcattatttacaagaagttctacagatgcatactattattaagcttttcaatctacagcaggatttcatcaagaaatacagaagaagtactcgttatgagtactttaaaggaacaatggattctcatattcttggactttgctggggttttggtcaagcaattcaaaatactgctcaaagctttggtttatggtatggtagtaagatgacagttgaacaaaagattggattaggagaacttgttcaaactattttggttctaatattaacagcagcttcagtttgtaggtctcagatatacgctactgataagaagaaggctaaagtatcagctaacaaaatcttttcttacatagatagagatcctattgtaagaaataagtgctttgttagtataaatgagagatgtcttaaagacttctctttagcaagggataaaagatcaggaaaatccattcttgatgggaaaatgaagactaaattacaaagactgggaaagtttatcaaagccagagaatttgctacaataactcccaataaactggataatctcttagccagaggagattttaatacttatagctcagaagaatctaagcttagaaaaggcgagatagtctttaagaatgtcttctttagttactcagacaatattgataacttggtcctttccagagttacttttgcaattaatagtggagaatttgttgcaattgttggtaaaagtggatcagggaaaagtactatttttgaacttttggagagattttatccaattagttctcaattttcagaagaaactaggaatgaaaagaatgatcaatattttggtgaaagatcctcaattctcattgattcaattgatttgaatgatctagatgtgggaaaactcagatcttcaatatcttatgtacaacagaaccccatattattttccggtactattcaagaaaacatattattagggaggatggatgcatctatggaagagttggaagaggcaacaaaaatggctcaagcttatgatttcattatggagcttccggaaggctttgagacaaaggtaagttaa

SEQ ID NO: 2734 - DNA, 2403 bp, Cryptosporidium hominis
atgacagcagatgtttctggaggtagtacaaagggtgaagctacctcatctagaataattatcaaaaatcttccgagttatctctcagaaaagagactaaaagatcatatatcttctattggctgcaatataactgatgtaaaaatagttaaaaagagatctgagaagaaccctgaagtagaatcaagtaggaagtttggatttgttggtttttactctgaagaagatgcaaaaaaagttttggaatactttaatggaacatttatagatacttgtagaattaatgttcagtatgcttttcctcctggatcagatttacttcctagaccttggagtaaatattcagttggtagttctcagtataacaagagaaataatattaaagaaaatacagaggttgatgaaaaagaaccaatcactttaagtaaagaagatgatttaaagaaggaaaactttaagaaatggatttcccaaaagaattcaaacaaaagttggctagattctgcagaccttatagataataacgagattaactcttttaagaatgattcatctgtcaagatttcaagtgaaattgtaaaaccaactaaagcaggtgtttcaagtgtaagaaaacatatacagttttcagagtctgaatctgatcctgatcctgattctgattctgatcaagatttagagttaaaacatgagacatttaatgaaagcgatgataactccagcacaaatgtatctgagtctgatttatcatctgaatcgaatacggattcagaagataatcaggaacttgaagaagctgttgatattggagaacagatggttacatctccaacggaaacttccagattaatggtggtaaatatttcatattccacaacagaagaggatttaaataagtttttttccaaatggggagaagtcaaatcagtaaatattattcgctcaccagaatctggagtttcaaaaggatatggatttgtccaatacgaatttgttgagcatgcagtttctgctttatcccaagctcatttgtctcttctacatggaagagtactaagagtatctccagcttttaataaaccaacaaaaactatcacggattctttcaatgaatccaatgtaattgtacactcagattataaattgaaagctttaaacaaaaggaaagaatcttcaatagacaaaaaaacttggaacctcctttatatcagtgggaattctgcagttaatgctttcatagataatgaggatgttaaaaagcatgatattgttgatatacaagcaccagatttggcctccagagtatccttaatggaaactcatgttatttcagctactaaagagtggttaaagaaggaaggaatttcagttaaggcttttgaagtagagggaagcgatatatttacagcaaaactaaaatttgaaggagtcggaaatgttgaaagaagcaaagataccattatcattaaacatttaccttcagatcaagtaacattatccgatcttcagaaaatttgttctccttttggtagaattaatcgattatgcttatctccaagcaagaccattgcaattgtacaatttttggatgaatcttcggcagaatctgccttcaaaagattagcattcaaaagattcaaaagtgttccactttatatagaatgggcaccagttaatttgtttgtctcagaaacagaaacacagaaagaaaaagagacagaatctaaagttgttaacaagaaagaaattttggatatgaatgaagatttagataatacaaatgccgttcatgtatttattaagaatttaagctttgatactacaaacaaagctcttgagaatctatttagcaaagttgaagggtttagaaaggctacaataacaatgaaaactcattcagactctgatgggaatattattaaaaaatcaatgggttatggcttccttgagttcaaaacaagcgaaaatgctaaagaatgtgttaaaaggatgcaatccatcactttagatggacacacactggaacttaaaatctcaaaaaaatctaaaacttctcaagtagatgaaaaaacatcacttccatatggaaagcaacttactgatattggagtaaagaatgtatctaacaaacttcttattaagaatcttccattccaagcaactaaatctgacattatgtctcttttcaactctgtcggaacggtaacttccattagaattccgaagaaatcagatggaactaataagggctactgctttatcgaatttcttggaaaattagaggctatttcagcattggaacagttccaacatactcacttatacgggaggcatctaattattgaagtagcagaaaatgatgatgattcttctccaggaaaaaagaaagcaagaagtagttaa

SEQ ID NO: 2735 - DNA, 498 bp, Cryptosporidium hominis
atggagagatggattcggaacttgatgtgcaaaaaagcagttaggtgcctaagacaacagcaaacagcaggtagaataagatgcaaaaatggaggacttgcgagtacaggttcttcaacaggaactggttgtcctttatcatctcaaagaccctgtgaagcttgttcttctttaaaaggagtagttctttatcccttaactgagaatgtaggaatagaagaaattaagatggatgatgatattaaggaaatgtggaaatctttgataagcaaaaaaggaatgaatttggaagatattattcgtactacaaaaggtgaaatggcggttagaaaacttcttggtcttgataaaacttccaactcttccgaatccacttccaagaaacgtcaaaacaaaactttatcctctaacaacatggaactgaaacgaagaagaatcaagataagaaactcacatatttttaacaattctgatgaactatttgcctctaatacttag

SEQ ID NO: 2736 - DNA, 336 bp, Cryptosporidium hominis
atgtcaaatgaagagaaaccattttcatatttaatacataaagtactgaatattctgcagtcaaacacagttccattaagaaggaaggagattcacaatatactttgcaaggatggagtacaaatatctctagaaagcgatttttggacaaaaattcatctacatgacagaatatttttggaccaggcgacaggtaaatatagttataaatctccatatgataagctaaatagtgagatttctctattagcattcgtgaggcaacatcaggatggtcttttgattgatgaagaactattgaaggtaagttatgttaaaactaacaaaattgattga

SEQ ID NO: 2737 - DNA, 612 bp, Cryptosporidium hominis
atgaccatttcagtacctattgaaccaatcttagtatctatggcattttttacctcaagtattaatggacccactattgatgtacttttgtgtttatttatatgttttaacgccacacaaatcagtacattcttgacggttattgttaccagattttgttttccaaaatatttgggggaaatggttcgtcagtacaaatttttttctgcattcaacgaaatagcaaaagaaagagggtttctactacttgcattgattagactctctctttttttaccttttgttccaagtaattgtttattgggtttaacagatatttcattttttaacttatttctgggaaactttgcagttatcccggctcaaatttcattaatattattcggagcctcaatctatgacaataatcatctcaagaatgaacttaataccaattatattcatcctaaatatgcactcttatttttctcattttccattatttctatgtctctacttttttatattatatttcagaaatttcgagaaatcaatcagaaaactgaatcattgttagagcatgaaaatacttccctctcttctgttcctttccatagtattgataatttataa

SEQ ID NO: 2738 - DNA, 834 bp, Cryptosporidium hominis
atgactactcaaactaattcaaggtcaagttcttccaaaatattgaggaatttaacaatagtattcttttccattctggctatagttttatttgtcgctattatcaagactaccgtttatttgacaaataatctatacttctttaaacaaattgaacagctttcaggtggaaatcttttcattttatacagtttaatacttttaaactctactttctttgctttacttccattcagctttgaaccattaatttttttaactgcagtttactattacaagaatttccaattctatcaaggattagctttaacaatgctctctacatttattgcaattaatgttgggtcaattataattatgctaatatctcgtaaagtaatgtttccatactttaaaagaaaccaagaacactgggattacttcaatactttaaatgatgtttcagatagtcttgggcttttgttcgtaatattggcgagactcattatctctcctcatttcctatatgatatcatatttggttttactaacatctcaattccacaactaatcattggtaactttacctttcttccccgatacctttccatttcagtcttttctgtagttatcaatgatatcgatattttcaaggatagattagttaatttaagctcagatccatccagtgcaatgctcttcacatctatttcttggatatcattcttaatattggttggtctactccacagaagctacttaaaagtcaagggaagaactcctcttcctactgaagagaatcattcaagtcttaaaaattccactaatgcgttaaattttgaaacccgtgtatag

SEQ ID NO: 2739 - DNA, 3096 bp, Cryptosporidium hominis
atgtcagatgaggtaggtaaatcggattggacagcaatggaggatggacgaggagagcggctcgtcattttagaacaggaaaaggctctaacaagacctcaaagacgtaagaaaagatgggacattgtacctgatgaggatcaggaagttagtagttgcgggaagctggaccaaaagaagtcaagatgggacaatggggaagtggaaacccttagagaggttaaggaaacggttgaaactggtagttcagaacaatcatcagaggttggttttgcccagagaactatttctaaggaagaaaggtttcatccaacttttcaaaaagagtttactgacgaggaattggacaagatcctcccttcagaagggtacgagattgtgaagcctcctgaaggatatgagaagcttagaagagccaatttggagaacaaaagaaagcttttagaacctaaaattactttatatgatattcctgaaccaaccaaatcttttcaagaagaattgggagaaagtaaggatgttccccagcaaggttttatgagacaggtatttcattctgaacttggagagttgtctctaagaatagaagacttccatttctttgggaaactcttttctaatatctctgatgatgacctttctcctgaggaagttaacgagcgacttgtattaacacttttattgaaaataaaaaatggagctccaatacttagaagaaaggcaatgaaacagattgtagaaactgctcgtgatcatggacctggaattatcctaaatcatcttcttccattgctaatgcaatctactttggaagagcaggaaagacatatacttgttaaagctttagacagaatcctccaacgtctaggagagaaagttaaaccatatgttcataagattttggttgtaatagaaccaatgttaatagatcaagattattatgctcgccaagaaggaagagagatcatttcaaatcttgcaaaggctgttggactagccactatgattgcaactatgagaccagatatagatcatcctgatgagtatgtgagaaatactacggctaaggcttttgctattctggcctcagctatgggaattccctcattggttatctttctacaagcggtttgtcagagtaagaaaagttggcaagcaagacatactggaattaggattgtccaacaaatagctattttgcatgggagctcagttctccctcacttgaagagtttagtccaaattatttctcacggtttaagtgatgaaaatcaaaaagttagagtaattacagctctctcacttgcatcattagctgaagcttcgtcaccttatggcattgaggcttttgaaccaattctaggacaaatttggaaagggatttctgaatatagaagtcgaaatttggcaagttaccttaaagccatgggacaaatgatttctcttatggaaacaaatcaagcttgccattatattaaggaaatctctcctgttctagtaagggaatttggttcacaggatgatgaaatgaaaagaatcgtcctgagagttctggaacaatgtgtttctgttgaagaaattgggtcagagtttgttaagcaaaagcttcttggacctttctttggacaattttggacttgccgtaattctttggataaaagaacctcaaaattggtcataaatgcaacagtttcactttctaaacaagttggattggagcctattttggatggattactaatatttctcagagatggtagtgagacatttagaattcaagccttagaaactgtcagaaatgtaatggagattgttccagtaattcatttagaacagagactggaaaaactcttagttgatggaatattatacatctttcaggaaagttctactgatgaagattcgtctgttgttgaaaatgtaggtagaatattaactttacttggaacaagatctaaacaatacttaccccaaatatcctcaattattagatggcgtcttaatactccttctccaagagcaagacaaacagctgcagatttagtagctggtattattggagttatgaaacaatgtgaagaagaacaaatgattgctcatattggattatttctatacgaatatttaggcgaagaatatccagaagttcttgggagtattattggagcattacatgcaatagtaactcaagtaagagtagagaaattaagccctccaatcaaagaattagttccaagattaaccccaattctgaaaaatagacatgaaaaagtacaagaaaatatcatacagcttttaggatgctgtgcaaagaaaggaggtgattttgtatctcctaaagaatgggacagaatttgttttgatcttttagatagtcttaaagctaataagaagtcaattaggagagcatcagtcaaaacttttggtcatattgcaaagactataggaccacaagatgtattagtaactttgttaaacaacttaagagtacaagaaagacaacttagagtttgtactactattgctattgctataatttcagaaatttgtatgccttacacagtacttccagctataatgaatgaatataggattccagaccttaatgtccaaaatggagttttaaaaactctttcatttatgtttgaatacattggaacaatgtcaaaggattatatttatgctttaactcctttattggaggtagctcttacagatagagatcaggttcataggcaaacagcagcatgggcttgtaagcatttggctttaggagtggcagggacaggatgcaatgacgctctaatccatctacttaactttctttggccaaacgtctttgagaactctcctcatttagttcaagctgtatacgaagccctagatgcatttagagtcgctttaggtcctggagttatcctaagctaccttttgcaggggctcttccacccagcaaagaaagttaggagtgtttattggaggatttataataacttatatattggaagtcaagattccttggttccattctttccaccaattccccaaattaaaaatagggactttgatatcaatgaattttattactttatttaa

SEQ ID NO: 2740 - DNA, 237 bp, Cryptosporidium hominis
atgagaaatgaagtcataacttctctttttggactttctctaaccctttctctcccctcaacctttccccttaataattcaggcccattgacttggagtatagcccgccaaaaacaaacagaattgattattaatatagcaagaaaatccctgcaggttattttcccgaaattaaagagaagtggattaagaaagaaggaagttcttaacacacttatttttttttgctcttgttga

SEQ ID NO: 2741 - DNA, 1206 bp, Cryptosporidium hominis
atggaacgtattaatgttttctacaatgaagcttctggtggaagatacgttccaagagcaattttggtagatcttgagccaggaacaatggattcagttagagctggtccttttggatcattatttagacctgataacttcatttttggccaaagtggagctggtaatatttgggctaaaggtcattatacagagggagctgaactcttggatgctgtaatggatgtagttagacatgaggcagaatcttgtgattgcctacaaggtttccaaattactcactctttgggaggtggtacaggatcgggtatgggtactttgctggttggaaagattcatgaagaattcccagatcgtattttgcaaaccttttcagtattcccatctccaaaggtatcagatactgtagtagagccctacaatgcaaccttatcaattcaccagttggttgaaaattctgatgctgttcaagtaatcgataatgaagctttgtatgatatttgctttagaacattgaaactaacaaatccatcttatggagatttgaatcacttggtttcagttgccatgtctggcgtaacttgttgcttacgtttcccaggtcaacttaacagtgacttaagaaagatgtgcgttaacttggttcctttcccaagattacacttcttcatgattgggtttgcacctctaacatcaagaggttctcaacaatacagatctttatcagttgcagagcttacccaacaaatgtttgatgcaaagaatatgatgtgtgcttcagacccccgacatggaagatatctcacagctagtgtaatgttcagaggaagaatgtcaacaaaggaagttgatgaacagatgcttttggttcaaaacagaaactcatcttactttgttgaatggattccaaataatatcaagtcatcagtttgtgatattcctccaaaaggattgaagatggcttcaacctttgttggaaactctaccgccatccaggaaatgttcagacgtgttgctgagcaattcacttccatgttcaggagaaaggccttcttgcactggtatactggagagggaatggatgagatggaattcactgaagctgagagcaacatgaacgatttggtttctgaatatcaacaatatcaagatgttccagttgaagaagatgaatacccagatgacgaacatcatattgaggcttaa

SEQ ID NO: 2742 - DNA, 1029 bp, Cryptosporidium hominis
atggacaaagttccaatcgaatttaaaaggaagccaacagttgaagaactgaagaggccagctagagctcagagtgatggttctctccagagcaacttggcatataaggaaggaggagaactatataatatatggtatggaaagtaccaatttgactatgataagagggggaaagtggcttcaaagacaaaatgtatccctgataaagactctggatggacaaaagcagaccaggatccaaataccaagagttatttttgtctttatttcgcaaaaggagcttgtgtgaatggttcaaaatgcaaatactttcatagaattccaacagaggaggacgatagattagtttctccaatgtatgatgtatttgggagagaaaggcatgctcaacacaaagatgatatgactgggacaggttcttttaacaaggaatgtagaacaatatttgttggagacctttatattaataggtcaaaaagtaattacttggagggagtaaacaaggtaattaaaaaggagttttcagtttggggcccagtggactatataagagtgattccaagtaagaatattgcatttgttcgatactttttaagatcatcagcggagtttgccaaagcagcaatggaaaatcagataattttcaaagggcaaacagatccaattactgtgagatgggcatatgatgacccaaatccaacaagtatggagaatagtaagaagagaaatgcagaggaagtggaggaattcgtgtcaaatttggacatagaaaagaaatccagatcagatttacaggtaaataatgaaactgaaggtttttttagccatattgataacacaagtcacaatgttccatcagaagaagtatttaagattcaaaaagattattatagagttgagaaaattctagagtcaattaaaagttgccaaacaaaaaatttggataaatctacaaacattgaaaaaggcaattccgaggatgatgaatcagaaaaacaagaaaactctatctacgatgttattctatag

SEQ ID NO: 2743 - DNA, 1221 bp, Cryptosporidium hominis
atggaaatggatatttcgtcttccaactttgagaatgataatcaaacaaatactgagctttttgaaagtaaaggcctaatgccttcacaatattatgtggatttattctatagtcagttagcttattcatattatggatctcttcactttcattggagggaaaacttttgtagaattataaaagagaagggtctttcaggtttaggtgaaaaatcactcaatattgattttattgacccactttctcacttggcagataagggaattactaatttgttgaataatcactcagattttagtcaggatttaggtcctcagatgcagttaactggctctgtattctacagaggtgattcagatcaggttctattggctcaggcttatgatagttccatcaggaatcctaatgagtgcgaattaactacagagtttgccctaattgctgaatatgaaagccaaaataaggcattctcttatccaggagagaagaaatactccattaatccttgggaaaggtatcatatttcaattttgatgaaagcaatatttgtattcatgttctttgatgtttccagggaattctacattgttttgatttctctctacttcttgtacataagaggtttatttgatggacttcaagatctatttgaaaggatttcttccagccaaccaatggatactactcttgctgaactaagaaggagaagggctgagattgaacttgaagctcagttaattcaagaaagagaacaagagttacttatcaattctgaatttgaacaagttaaggaacaaacagaggacagagctgtggatcaagaaaactcagatttgcccaaatctcaaataaattcttcaaatggggtatctgaggacgaaccctcacaagaagctccaccaaatgaagattttgatgatggttcttccgtgatatctacccatgaagaagctcactttttggacccattgggtgtattagggcctaatgaagtccttggtgcttcacaagctgaagaactacaacattctagtgataatttgaggagagagaataccacagtagcccaagaaaacactcaagaacattcagaagattcacaaggtaacaaccgagctaagaccgttaactacttgacatgcgctatttaccaaacaataggaatgtacattttcacactcatgccctggtggaatccagatcccacatatcttgtctag

SEQ ID NO: 2744 - DNA, 3471 bp, Cryptosporidium hominis
atgcttgaaaacaaaaattcagcaaataaggatgacgcaaatacacgggatccgagagcaatgaatataaataatagcatagggaagctatttgaacagttcagttctagtgaagaatccaagatcaacatggatgatagaatatgcatgcactgttggatttctaaaagcactctctactgtagcacatgtatgtgcttctactgtgcatcatgtgctcatatgaatcatgtttctgcgggtagttaccatgacattatatcagtgcaacatttgtcaatatctagaacagatacagcaaagagccttcaggaaaagcaaaagaatcaatgtaaaagacataaaaataaagaattgacttattgctgtacaagctgtaattatatgttaatttgtgaaacatgtataattatagacgggcatgggtctcatctgttattaacattggctgaagctattccaaggggaagacaaattcttctgcaatctctctcatctcttaatgcaacttcgttttatatgtcgcaaaagatttcagagatttcagccttagcagagcagcgcaaaactatctttgaaaataacctattaaatgttgaagatacccaaaaatccttaacaagggcaataacatcagaagaacagcttctattcacagaaattaacctattagcgagcaaacttgatcgtggagggaaagatatatgcaatagttgtattgatcttaaagaattactcgtaagtgtttgtggtgaggttagtattatacttcagctagctaaagactctccaagccattcccttaatagatatgtaaagattagcaatgttgttaagggaactttagattcttcatatagagtattggttccggaacttcaacatttgagtgttccatattggaatttatttccagatatcattgatgatgtgttaaatgatacaaataaatatactcaggagcatgtagatcatgcaatgaaattatctgatgcaattacaaaaattgcctcgggagatatttctgttgttgaggacattgggccaattaatgttcaagtttattcacaaggcaaacaaggcgatcgagctgctagagccaaagttcataaaatatttacaagcaaactaaaaatgattcagcatgagaagctgaagaatattcaaaatcctttaattgcaccgaaaagttcactcaagcttgatccaacaaaaagcaaggcaaaatcaaaagcagctcaaactggccccaaattgcaagaatggctgggattacgtgattggaagaataatcaatcaaagaaacaaaatgttacaataaataaaaatctaccagcttttaaaatgatgaataaaattaataattctgataataaagccaacaagtccatttttaatgattttggtttgattagagcactttctgatggagatatcaaagttgatgaaattgttgaaaaagatatcgaaattatgacaattggtagagataagaaacttgaagctataggaagaacaaaagaagaaaagttaaagacagaagaattctatgaatctcaagtacattttactggtacacttatgggtgcatgtatatatactaaaaaagaggatggaagtgaagtgtttaagatggactatgaactaactcaaattaacatcaagtactgctttccatttattgtaatttatgatgcaagtaatactggagaccaaaattccaaagattcttctaaaagagaaaattctaatattattgataaggctcattctattaaaggagaaattggatatgcgttacctactatatccccaggattagagagaattgatatcccaattatccttgggaaaatagaaaaacccaggaattcgttatttgttgcagatatacgtcaatcaaatatcagaatccaatcaatacattccaattctattacacctgagacttccaaatacttgggtgcagcagctaactcttggaaacctattgaagatggatttgaaattagtaatgtaattaaaggaaatactattgattcttgggtattttcatgtatagattttaacaatgctgaaaaatggatttcaatgcttaaaggtgaggattcagatgttaaatcttgcatacaaaagattggaaccgctagattatgcgtcaaatcacttaataagagaaatagttttaaaatgtccaactctaaattgaccaagaatccaacaggaagtaatgatgaacaagcatttattgatgttgtgccaaatgtaccaaataatactagagagaaactccttatttctgctcaacctgatcatcatgaactcactcaaacaattgtttatgaggatgatgaaggagagtattatgaagaacaagaaattgatttaccagatgttatgtcaatcaggctagatagaaaactctctgcaaagaaaactaaatctcttgaaaagcttatgataccatcaatccttaaagtaggaaaggaaccagttattcaaattgaaaaattatatgttattggatcatcattaaatacaaatcccttacaagtcgttgttttaaccaagagcaatctatatatcacttctgctgaaatctttgaaaaaaacctttcacatgatttacttttggatgaatattctatacatgaaaaatgctttacagataatattcaattgagtgactctactcatcctaacgatatatcctctagattctctattatttcatccaacttaaaagaatctccaacaaataacgataactcatcaaattcaaacaactttggttttgaatatagggattatggtcgttctctcccctctaacaccgcaactaatgacaaaaataacaattcaagttattctaatgcagctacgattacatttatttgtccaacaaaagatagtgaactcatttggctggactctattcataatcatacaaaaaagaaaccactcaagtattggaggcaaatcctagatggtatcattgttaggcatagaaggataacacgttctccaaaatcctcgaaaggttccagatcatcaaaaccttcaagtattctccctggatccagacatagatcctcaataaaatttgaagatagtgataggttcactgatacatccattcaacaccaaaaactagaatctgaaactaaaaattataattataaagatagccatcttgaaaattctaaagtaaaaaaaacgagtggtgctaattcaacccattctgatattcaagaacatactagtatgtctgatcaagagaaaaaattcaatcgtgaagttaatcgctctaaacacaattttgaaagctcaaatcatctcaaaaataaccgaagcctggttagatttaacttagataatgatgttgaaaaaagccatcgcattccttctaccaaaagttcccatgcttctaatgattttcaacatatttttaaagagagttcattctcttga

SEQ ID NO: 2745 - DNA, 1320 bp, Cryptosporidium hominis
atgcctaacgatttcagtaaaagtaaagagaacaacgatctctttgacattcttgaacttgatgaggaaacaaaaaatgagctcattaaaaatgatataaaaacaattcaacagcttttattagataacctaagaaaaaaagggttaaaaagctttcaagaagcaaggatttactcaaaatgtagagaaaaaattacatgcttccctaataacgtcacagaagaccaaaaaattaacctttgtggtattggtattgaaactggatttgtaaccggtaaaaaattattagaggaagctagagaaaactggtcccagaatggagacttaagatcgcatataaacctaggatccgatatactcatggatttttttgatggaggatttcttgcaggtgaaaccactgaactttttgggcatgatctaccagttatcagaagggttgttcactggattatatcaaatactatgtttaactcaacattagaaagtttaaatgttgaaacggagttagaaggaatttctccatatcaagttatttacattcaaacaaccgacaatagctttgatccaattttcatgaagaaatgttttcaaagactgtgtggagaacttgaaatgactcaaaactcacaatattcaacagaaattagtcataatatggaacttctcctctcgaacatttgtgtagtgactgtagatgattgcgctcaactacaaaagctactatatgacctaccaagaattaaacaaaaagaactaaaaagacttaaactagttgttattgacccaattacatcattgctgggatcccataactttattgaagctcaagaactttcaaataattactataaagaagtcaaagaaaaggtctttatagttgggagattaattaggtatgtatccaaggctctaaatatatcttcagttgtaacttcactcgctaaacaatctattaaacaaactaacaccgtccttggttactgctcaaaccagcttttatgtgatgtcaattacccaaaaagcgttcattttgaaggatttggaacattctacatgcctccaccaacaagagaattttcaacagaaattgactataattggtttctctcacctcacaatcgaatacttattgaaaatattggaaaagtgcacgaagaacacgcgggaaacacgaatgcatgcaataatctggctccccacaatttaagaattttgagatggacaattttcaaatccaatagacttccaataggaaaatatgtatgtgtgatttttgataaaattggtttggttgagtcagaatgccaatttttctga

SEQ ID NO: 2746 - DNA, 327 bp, Cryptosporidium hominis
atgatgagcaaaaaggagtttgagcgtttacaagcagttattctagtatgtttattgtatttatgtatccatgttgaaggaaatggcagaaatgtaacaggatttgtaccagaatttaggaattcaagaagagagccaattcttacaagagcacctccagttacaatacttggagatccaagtatatcactaactattccagcaagaaaagtttgttataagggctcatttgattcaaagtataattcgtgtacttatatagataagaatgatgaggcagttccaatttataaggtaagtaatatgaaggatttccagctaatataa

SEQ ID NO: 2747 - DNA, 324 bp, Cryptosporidium hominis
atgcaatgccctaaaggcgcaaagttagttagttcttttgataactcaaaagcaacatgcgaaaccaaagtaacagttgttccagactttgatagaagatgtgggggagaacagtctggatggttttgggatggagaattaaatgtatgtttaaaactaagaacacatgagccaaagttacgctgtccacatccaagaccaaaattagggatggaaataggaaattgggatacaccagaatatgaacctcatccaatatatacatgtttggcaaatagagccagagcaatagtaaagggtaagtgtgtaaacatattcagttaa

SEQ ID NO: 2748 - DNA, 1632 bp, Cryptosporidium hominis
atgtggagttctttagagttgagtaggcctttattaaaggcattaagtgatttgaactttgtagaagcaacattaattcagaaggaggtaattccattggcattatcgggaagagatattatggctgaggcagaaacaggaagcggaaagacagcagcatttttattacctgcattggaaagattattgaggtcaccatatgttcgaaattccagggtatcatcattgggaagagttggtggagcagttggtacaaaggtgttggtattattgccaagtcgtgagctagcaatgcaatgctttggagtattagaatctttgacaaaatattgcccagtgataaccagggcagtagtaacaggtgggatgaatattcaacagcaagaaagaatacttaaatgtcaaccacatattgttatagcaacaccaggaagaattttggatatgctattaaatacattaagtatacagttagaattattggaaataattatattggatgaagctgacagattattggatatgggatttcgtcaagaatgtttggaaattcttaaatattcatctagaactcgccagacaatgttattttcagcaacattaagtagaagtgtaacagatttagctttattggctctaaataatccatgcaaagtatctacagttggtctcaaatcagggatcaaatctgcaggaagttcaggagaatcagaattattatccattacaggtttatcatcaacattagaacaagaatttcttgagattactaaagaagaagaaagagaaggcgctttgttttatattttaaataagatatttacaaaaagggttatagtctttttccaaactaaaaaagaagctcatagatgtgcaattttaggaaatatttttggattgtcatcaacagagttacatggattcttaccacaagaaaaacgtttagaaaatttttcaaagtttaaatctggacaagttgatattttatttgctagcgaactagcagcaagaggattggatgtacaagatgtttctgcagttatcaatttcactattccattagaagcttctagatatattcatagagttggaagaactgcaagaattggatctaaaggtaattgcattacaatttacactcaaagtgaaagaagccagttaaaagctttaatgaaacaggtacttagagcaggtaataagtcttctgttgcaggaagagacaaaaaagaaaatgtatcttcaattatgaagaagagaactcttgctactaataacattaatcaatgggttgaaaaaatatctaattctgaaaaacaagtcaaagatgcaataaaagcagatattacagaaaaagaacttagaattgccgagatgcaagtaaataaagcgcaaaatattcttttacataaaaaagatattgaatccaggccaagaaaaaagtggataaaaagcaaaaaagaaaaggatttaactagagaatctgcaaaaaaggatttattaaaatcttgttcttcactaattggccaacattcagcatttaatcaagttaagaatactcttcaaaatgatttaaaatctaatagcaaaacggttactaataaaaacaaaaaaagaaaattatcacaaaaatga

SEQ ID NO: 2749 - DNA, 126 bp, Cryptosporidium hominis
aaagacttttatttagaaagttcgaatgggaaatttattattggtcatacacactttaaaaatctattcctaattgtatggtttgaatacaatgcttctattggaaaagtacatattaagtttaac

SEQ ID NO: 2750 - DNA, 267 bp, Cryptosporidium hominis
atgatttacaaagttggttggaaagctgtaattccctccacttttgaagatcaaaccttcaaaggccagattcaagtatcttcatcagatggagcagcctcaataatcccagtttctatcactgcaattaaagaaaaggtcaaccaggttcaatcatcttctaaagatttggaggaagaaaaggatgatgaggaggaaaaggaaattgggacttcaagagaagcaagagatgttgaagaaaatgaatttggtaggttagattcatga

SEQ ID NO: 2751 - DNA, 1659 bp, Cryptosporidium hominis
atgtcattaatttgctcaatttcaggaactactcctgaagatcctgtgatctcaaagacaggatatatctttgaaaaaagactcatagaggagtacataagatgcaataatagctgtccaatcacaaagagtgagctttctttggatgatttgattcaagttaagtccaaaagtaatttaaagccaagattgattaaaaatacaagtattccaggtattcttgactcccttagaacagaatgggatgcaatggcaatggagatgttccagcttagatctgagcttgaacagaccaaatcacaactgactcatagtctttatcaacatgatgctgcctgtagagtgattgccagaattaccagagaaaaagaccaagccattagtaggttagctgaaatccagaatagtattcttgagaaggatgaatataatagtactagtcttcaaagtggaggaggtaaaaggattagagcacaagataattttgttaatatcccagaagacgttatagacctttttactgaatattcggataaaatgcgaccaattcgaaaaaaacagtctttcccagaccttatacctgctgaacaagtcaaagaattctcattaaagagtgaaataaaactcaaagagaactgtaacatagaggttggagtagctttcaatgaccaaatttatgtttctggaatggaaaatggcgagattcttgtatcaaacatagaatttgatagaaatgagatatcttctatccctataagttatccacaaaactgtgaacaagctgtttctatttttgccatcgaaaaatattcaggaggtcaatactcatctgaagatactagccagctcctcctctccttaaatgttcttgcttgcttccaaaactcaaataaaatccatatattctctagaaatcaagaagatcatgaatcttttaacttatcgctcatggattttaactcttcttttgaatcaaatatcattatcaactcactcgaaaaacatcctttaggaatgcatataattgcaaattcttcaaataaaggcctgttttccatgtttgatctggaatccagaaaacaacttttcctacatcaacttgaacaaaatcattcatattcacaactcaaaccacatcctgatggccttattcttggaggaattgtacccaatgggaatattgttgatatttgggatattagaaatctagagaagatttcatcccttgaatacctcaccaaaaataataatattgactataaagacccaaatattagcagaagctccagcctttgcttctcaaataatggatactatctgctttctacctcccttgacaataaaatccacctttgggatcttagaaaatctgcaattcttgattctcttgaactatccacactccctaacaattctaacctgattttacaaattgatgaaagtggaaaatacgcctcctgctttagcaaaaaccatttctccattttctcactcttcaataaacacaaactgcaacttatctcatctttgtccaatttctctaatagaaataataataataatctcccagacaatatccaccatattcatttcagccaaaatcttaattcattctcctcattatgccacagtggaactattcgtatgtggacaaattaa

SEQ ID NO: 2752 - DNA, 2037 bp, Cryptosporidium hominis
atggatcataagaaaagaaagttggagagtgaggtagatggctcaatagataggttcctattaagcgatgagagtagggagattttgaggagtagaggtattgagagattatttcctattcaggctcagtcattcgagtctatatatggtaagaaggatgtattagggaaagcaaaaactgggacaggtaagacattggcatttgttcttccagtcattgagaggctgttaaagaagggtaaatttgatccaaataaacatggcaggcgtccgttagttttagttttacttccaacaagagaattagcacaacaggtatcaaatgaatttgagttaatgaagggaaaggataggtataaagtttgtagcgtatatggtggttctccagaatatcctcaaattcaggaaataaagaagggagttgatattgttgtaggatgtccaggaagagttttagattttattgagcgtggtattttaaatgttagtaaaatatcagtgctaacattggatgaggctgataagatgttggagatggggtttaaagagactgttgataagattattgactgcgttagaaaagaaacgggagatggagaaacacatagtagacaaaataaatttcaagtattactattcagtgctactgtacctccttgggtaaagaacattttaactgagattatgtcaagtgatactgttacagtagatgtgactcatatttcaattcatggagaggaggaggatgaggcagcagctagaagtaggattaggcatttggcaatacagtgtgcatatcctcaaagaactggtttattaggagatattataacaatgtatgcgggaattaatggaaaatgtattatatttacagaaacaaagcaaacagctaatgaaatagccatgagaagtgagattagtaagatgtgtcaggtattacatggtgatatacaacaaaatcaaagagaaatagctttacaagcttttaaagaaggaaggtatcgttgtttagtagcaacagatgttgcagcaagaggattacacattgatgatgttgcagtagtaatacaattagcccctccacgtgatattgatacttatatacatagatcaggaagaacaggaagagcaggaaagttcggaactgctataatgttttgtaatatgtcagattatccattcttatcaagcattgagaaggcgagtaagataagttttcaaagaattggtgtacctcaatatgaagagattttacagaagactgctgattctataggtaaggatttattagaaaaagacataccttcagcaatgttggattgtgttagagatcctgctaagcatatcattcaaggtttatggagaaagctaacaggtaaggcatctagaaaaaggaatagattaggtaattctgatgatgaggaaactgaagctgagtcaaatattaatgataatgatatggatgatgatatgccagagattccggattgtgctgtaagagctttaagtcattgtttattagagttaacaggtataaacaatgatctaaagaagattcctcatcgctcagtattgaatggtagagaagattttaagagctatatgattacttttaataggcttaaagagccaattgcaagtaatagttacgtatggagatgtcttaagagcaatttaagaggttgtgagggtttaatagaaagaatacaatgtatgacgttgttaaagaaaggagatggtgcagtttttgatgttccactgggttcaataaggcagtgggagagtgcaatttctaactttactccaaagaataataacgattcaggtttcttccagattattccagctacaagtaatttgccagagttatcaataccagttactgataataatgctgattttggccataatggcagaatgaacagccaacatatttcaaacaaggttggatatagacaatcaggaggttctagaggcggaggttctggctcaatgggttccagaggtgggttctcaaggggaggaaggcgtttttaa

SEQ ID NO: 2753 - DNA, 1692 bp, Cryptosporidium hominis
atgaaaaattcatgtaaagtaactaaaacaggtcaaaaatgcataaacttgacagaaagccacttcaaagagatagtttcagagttggagaatgcagctcatatcattacaaaccaaaaaagtgagattgaatctttagaaatggcattaagtgcgtccagagatgagattgagcttttacaggaaagtgatagggctttaaaaaaagagaaaaagaaattagcgatggatagtcagaaaatttcaagtgctttaagtaatgaaattgaaacacttaaaatggagttacaacatacacaaaagcaggtggaggtttggaaaggccgaacaagtgaatcaaaagcttccttaaggaagttcttagagtcaacaatcatggattcaggtgaagattcaatcaataatggaacatacatagaaagttatgaaagtacaataatgaatttaaagaatcagttggatgaacgattattaagaattgaacagttggaaatgaattatcaaaatgttaatttggaaagagacgaactttctagtgaagttgctagtttgaaagccaagaataaggcaaacgaatatgaattgcgtgaattaagagaaaaacaaagaaaagaagaaaatgagagaaaacgtttcagtatgcgtgaagaaaagttatctcacgaaattgatagtttatgtaagaaatataatgcagaaattgatgagttacaaaaaaagaatatcttattaaatgatgagatatgggaattaaatcgcattattaagagtaataataatagcattaaggaattacaggatcaaaattcaaataataaaaagtattatgaatactatattgcaggtaaaaaagtggaagattttattactagtaagatttcagattttgaatcttctgtgagaatacagttaacggcattaacaaacttggtgaataaatttgagaagaataagatgataaagaagaatcatcattcaatcaagggacaacaaaaccatcctgttcatactggaagaattacaacggaaattcaatcatttgttccagtaattttaggcgaaaaccaaaaattggatacttctgaaatggaagaaattaatccaggaagaaggaatcaagaaaatcattcatctaatttaagattatttgagaatgatgattctttgataaataataatccattaacaatagcaacaacagcatcttctggaattattacggctaataacagtcaatgtgtaagtaacaacaattcaaattctcctttcatcttgccacaatcacattcaaaatctgtggatttaaattctttacaaggttcaaatacagtccaacagaacgattttactaacaatgaaaatatttcctatcaagaattggccgaaaatattcccccaaattattcagaattagtaaaagaaactatgaaagttttaactcaagcttccaaagatcaccaatctattctagagaagattcagtacctctcagataatattgacgacgaccaggtaatcaatcaagctcaatattaccaaaataacagtaaagtcctacaggatgaaaatgcttttgaaaatggcgcttactattcaattgggaaggaggagatctacattaatagaaagcagtcaattgaggatgataattgttcagaatcaagtatcatttcatttctaagtgagctttaa

SEQ ID NO: 2754 - DNA, 1206 bp, Cryptosporidium hominis
atggacataggaaacaacgtggaagaacatcaggaatatatttctggaccatacattgcattaattaatggcactactcaacaaagggagccgaataaaaagttgaaaaacataataattgcaacgttgattgcaatctttatagttttggttgttactgtatctttgtatattactaataacaccagtgacaaaattgacgatttcgtacctggggattatgttgatccagcaactagggagtatagaaagagttttgaggagttcaaaaagaaatacaacaaaacatatagctctatggaggaggaaaatcaaagatttgaaatttataagcaaaatatgaactttattaaaacaacaaatagccaaggattcagttatgtattagaaatgaatgaatttggtgatttgtcgaaagaagagtttatggcaagattcacaggatatataaaagattccaaagatgatgaaagggtatttaagtcaagtagagtctcagcaagcgaattagaagaggagtttgttcccccaaattctattaattgggtagaagctgggtgcgtaaatccaataagaaatcaaaagaattgtgggtcatgttgggctttctctgctgttgcagctttggagggagcaacgtgtgctcaaacaaaccgaggattaccaagcttgagtgaacaacaatttgttgattgcagtaaacaaaatggcaactttggatgtgatggaggaacaatgggattggcttttcagtatgcaattaagaacaaatatttatgtactaatgatgattacccttactttgctgaggaaaaaacatgtatggattcattttgcgagaattatatagagattcctgtaaaagcctacaaatatgtatttccgagaaatattaatacattaaagactgctttggctaagtatgggccaatttcagttgcaattcaggccgatcaaacccctttccagttttataaaagtggagtatttgatgctccttgtggaaccaaggttaatcatggagttgttctagttggatatgatatggatgaagatactaataaagaatattggctagtaagaaacagctggggcgaggcgtggggagagaaaggatacatcaagctagctcttcattctggaaagaagggaacatgtggtatattggttgagccagtgtatccagtgattaatcaatcaatataa

SEQ ID NO: 2755 - DNA, 1341 bp, Cryptosporidium hominis
atgaatggctcaggaagggagttattgttagggagtgagggcgaaaatgagcaaattcaaataataacattaataaaaaatggaatgagtgcacttaacgaaggagttattaaaccatgcagagagaacttttttctgatagtttgcatgatgagcctcttgatttcttctgtatttaactcagtatttttcaagaaaatgacttcagcaatgccaaaccatgtttggtttttaacacagttaacttctgctttatatatcccattatttggattggtattactgattttttactttagaggtgagctttcaagagataatttagagtttccaatatcaaaattttggatgatgggattttttgacgcatttagcagtatcttaactttacttgcaagcactcacacatcaggagtgatgcaggtagttcttggacaaatgtgcactccaataactctggttatgctttcatcgatatgtaaggatcgatttcataagttacaatatattggagcaacggttatggtgatgggcatatttatagtaaagtcgacattaatattagggataagaaaaagtagcggagcagaaaattcaaatcagttgatattcaatattctatttgtaattgcatgtattccagcttcagccagttcagtttacaaagacctctcatttagagaatactcatcattaaatgagaattatctacaattttgcgttgcagtcactcaagtgatcataggatttatattggtaccaatcaatagtttgtctattcttggtcctcagaaaatagagatgaatcaaattccttctttattatttgatggagcaaattgtctttttttgaagagaaactcaatcactgaaagctgtggaggagaattacaaagaccatgtgataactgtaattcagcacaatttcctgtcttaatatattttattgcaaatgtaatttgcaatgttttcagtgtattagtattgaagcatgggactgcttcaacaggatttattgtctcaactctaagattgccagttactactttggtatttttttctccaagattagtagggaaagaagcaactgagccgaaagtgcaagacttaattgggatacttattttaattctaggattaattctctatagacttggatcagtgaaaattaatcaggaggaagaggaaatacagacggaagaggaaccagaaagagattactacgaattaagttcagtgacatattccaaagaaacaattgataaaattaaaagtaatacttcgtcaactacttgttcctttaatatagaatatgattcatctcatttccatagttcataa

SEQ ID NO: 2756 - DNA, 1227 bp, Cryptosporidium hominis
atgcctttgagccagaatatgagtatgactgaactttcacgtttcaggacaagaatatgtgagagaaaggctttacatggagtatgcgagcttgacgagagatgtcctttttcacattgtctttcctggcatcgtagaaatccttacgaatatgcgtatagaccgaacttatgtcctaatgtagttttccagaatgagaataagaagatgcgtgttaagaactattgccaaagaggcagaatgtgtatgttttctcatacaaaagaggagcaaatgtatcatgttttagtatataagactcaattatgtcgggaatatccgttatgtacaaaacattattgtccatttgctcatggcttagatgaattaagaaatccagaaactatagaatttgacccagtacaaggaccagaagtaattgaacgtcaaagacttgtccatgattgtaataaattcaatgaaattgatttatccgaagatttgaatgactctataattataaggaataaggaggctataataagtaacgttacaacttccccaatatctccatcaaattctcctttacattcaaatatggccgcttcaagtctagcgcctgtaatggatcaaacaaagagtcaaaatagtaaatattctttaaggaataaatctcaaatatctgcatcaagtacaaataactcacctaaaaagggtggtaggggaagtggtcttaatcataacaaggcaaattctaatagtcaaaatagacaatttacaaataatgaattattaaagggagagttaactcctataaacaatacaaatgagtctcctgttacaccatcaacagggtgtgagacccctctacattctcaaaatcacattgcttcaacaggatttaagaatgatgctcgtaaaactgtcaatagagattttcagagaaaggaagtcgatagagctagaggtgcttctccgaatacaagaagtgcgtttcctaaagttatagatggagacgaagttgctcatgctagagataatgtgaatattcctccacctccttataatgcaataggcttaaattttccatgtaatgaaggattaaatgacaatacagatccttcgtcactattaccaaactatgattttggaagatttgcatggaatggctactttgatagaaataagaatttattaaataatagcctaatcgactatgaaaagaataaaatggttcaagagccatta

SEQ ID NO: 2757 - DNA, 1722 bp, Cryptosporidium hominis
atgaaaagtaatgaaatttttgaaagaatcaaaaagagttttaagacaagggtggaggactttaagcaaggcagacagagttggagattaaaggaatggcatcatctacagtcaatactgtatttaatctatggagcaggagcgctcgtttttgtgagattgatagctaattcaaacccagataacaacaactatgatcattttgtgaatgatccaaatgatccagggagttcattcacccattgtgggattactccaatgtttaatatgataccaattccgggatcttacatattattaatatactcagtttattctttatcaataataagcttgacaatttcattcttatcatttatattgggattcagtttcaaatttttcagcagaattcctagaagctactttttctctccatcaaaaagaacaagagtattaggtttttgctgcaagatattaccaataattatcagaattttgaatttgttttttattctacttttggtcatcccatttatatatatcacaaccagtggagcttgttataggagattagttagatttgagagaaataaagtacaaaattgcaggatatgggttaataaatgtgcaaaagaccatcgaatttttggaaggcatttagaatgtagtttaagaaaaaactttaaacactttccaacagaaattgttgaagatcctacaattggtgaaaatctcgacattatcattggaggtccaatgcctctgttatgtcctatgtgcaatgaagtgagaatggacccaaaatcacctttatataaaggagaagcttatgttgagcaacttaaatcatctatttctaaaatggaagcaattaatattaaagacaggtcattatatcaggtagaggcattatcgtttattcaattaagtaatcatatttccacaagatctgggaatattcctaatatttatacaatccaagattacgaagagatgataaagcctattatgtttaataatatttcaccattaatgcaaaagatcattagtaatcgccagagtttacatagttattttaaacttttgccattttcacttatccaactcgaatctaatgtgaaaggcaagaccaatgaaaaagaaaaaaatgatgatttggtttctctagaagagcctattagtattgattttaattctgaatatattaaaaattatgataattatagaccctccatacaactaccttcaaaagttagtattccatccaaatttaagtcaattgttgagaaatatgctgcagctctttcatcacaggtaaatggtgatactttatttagtgaagaagttactcaaaaaaaagatactttcccaaataaaaatcctaaaaagaatcaacataaagaggttgacaaagcaactctaaacaattcatataaaagcacattttattttagtggcgactctagccccactccactaactatagatcaaagtatcgatttaaacagagaatttgaagccgcaagatatcaaatacaagtttccatgcacgaaggaagcaacttttcaagatcaatctttgtatttatgctcatctctctcattttttgggcattgacacgcttcttttcttttgctatctttgatactaccagaaatgaggcctgcttttatgttcctaattcaaaaagaacgctcatttggtccaagctaagaactttcttggacatactaagctaa

SEQ ID NO: 2758 - DNA, 1806 bp, Cryptosporidium hominis
atgcgaaagggagttgtttctattaattatggagatacagcagttgcagctgaggaaaatattgaaaaccaaaatgggaacgaattatttgtggaccatagaagaggagaagttaatgatttatatgagaaacttcaagatattactctgattaaggatagagaaaagaggattgagcttttccaaaaagctattgcattaatgaccctaggtgtagatgtctcttctctttatagtctaatgattcttgctagtgctacacatgaccaagttgagaagaaaatcatatatctatatcttactcattatgctgagagaaattcagaacttgctcttttgatggtaaatactttaagaaaagatagtgaagatgaagatcctgttattaggagtcttgcattaagaagtttctcatcgcttaagattcctattgctattgaatatattgagcctattctgaagaatggattgagtgattctgttggatatgtcagaaaaactgctgtaatgggatgtctcaagttctttcaatattctaaagaagatttcctcaatactaatatattggacattttaatttgtatgttaaataccgaattagatcccaatacaattactaacttaatttatgtattaaatgaaattaataaagaaataggaggagcaacttttacaaagcaatttattatcaaaattcttaacaatattaaatcttttaatgaatggagtcaatatcatatcttacaactcatttttcaaaatctttcaaatattcttcaacaagatcaatcatattctttagaaaccacttttaaggaacaggtaccctcttctgatgtttttcatatattaaatgctttagaagaagtaattcggcattcaagtgttaatgtattattaataagtattcaaatattcatctctttgacaaaaccttatccaaagttattttcccaagtaatacagagaattaagggtccactttttactcatgcatccacttctataccagagatctcagtaatagtttactcacatatgcgacttttgttttcatatttttcaaattattccaaagatggagtatttgtaaaagaagaaaacaaatgcttttattcttcatcttcaatattatctttttattatgatgaatataaattgcttatgttaagaaatggagatcctttttatattcaagacatcaaactggatctaattccttttttaacttctgaagataatattgaacatatattagaagaactttaccattattcctatgaacttggtaattcttgcctaatacataaatctacctatttaatgtcaatcttaataataaaatatattcagatcaaagttgataatgattcagataactttaatccccatgagacacttgaaaatgatcatataattaaatcctatataaatttttcaaaggatttgatggaatcagaaaaagaacaagttcttagtcctgttataatgggacttgaattagtttcagagtcttttccttgggtaatagaagaagttgttggaagatatttctatatgacacttgtggagaagcttagctttaacactggtggtatttgttcatttttgtggattatggcaaaattcccagattatgtatattgtgacaaaggagaagttttagattatgttgtaacaaatttacttgatatttttgagaaggattcaagtaatatagaaaacttggtaaatagaccatcaaatttatttagtattcttattacaagttgttgtagacttttatttgactctcctgaagagtga

SEQ ID NO: 2759 - DNA, 1359 bp, Cryptosporidium hominis
atgaatagggatttaggggaatattttgctataatgggtataaaagattgcgagtattatagtttagaagaagtttcggagagagtaaagacttcaaatataagatttaatagagatgtgatgaggaacgtatttttatcaataaagccaacacatatagataaatgtagtggaaagcaaattaaggataactatttgaaaagaagatgggaacttcagacaatgttagacacctgttttagggagtttgaagctttggaacaacttagacagcaagctgagaataatttgaggaggtatgagaatgttgcaagtaaatacgaccaagaggaaagcaagttaatgattcaagtggtcagtttggatttacaaaaagagatgaatttggaggtaggatataaggttcacttggaatgccaggatcaagtaattgagactcaatggaaaaggtatcaacatgataagaaatgcgtattttggaatgagttgttcagttttgagattgagaggaaatttgcaagtgaggcaaatattttagatataatattattggatagtagaagtaatctgcagctaggaggatgcaatgtaatcttagatgagcttgcagaccaaagaaagcatgaattaagaaaggagatttacagtaatactgatgaagttgtaataggatctttattgatttcttgtcaatggttatattcgagacatattctatataaaagttatgtaagagaatttaagcaaaaaagagatcagaaaatggaagatttgaatacttatcaaaatgaactggcttgtttagatgaacctttcttaccaaaatcaaacaatctttctttatattcttatttatcatcagttccagattatttagcaaataaactggataactcactaactcaatttaaaatgaatggtccagaagtactttacaaatatgtaatttttatttcatttcttcttcaatggattgctagtgctacaagatcatgctatttggattctttgacaacttgttatatattttggtgtaatcttggtaatgagggatttgcttcttctagatggactaataatggattcaaatttatcctttattccatatttatttcacttattattgatatattctggatgaacatattctttccagcgtggagtgttagctctgaagaaggtgaccttcgcaatttctctaaagtctttacattctttaactttgtgtggaagatcatacttttttttataatctggaaatctagaaatgattttattaaattccagcaatacgatgaagccctattgagaaaaaacaaacatggaaatctaagtctacaaaatcatcttaattattaa

SEQ ID NO: 2760 - DNA, 789 bp, Cryptosporidium hominis
atgtcagaaacaagaagatcatttttaggaaacatagcaaatggaattggtaactttataatgggatcagatgaaaaggaatataacttggtaaatgtagcaagagcatcagcaacatttgcaaagccaataattggtcaagtttcagaatttgtcgaatctggaaagaattcactttcagattcatttgtatggaaagattaccatagaggttatatatcaacagaagaagcaatagatttagcttcaacaacagcaagggaagtggagagttctgaaccagaggagtttaagattagatatgaggagaagattaagagtaagagtcaagtattttcttatccaactcctcgtttggaatcattatctcaagctataacagattcgaaggaaaagattcagaatagtgagatcatttcaaagattggatcctgtggatataatatatatcattttctaaaatcaggatcaatcaaagtttttgttaatattaaagaattaatatgcaaagcattgagctttttaaggaattctataagattttgtgatcaaattattttctttttcaagaagaactggggaatcttctacaaaaaagtgaataagataatactaaatatcaaaaataatcctttgggatatccaaagaaagtctattatttcatttatggattcttccatagaatttatgagaaaatttatcattacagacatccagaagttcacaagtcaaagattgcagctttgggaagctctattaagaatattggttggtcttggaggaagtga

SEQ ID NO: 2761 - DNA, 1053 bp, Cryptosporidium hominis
atgatttttaagattaaaagtttattaaatttagatagaaatggttttctttgggtattaattaagacaaatatagaaaatgacgatttgagtgttaactactgcttaaataattatgcctacaattcatcaaaggaaggattcttaggtgaaggtagttactttagggcatataggggtaggaaacttttttcttttaataaagatagtgttgaaagtatcttaactacacttaaaatagggttattatcatgtcttaaatctcataaagttgctttggttatggaaaataaccaaaagataattttatctgtgtatgagagggtgattttggaatatttaataatgagaaaattgaatcattccagtataccaagagttcttgacttgattgaggtaccagaatcgaatcaaatagtgctggttcatgagtatctaccttttcagttgatgtattggaataggtatggtaaattttatagtgtaattaataattccagaaggattatggtttatagtgagaagatttcaatattaatattgtaccaattacttgtttgtgttgattatttacatgaacatagaattgtacatagggatattaagccagaaaatatctttttaacagaaagagttgatgaatcagatttgatttgtactgttgaagacttgaatagtttggatgaggatgaggaggatgaggatgatgaggatgaattgtttgaggaaaagtgtctttgggaggatgctcccatatttgagtcaacttcaggagcaaaagctgaacaaataagattattaagaggaagagatgtggaagaagaagaagaaaaggctttcttggggaggagctccttaatgcagttattggtgctcaaagaatatatggaatacttccaaaaagactttccttcaacaaataaggagtctgataccgcacttaagtttatttccaagttccaagtaaaactttccgatttcaactcatctattatagttaatgactctgggttaatatatgattctggtaagtttaattatattttaaggtga

SEQ ID NO: 2762 - DNA, 1857 bp, Cryptosporidium hominis
atgttgcttcggtctggtataaatttttacaagtcagttgaaggttcaatagggttaagaagcgctgctattaggttcggaatgcgttatataagctctggaaaagagcttagttttggaggaaaagccaggaaagaaatgttgaaaggtgcaaacgaccttgcagatgctgtaggagtgactttggggccaagaggtcgaaatgtcgttatagagcagagatttggggaagctccaaagattaccaaagatggggtcacagttgcaaaggcaattcaatttggtaaaggctcagtgaatttgggtgctcagttattaaagaatgtggcaatatcaacaaacgaggaggctggtgatggtacaactacagccacagtgttagcaagagcaattttcaaatcaggttgtgagaaagttgatgcaggattaaatccaatggacctacttagaggaatcaagcttggagttgagcatgtggttaatgaattggatttattaagccaaccagtaaaatctcatgatgatattttgaatgttgctacaattagtgcaaatggtgattctattgttggatctttgattgctcaggcttatagtaaagttggtaggcatggtacaattaatattgaggaggggaatactacacaaagtgagttggagattgttgaggggttaaaacttgacaagggttatatatccccatactttattacaaatcaaaagtaccaaaaagttgaattggagaatccatatatactgatttcacaagggaagatatcatctttgaagtctattctcccaattctagaattctgtatctcttccagatctcctttattaattattgctgaagaaattgaaggagaagctttaacagctttgattttgaataaacttcaactcaatttaaaagtttgtgcagtgaaagctccaggatttggggatcataggaagcaaatactggaggatatctcagtctctgttggagctaaaattattcaagaagagttctcaaatgcaaagcttgatcagatgaattctaatcaaatacaagaattccttggtaagtgtaaaagtatttcagtctctaaagatgaaacaatcattactcaaggtcaaggatcacctaaagacgtaaaagatactatttccttacttaaatcgcaaattgaggaaaatcaaaagcttactgattatgataaagaaaagcttcgagaaagacttgcaagattaacaggcagagttgctttaattaagattggtggatattctgatactgagatttctgagcttaaggataggtttatcgatgccttgaatgccacaaagtgtgcaatagaacaaggaattgttccaggaggtggttccgctttgttatgggcatctagaaatcttggaaaattatattctcaaagtcctcctcctggaaaaactttaacaccctctcaatcgtcatcaaatgaatcgaatcctattagaaattatgatatggcaatgggtgttaagattattcaagatgcatgcaaggtaccttgccacctcatttcttctaatgcaggttttgatggttcagttatcgttggagaattggttaaagtcttttctaaaggaagtaagcactttggttttgacgctcagactggtcagtttgttgatatgattgaaagtggtattcttgaccctactaaagttgtcaaatctggtctgagagatgctgctagtattgcatctttgatgactacaacacaagtatctgtattcgaaccgagcaatcaatcagaaaagaataattcctctggatcaaattcctccgaatcttcttcttcatttggttcacttcctggtgatttttactaa

SEQ ID NO: 2763 - DNA, 1158 bp, Cryptosporidium hominis
atgacagattttagtgaaaagaatttggagtataggttggacagttcagaacaccaagcacaaggtcagggacaagggcaagggcaagggcaaggacaaattcagaacgaaaataagattccaagtggtcccataatagcaacattatgttgcttgtcggctttgggtttaagaggaaaagtggtatcatcattctcattctttcctccgaaattgagcggtctagtattgagagatcgagatggaagcgaaatagagtttaagaaggagtatatacgcatgagatttgggttagaaaagattaccttaagatctgtgactaatatagaaaagagattggaagatttgttagttggagagagaaaggctgatattttttgtacttggttggaaagtggtagatcaaagatacctatttcttgcattagtatatccccagttcataatgaagatggtactagagaaaagattccagcattcatatttagtcatggaaatgcgacagatattggaagcatgctaccttggtttgtaaatttgagcttaaagttaaatgcgcatgttttagcttatgattatagatcatatggtctttccaaaggaaaaccgacagagagagggatttatgcagatattaaagcagtttatgaatatgcaagagacgaattaaattttccaactgatagaatttttctgttaggacaaagtataggttcagctccaacaatacaccttgctagaaaacttaggaagaagttgagaaagaatacaggtacaagaacaacttctgataaatccaatattgattgtaataggtctgggctccctttaggaggaattattattcaatctggaatagcttcgggtttaaatgctcttttagctccagattataagaaagatataccatgtgatgtatttccaaactataggaatattcgaaaagtgccatttccaattcttattttgcatggaactaatgaccaagttattcatatttcaaactctaagaagttgtttgagaatgcgaaagaaaataaattccatcctccagtaactacttggtgggttgagggagctaaccataatcttccagggccaaaccccaaaaaagagtactaccaaaaaattggtgcttttattaactctgtaatttaa

SEQ ID NO: 2764 - DNA, 213 bp, Cryptosporidium hominis
atggataatagtggtaaagaagaatatcctgctttcagctcagagtttgatgggtttctcaaggaattagatttagccttgaagcagacagtaaaagaacatgaaaaagaaattactaagacaagggtggatcaaaaggttaatgattacaatgcttcaatagagtttatattgaacaaggcgaaaaaaatcttagattctatagaatcctag

SEQ ID NO: 2765 - DNA, 3861 bp, Cryptosporidium hominis
atggcaaaattctcagtagccagttcgtcggcttcaatggagcgactgagctacgatagatctttactaaggagtgcaacagaaagttattctccattagatagagctatcaagtattcaaattcgaaggttgttctacaacggttggttttgattagagagtttatagatatttgccacgatgttgggtattccaaggcaacgagtactttgttaccaatattagggaggttaattaaagataacgaggaggatgtaaggcgaggagtattgagtattttgggtgatttagttgggtttttggtacaatctgatttggaaaaaggttacaatgttgttttatcgactattattccaataataaaagatgttttgatgggtgatattcaaaatacaagcatttctattaaagaggctgcttgccatgttggtataacattatgttcccatttaaggcattcagatagagttcattccattttatctattagtttggctcttgcgaatgacttggataatgaggattcgagatgtttagcatcttggatgttgaatggtttagctgagtatatgggcaaagatatttgcatgcaatttatagttcctcaaattaaatgtctagcagatgatcacagtgagagagtccgaatgtttacagttatgaatctttgtgaggtaattcgaatcactcagagtttttcagagctatttacagttttcaagcgtttattactatatgattcgaaagcagttaggaaatgtgcagtaaaagtgattattggtatcttcagcagtataaaaactattgatagcagcgatttttctactttcctaattgagattttgagggatatttctgacaaagaccttatcaacgatataaacaaacagattggccctctaattactttatttagggacccagaatgtgtcccaagggagattcttgatatatatttggctatgggagtgtcttctgaagcagatgagaatatagcgatatcagagattgattccaaggtctctaaaatggaagaggatagtcaggtttgtaataggcagggcacagaagaggatgatcaggcttctagaggccatatagagacgtttagcagcaggaagtcatctgcgacaatggatattaaaacagagcatgaggagatttccttgcttccttttgggagtaatttggggttaacatttagagagcttgagttcaatggaccatcttacttttgctcttatagcttcgcctccgtattctcacgtatgggtcccagcagctggcctgagttttctaagcttttggctcatcttgttgagagccctcattattcagtaaggcttccaattgccgcctctatgtctttaattctagcaactgcactttcttgtggagatagatctcattctcatcttattcgttccacttccttgttacaaaatcctcctttatcagattcatccaacatgagtaaaagcggtacaatggacaaggagaaaagcgagaaaagtagtgcagagattaagaaagaaaaagagttttgtaacacgattgaaaagggagccgacatgttctttaacaatattaatcaagaacctgctaaatgtcttctaataggctctcccttcaagcttccatgttccaaaggctgccatcttcgtacagatattatatcatttttgcatgatatcattgggaaactgctggatgatagtgacatctatgtaaaaagagccatatttggctgtctttcagacatcattaaatgccttcctcataaggaacacgtggaaccacttattaaaaagttccctgacctacttaattcttgccgaattgactggagatgcagaaatatcttagctaaccagatcagaaagatttgtatagatctccacttaaggaatatggaaattaggagacattcagagacttcccaggagctttttactggaagatttgctcaagaatacttatccccagtagctttttcgctacttcttgatccagtttctgaagttagaaaaactgctataaacagtatttcctctcttttaagaatatcttcgccgttcctttggcacttcttccaaaatgggggtaatgtccacgatcttccaaatccaattcattctccagaatccacttctggccctaaaaaagatattcaggttatttcatcagtttccacatcatcttcatctacttcagcttcctcaccaactccttcctcctccaatcctattgatacctcttgctccgtgaccactgtgaatgttactggaaactctaaatcctttgaatcaaaagaggagaacaaagatctttcctcttcaatcagtgactctgaaaagcaaaataaagatgttaatgatatcctatataagagttttcaaccgctatatattcataaacaaaactcgtccataatatattcatctatttataacttctccccaagttcgtctaaggctttaagaaagggaaatggagaaatcactggttctgctactaattctggaattatcaatggagttaatggatttattagcaataataattataatcaagtccaaatcacgaatgcaaattttaatgatgcttaccccaaattttcagagaaacttcgagtattgttttctctagacgaagaaaatggtaactgtaagttattcaatgaattagctctaatttggtgtattcttaaaacatttgcaatctcaaccaaataccatcatagacaagagtttatacaaatgtgtgatcgctttattagagatattcctagaggatttttttatgcctatttccttaatcctctcatattacttgcttctgatcctatcagaaatgttagatccacatggttaagagttattggacctcatattaaagattctggtagattagcacaatgtgctaatattgttgcagcttgtaagctcatgagccaatcagagtttgacaaagaatgcaacaaatacttatcgaatatcaaattcttaccaaagaataccctaaaacgggtagagtttctatcagttaaagatattacagagattattggccgtactgtcagttatgatgatatccttacttggaatcagcaacctttaatcaaacatttcaatctttatatggaagaagtcttaggatctctatggtgtcttgataatgtgcaaggttcaagtcttcatgcattctccaatgccaattctattattagaaagccattttactcttctgagcgctgttctgacctcacaatggagtatgaaatgatgcttcttgaagtaagacccaactcatctcccacaaatatatcatctttagcaccagtaatcgcttccgataccagcagtttagaatttgggccatcaaacattgatttattttccaatagcaatgcattattctcatgtagacttggggtttgtagaagatcatccgaattttccgaaaatggttcattatcacccaatacaattcttgatacagaaacaaagaccatatccaaggaagattcatccggcattttggaatttgattcctcatcttcaaaatcttcttattctgtcaattccttagaaatactatatagaccaggaatacctagaagttattccaaatttatctgtccttcaggaacagatacctccttccagaatataactgaaacagagtcaattgtcaaaattcggagaatcccaagaaaaaagacgcaaagaagccattcccagaagctaaaacaagataagaaacaaacttctatagtatttgatcataaactacacgaagccactaggaacttctttatggtcgatattgctagagctgcaactgatgatctattttaa

SEQ ID NO: 2766 - DNA, 531 bp, Cryptosporidium hominis
atgcatgctatttctggcccaagcgcatgcacactaaaatccgagcttaattcccgtttgcatgcaacgcagattctaaaattcgagcatccagctgactgtatttatatgaatggcgtggataatcgacactttggagttggcctttactgccttgaggatgcagagtctcagcacagaattgggggaatcaatatatatgacatccagtcagttctggagattcatgatggccacccaaattactcttctaaaactgcagaaaatgtagagcacaaacccaaaatgtatattaatgcagagtcaggagtcgttaattttaaatgggaccctaaagatgtaaacctcaacaatccggactttacccacattacttgtctctgttccgataagagccttaaactatttagaatagactcagatttttgcagctataagcttcttaattctgttaggtctgaaaatatagacaataacaaccatgtaattgggctagacctgtcttgtatttattttaatggtaccaggtaa

SEQ ID NO: 2767 - DNA, 528 bp, Cryptosporidium hominis
atgggttcaaacgataaggaactttctgctctcagaagtaacattaaggaaaagggagaatttagttattattatgctcacaagaacaattctcaagacctcaaggatgcaaagatctttgaaggaccaggaatagtaacaggaggacagccaattttgctgcataaagatgatgaaaaagagcctgtttctgacaagcctcgaagtgttcagattaaaaagtattcatggtcagactgtggagaaagtattgagatttatataagcttacaggatctagccgaattgatatccagtaaatcacctgttgaaatagcagggaaaccaaatttggaagtaacaaataatacaatttcattggaagttttatctgaaaatactaacttcctttttaaaattgcaaacctttctaaccctatagactcagaactttctagagtcaaagtttcagctaaaagaataacaattatctgtttcaaagaagactctgagttgaagtggaactccctttgtaggccaatgttataa

SEQ ID NO: 2768 - DNA, 540 bp, Cryptosporidium hominis
atggaggggactttatatataattctggattcaagaagtttatttaaatatgaggacactggagatagtcaatcaaatactcaaaataacttattggtttcgggagaatgcgtattgaattcagtatttcaattcacaaggctatataatcttagtactggtcagaaaaagaagctgaatatatatctatgcgactcaaaaggcgaaaatttgttgtttgatggctttatatctggtttgacaaaggagttacaatttgagataatgccaaagatgttagaggagatttcagaaagaatttcattgggcgagatgaagatgagcccaaccatttcaaagtgtttgtgtaagattaatagtacaagaaagaagtttggatataatagatcagaaaaagatcgtattatactactagatgcttcaaataaagatgaatacatttctcagtatgtatctttgctgaattgtgggtttgcatcacaaaaattggtaagttatttactcatattattaaacattaaattaattgtaatgttttga

SEQ ID NO: 2769 - DNA, 774 bp, Cryptosporidium hominis
atgacgtcagatttttcagcagttagtgtgagcaaggtaaactcaaggataagcaaagttcctgtgataatgttttctccatctatcataaactttagaagatttacgtttagtagaatggagttagagcctgaaagatttcaaagtctgatgattgtacaaagtcttaatgataaaattgtgccaacaagagatataatggaactagttagtggttttgatgaaacacaagtaagaactcattttgttcaaggagttggaactctacttccaacttatgcaagtctctcatccgagcaattaagaatgtacatggtcgaaattctgcaaatggcttcagaagataatggtattactagtgattctcaaagtaataatgtaacagagatgcagagatttagtaacaagagcgatgcaatggaacaaggaattaataaattggttagtaatagattacaaacaatgcatacatttacagattataattatggaattaatttgccctcactaaggaagccaatttcactcatcagcagaagtcccagaaacagttattctaagtacaaaagtcttggcagcgagttgagagattcaggatacaaccaagataatgaacttgatgagaatgaacagtcacctttgattgaatcaagggaaaaacttacttctaggtcaatatataatccaaagccaaacaatgcaagtgaactatttagtcagctagaacatattaaggaagatgatagtagcgaatattatagtgataaatcatga

SEQ ID NO: 2770 - DNA, 114 bp, Cryptosporidium hominis
gataattataagtcgtatagaaagaagcaagtagaggagattgttggggtttcatacattcggtctccagatttgaggtatcgaactttaataataaggtccaagacttcatat

SEQ ID NO: 2771 - DNA, 2010 bp, Cryptosporidium hominis
atgtatactattcacgaagggtgtaatatatcagggaacacaaggatttatgacactccgaacagacacacttgggatatcaataatggaggtactgatggtatgaggaatgaaagttcaacacctagattcaagcataactttaattctggttattctgataaaaagtttctacaacatggagaagagatggaatttacagggaacaatagaaatgatatattaggaagaaatggaaacttcatcagacaaaatatatcagaatataaaaaaagtattggagtaatggaagggagctatgttgacagaaacatggagatttcagaaaccccaagagtaattcaacagttagaaactaataaacgtcaaataagtgaagaatttactgagaaaagagatcatgaatatgataccagaattgtagataagaacactaaattgagtagcaaaattggatctcaaagctcattgaaccaaactaactacaagaaggtgaacttgggaggatttactgaggcagattggtataaaaagattccaaattgggaaagaataattgatgaaagatatacaagcgtttatagttcatatgaaagacttgaaatgataggaactgggacttatgctaaagtttggcttttgaaagataaaataacagggaagaaatatgcaggaaaactattagaacctcatacttatccctcagatacagtagaaaggattgagagaatgtttcagtcagaaataaagaatctcatagtgagccaatgcccaggtgtagttaggctacacaagatcgtagtaggtccagaaggaagcctattagttcaagattatgtagatgatggtactatttggcgtgagaactgttgtgtaagcgaattggaagccttccagcactttattcaactaattcagagcgtattatacttccaagacaagggggtagtacacagagacttgaaaccaacgaatattttaagatattcaaataaaacaatagtaataggtgattttgggtggagtgaacaaacgaagaagttacatttgagcccctcagaatggccaggaacacttgaaattaatcccccggaagtattgacatttaaagggcctttaaccgaaaagatagacaactatgcagttggaatgaacttattgttgtttctcactggtaggtttatttgcagacagaaaggattggatgttacggaagcagctccttatattctaaaagtagtggaactaatcagaagtgattttaataacaagattctaagtaaaggaaaacaaaaagggaatactcaattgaagcagagccagtacttcatgtgggagatctttattgggtttactgatcccaacccaaatacaaggtggagtattaagaaggctttgttccacccagattgtattcaacagcttttattttgtttccataataactttccaattctatggcatcctcaggtaattgctataatcaaatcaaatattatacctaacaatgtgagctctcaccaaactttcatagaagatgagaaacaatattgtgaagtgggaaaacaaagcattggtatgggaaagagttcagtggcaaacataaatagtagtaatcagataaatattcataatgtttcacatgctacacatttcaataattatagtggcggtcagagtccagtttctgaagacttagcagaatcccagagaagctattataagtcagttggaacgtctctaaggcctgcaaatcctccaataggtcataagttctttaaaaacgacggacaacaacataaactaatgctaaacagccagtttttgtcagggtcttctgataacaattcagtttataataatgagtttgctgcatcattaagaaaccaacaacaggtgaatacctcctctgcagccactctaagttatacaaacaatggccataagtttgttggggttgaaagttctgttgtgaagcaaccccattttatcaataattttcactattga

SEQ ID NO: 2772 - DNA, 1545 bp, Cryptosporidium hominis
atgtttaataaaaaaaattttagggggaaaagaggggtaaaaaaaagtctagagttttttaaaagtcaaagaatctcaataatgctcaaaatgagcggaattaagatgtattttttaagtattttggtattattcagctggatctcaatagttattggaggagaaggaaacttagatgaactagtttcaacacaagttaccagaactttttacttgacaaagagagttgccaaggtagttatggaagtgaaacttaaaagtattaaagacgagatttctggttttgaatacgtttttgctcttccagaagaccaattttcaagaattggattcatctcagcaggaacttcctctattagttctaataactttaaagttgaaaaaattgaagcagaaaagtcatttaagatagaagttggtaatctttcagatgatgagaggaccatatttatagagtatcatatgggaaatccttactctgctttaccaaaagctataagacttggagaaaaccaacttttggtgtttgaggatgaactcaggcttagaaacaagtacaaagttactaaagaaaagatagtaattcagtttttagcaggaacaattatagagagagtaataccaacaaatatgaagcgacaagaaaacaaggtagtccatttggtgagccaggacaaacaaggtgataagtttttggttcatttttcattaaacaatcatctcgtttactttgactcagtctccagaatcattgaaatttcccactggggaaatgttaaggttaaagaagaatactcaggaataaatatggcagctcataacaaaggagaattccacagaaaggaaattatgatcctttcagggcaaggttttgctaggatgagaaatccaggaacagtactacctcataacacacatgtttgtctatttgtagatcatgttcttccatatagagctgttggactggaatactatgaccagattggaaatatttcatactcaaatgcttggagagttggggcctctcacacaatgctccaaatccagcccagatcacctttaatgggcggatggcagtttgactacattgtggaatacaatctccctctggaaactgttgttttctacgatcaaaatttaaagctatacatgcttaatcttactatgattccttcagctaaaggaatatactcagaaaatgtcaacacacaaatcagattcccaactggctcctctgacatttctatagatttcccaaagaataacaatatcccatctcttatacaaaatgatgagttggatcattattttggttggctcgatatttttaagcctagaccagtattagtatataatatgagttcctactatattcctgaacatcttctactcaactacaaatttcaagcatattacagaatcaagtcacatatcatcacattttcaggaactttcctaatttctttcctcgtttttattcctttccttattgttattttaattaaaagacttaataatcactctgtcaaaattaaaaaggaataa

SEQ ID NO: 2773 - DNA, 1596 bp, Cryptosporidium hominis
atgacatcagtcgtaccgaagatcatggatgatggagctcaggagagcaagggtgaattggccagactccagtcaattgtaggagcaatagcaataggagatcttttgaaaactacttttggtccaaaaggaatggataaaatattacaaccaataaaggaaggcccaattgactctactcctatagtaactaatgatggtgctactattttgaagtctatttcaattgacaatccagctgccaagatattggttgatattagtaaacaacaagacaatagatgtggagatggtacaacgggagttgttattttagcttcagaattacttaaacaagctgagagattattggatcagaagattcatcctcaagttattattgctggatatagaatggctctagaggaggctagaaaagctttaagctcaaattcttttaataaccgtgaagatcgttcagcttttgaaactgatttactaaatatagcaagaactactctaagttcaaaacttctcactgttgagaaggatcattttgctaacttagctttaaaagctattcttagacttggagataacatgaatttggactacatccaaatcatcaaaaaagttggaggatcactacaggactccttcttagaagaaggattcattcttgaaaagaagattggagttggccaaccaaaggttatgagaaactgtaaaatcttggtagcaaataccccaatggatactgacaaaattaagatctacggtgctaaagtcactgttgatagtatgaatactgttcaggaaattgaacaagcagaaaagaagaaaatgtataataaagtccagaaaatcctcaagcatggatgtaatgtattcattaatagacaacttatttataactatcctgatcaattattcaaagaggctggaattgttgccatagaacatgcagactttgaaggagttgagagacttggagctgtattaggagcagatattgttagtacttttgataatccagaaaaaacagttcttggaacttgtgaacttatggataccattatgattggagaagacgagtttatccgcttttctggatgtgctaaaaaccaagcatgcaccattgtattaagaggagcatcttctcatatacttgatgaggccgaaagaagtcttcatgatgctctggcagttcttttccaaactgttagtgatggaagagtggtttatggtggtggatgtagtgaaatgttaatgagtgtctcagttgatgaactttctaagagagttgaaggaaaaaagagtcttgcaattgaggcatttgctaatgcattgagacaaattcccactattctcttggataatggaggctatgatagtgctgagattgttactaaacttagagctcttcattataagggtaatagtacctatggaattgattttaaagtcgctcaacctggagatatgaaggaacttggcgtccttgagtcgtttgaatcaaaactctctcagatctgttcagctactgaggcagctgagatgattttgagagttgacgatattatacgttgcgctcctagacaaaggcaaggagtttaa

SEQ ID NO: 2774 - DNA, 1371 bp, Cryptosporidium hominis
atggagaatcttgtagttcaagcaataagtagtgatggagatccgattttgatagatttggctgatatcttaccaaattggatgaaaccaaataattcagcaaatagatgttttatattaaagggaagagtttatttgattcctccagaaataatggacaatatgacagagaatttgtctctgaaatctgctcttgagataataaagtcccaaattaatgattgttatacagaagaatcctttacaaagatctttatggataagtttgactcaatttcaaaaattaatcatgtagagaaatttcataatttttatgtaatacttccaaaaaaaatagcagagatgatatttgagtttcattatctattagaaatctcacttaaatatcttcttggcaacaggtatgattctttagagctaaaaagattgagaaaaaaagaggattctgagaataatgttaaaatgtttttaccaaaagacttgattcgagtaaagatttgcatgacaaggactcaatattcgagatttattaatgaagctctcttgacaatgcttcctccaaaattttcaagaaatagttggataaatcatctttcagagaatcttcaaaataagaaattccattctgagcttttgtatggatgtctattaacttatgggatttatctagcatatttaatcaatccaagtaaatctttgaatttatttatctggaaatttaccaatacagaatacttgaaatcaaatgaggagactaagaataaagagtctgatattcaaattcttgtaaaagattctctagaacttatgaaagacttaaaatcccaaaagagtgatgattttcgtacattatgggtacatttaacaaacaatttaaaagaatcaaaaatgattttatcatctaaaaatgatgaggataaaaatgaatccgattcaagcagttggatgaataatgaagaatactctaaaaagctaattgaagatatccaaaaagtctactcagaagactccaaatctttcaaaaatgatcaatcttttaatttctcagatattttggaagagaaatcttattttgacggcatagacctagatttttcggatccaaattcacttccagaatatcatgatgaagatatgagtgatataactctcgaaagcgacttaagtgaacttgattttgatgaactgaatgaaatcatgaaaaaaatggatgaagaacttaaaagtactctcaaaacgtcagttcccactataagtgataatgatgaagcaaaaaaatttgctgaaaatacctattctgatactttaaagctagaagaaacatttggaattgttggacctgctactgttttccacaaaatgaaaaagtaa

SEQ ID NO: 2775 - DNA, 600 bp, Cryptosporidium hominis
atgattgttggaacaattattagtaatttggcatttgtattagcttctgttggtctatatctatttcaatgtgaattattctataagattaaaataaaaaatgttgtttttccaggtatatctactcttttctttcttttcccaagctcaaacattttcaattcttccatgtatactgaaagcttatattcttgttttaatttctggggagcctttctaattcttaaagctgagtccaattctcataagtttggtttcttctcaattaagaattttatatatttaattttatcagtactttgtatgtcagtaacatgtgtaataagatctaatggaatcttaaattctattccactctttttctatattgtatcaactagtccaagcattaaaaatatcttaaaattcatattacatcggtctattgcctttattaatttcatttctactattttttcttttttggcttatctaatatattcttattttagatattgtgtatatatttcagaatctcgtccttggtgcaaatttttaatcccaaatatttattcttctgttcaagatgaatactgtagtaatggtatattcaactattga

SEQ ID NO: 2776 - DNA, 375 bp, Cryptosporidium hominis
atgttggtattaagttcagaaattaatcaaaattatggtaataattctgaaatcgaccaaagtcaagaacaagatgaagaaatttctgtattaacaagtttgctcccaaatcaaggacaaatgcacaaaatagcacaatattgtcataataaatcaataaagtctgattcaaagatggaatttcttataaataatgacatgttttcatcagcaggaacacttctttcaagtcttttatcagttaatagtagttctaatcaaatgaatcaatattcttcttctacatctaatcaacaagataactactattcaaataatatttgtactttgagagatttagcaaactcattaaaacgtaaaatcactcaaggatga

SEQ ID NO: 2777 - DNA, 663 bp, Cryptosporidium hominis
atgattaaagagaaaatgattgttaatgacgaattatataattacttcatgagacatttaacagaaaagatattaataaattttaaaggaaagaattctatttctgaatctattgatgattatttacaagatttggattatattatgaattataattttattaatgaaattaataaaatagaattaatttcagaaattgatgaaataaaactattagatcaaaatattcaagaaatgatagaaaaattgaatggtgagaattttaagaataagaaagaattgattgagaatattttggattatgaattagatttacaaaatgatttaaattcttcaataaacaataaaaaatcattgaatgatacgatttatattcatcaacctataagttatgatgaagaaatgattcgagatcaactgaatatagattttcctataaaaaagaaaaatgaattcttttctaaattgcaaattaatgatttatttaatcaagaaagtattaaaattatcaaatctaaagatcctaatatgaaaaaccttattcaaaaaaaagatgattttaaaatgactaaagagataaaaaatattgtaaatttattaaaaagatttctttcaattattgaagatgagagacaatcaatattgttattattaggcatataa

SEQ ID NO: 2778 - DNA, 766 bp, Cryptosporidium hominis
atggaggagttgagaacaaatatagaagattgttttgacacttccaaaattttcaagagctataaattgccatttattaaagtaaaaataaataattgtaactatgtacaaaatttgttgaaagaaaatgatattctttttaagttcccaagagtgtctccaattattaatgatgaaaagaataaagaaaacaaattaattttaatgggtgaggatttattacggaattattacaaagttagtgataaaagaatgaaattagaggacaggttgaattcagaattagaatcaaatggagattatattatagaattatcagatgatttctttataaatatgccaagaaatgtatttattggcttaaattcaatagattttgcagaatatggaataatggattttaagatagaatataagtatctttcatatattgaatgtgctagacaatgtattccaaataacattgagatagtatccagttttgagacaattggacatatagctcatttaaatttgaatgaggataacttccaatatagatatattttaggaaagattttattagataagaatccagggataagaacggtagtaacgaaaacaggaaatattgagagtacatttagaacttatcctttggaggtaattggtggagaaaataatttaaaggcaagacttaaggaacagggcataatttataatattaacatcgaccaggtttattggaattctagactttctaatgagagacatagaattgttgagc

SEQ ID NO: 2779 - DNA, 1380 bp, Cryptosporidium hominis
atgtggcgttggtggtcagatgaaggatgggtttattattctttggaaaactctgctgtcattgagaaatcatggagaaaaaaagaagttaacataatcatcaatgttggaggaataccatttctacttaatctccggcacttttaccaatttaacttcattactcaacgtcacagaaggataagtagagatatttcttcagctgtatggttctggacagataatgatgatcagttaaacctttaccaaccaaatgtatctgctcaaattgagagattttatctgcatattcaatggaacctttataaagaatcgcaaaatgatgagaatagtcatcataatcataataattgtcagaaattatgcaaaggttctgatgccctacaaccagctattaataatgaattggttaaaagaccaaaatctggagactgcgttgtttggaaccagtatgatatctacccaatagaatgtgttcaagtgaatagaattactggaaaagaaagaaagatttatagaagatatttaaagaaggtagaatatgaacttactgacaattctcaagattcagataaggaaaatgattttaatttggaatgggaatttactgataccagtaaacctcaaatccaagatgctctttcaataattgttgagactggagaatttaattgtgaaggatactctaatgcattcactaagcaagaaattgactttactgtatccaagttactagaacaagcacaagtggatgatgattgttgtttatgtttggatgctttgaatagggatttagtcaagctgaataaatgttcgcatgttttccattcagagtgtttaaatgatatgataagtcatttgaataacaaaacagctttgttatgcccactttgtatgactccacaatgctttggaagaggaaattcacctcctgggaaaatgagatatattgtttataaatctggaaatattgagatagaaagttatcccaatacaaatgtaattgaaattgaatattttattccaagtggcatccaaaatcagagacatccaagtccaaataagttatatacaggaacatacaaaattgcatatttaccatttaataaaaaaggtctaataatgcttgatggacttgccaaagctttccaacttggtcatacattcaaagtaaacagtattactaatccttcaacaggatcatctatggaaattgttcaatggggcaatattccacataagatctcaacttgcggagggccagctttacacggatttccagatccaaactttttcactacactaataaacaagttatctagtttgggtataaaatgtaaacatgaagaatctgaatcccattctgagattcatgaataa

SEQ ID NO: 2780 - DNA, 1380 bp, Cryptosporidium hominis; identical to SEQ ID NO: 2779

SEQ ID NO: 2781 - DNA, 1032 bp, Cryptosporidium hominis
atggcaagtatgagcagacattacaacaatatatcagaacttccatatattgatttagatagaattgaagagttgagaagacagaataatagatgttgctgcaatcacggaggggagaagttataccagagaaattgcatggattatcaatactcgaaaagagaaggttgtataagagaaaggagaggatattgtgattttgagttggatgaacttagagaagatgatggatgtattcatagaataagattctataaagactcgaatttggatcaaaattacgatttgggatttgaaaaaaattgcaatagacttccaatcttacactcaaattgtaaattaagaacaatgaacgatagtaactactattctaacaatgataataattgtatatattgcaattctagtctagaaagaacttctaataccagagaacgggatttttttaatggacaggatagaagagttcattcttatagtaaacagtgtttatcagaagattcagatactaatgattacaaagatataggacaagagtataattcagattatgaatatagaagaggccaaaacgcctcaagaaacaactgtgaaagacagttttcagatgagtattcagatttatcagaggatatggaagtggttattaaaagaaataatagaaatgtaatatctctagcattaaattggattagtctttcaggagaacacaataaaaaaattagaaagtttgtaatggattcaatgaactctattgagttaaaagatttaaatcactttataattttattccagtatgatgatcataaaggtatgcgcggactttactcatttttccagaaagaaaacaattggcaatgtgtagttgaaattgtaccaaattgtccaaaagttatatgcaaagaaatggtgcatacattgtatatttttgacactagtcagaaactattcaagcctataaatagatcaaaaaagattacagatattgttgatggattaagtataaagaatgaatatttaagtactcaataa

SEQ ID NO: 2782 - DNA, 315 bp, Cryptosporidium hominis
atggatattggacgcttttgtgacatttttgaaaaaatacatatttatatgattggtgttcttttatacttttgcttgactggagaatattatagctttgaatcaaaaaatgataccatatacttaaagttatctggtcatgtgaaggaacttttgaatgccatgttgaatccaaatattgatcaaattccaagtattgaacaaattcttggctttcctgcattgcatcctgaaagacttgtaggaactgtaggagttcagaccaactataacttgttccaaagtcaaatgtcggaattaaagataatggtttag

SEQ ID NO: 2783 - DNA, 2208 bp, Cryptosporidium hominis
atggaagccaataataatgccgaagaaaataaggatgtaattaatacagtaagaactccatctatttcaacagtttctcatccatcagcaagatactttgatgcaagatcatgggaggagaatagagatgtaatctctctaagaattcaatctccagcaagtgaactatatctagatgaagagtttagtcccagcaccattattggatccccaaatagtattgtagatattaaaactccgcaaacacatggaaacaatacatgtggaatacaaggtgaagagatgaaagaaagtgatgcttattacaaaagccatccaaatgaaaacatagaatccaataattatgaaaggagaccaatatttacttccaataggttgttttatgtagtattcacaatactaattggatttatctttattatcggaatattaggagctttcttttatttgggaaaaagccaagggtggaatgaaactttacttaaagatttagaatttaatgtagaagatatatttgtggattttggaatagatcatggacaagagaaattggaaacatctttaatggttaatattaatgcaccaccaaaagaaggtttacaaattagaaatgcaaaggtggttttaccattagaaaatgcaaaagttgaatggaattctattccaattgcaagaataagtagtcctcattctttagatatttttcaatctgataaattgaatgtaatgattcatgcaagttcaaatgctacacatatggtaggtatcagtggaataatacatgatattattacaaaaggatttacagatgtaatggtaaagactcaaatggttgttccaggaatacaaaataatgatgaaaaccaaatcatgtcaaaaaaattcacaatttcaatgccattaaaagagcttattacaaatatacaactctctgatatatcttttgatagagaagttggccacaattccaatattatatttaattccaaggttaattatgattatagaggaagaatctttgtaaataatctaggaaaaatcttcttgggagtatttcaccgaaataactatcttggtatcgtaaaaattgatgattcggatatattaataggaagaaaatctgaaatgagtcttaaaggtactttaaatatgcataatcttattaaggatgaagtaattttaaagagtttaaggccatcattagattttggagaaaatacaagccatcacatacctatcaagagttttgatttagatttgcatggagtaggaagttcttctccattaatggattctgcaattagatcagcaaaaactaatttaaatttggcagtgttgcctccacctcctttaagacaaatccctatgccaagcatttctgttgaatctctggttattacacctcaactaatggttcaaattagaggaaaactaagaacaaccttctatgggtatttaattagcaataatgagactccaaagatggaagctttaagtattaaagggttacttaatgatggaggacaatttactattacttctttagatcaaaataatggaattatgcatcaatctggatcttcaatttctcattttccggaagtaatacctcctccagaaagggaaactgttattccaggagttaatcaaagcttagaaggttcctcaaataatgtaaataatatgaatgatggaattccacatagtactattactatatcaccatatacagacaatttagaagttccaatcaatcttgaattattatttgatgatttctcaaaatcatcacttctaaatagtcacaaaggcttaatcaatgcaaaagatatccaaatactgtccagttggtccttctttactggtcagcatacagaatttaagaatattgatcaatccaaaattgagctggaaatgtttagtttcctaccaaaaattcttgaattccaagttaaagatggtatcttccaagcacaaattacccttcaactgatacatttaggagaatctgatcatgatgaaacttcatataatggtccaattaaagttacttggttttgtaatagggaatttggagcagaattcctactaaatagtgtgatagtcaaccaaattgctgcaaactacgtactaaattcaaatcaacttatcccttcacactgtactctggaaaactccagacttaaggtagagatctcttcaaaatga

SEQ ID NO: 2784 - DNA, 1755 bp, Cryptosporidium hominis
atgacagattttgtgacaaaaaaactagaagtagaaaataaagcttctaaaagtgaaaatagtgaggaaatcgatttaaataataaggaaacatttgtaaatcaagtagttagtgatgaaaatacaatttgtacaagaggaacagaatcttcaattttcacaatcttgaggaattcaaggagagaacatttctttgatgctcgtataaagttatataaagagaagcttagtttaatggagaaagaaggtaagatgaagttcagtaaggggataaactctcgaaaaagtatgccaagatgttgtaaaatgaataaatatcaaatataccgtatattgattactattttgggagttttttttatgttattagcattttttggtgtatcattcttgttgttgcttccaaagattgctgaaattcaaataaggaactcaaaaatggatattcaagaaatcaatgtttttcagattagtaggcagaatggagaaacttcatttgaagtggactcaatattagctatagataaagtatcaaagtacaagactgagtttattcattcattaatgcagataagctatggaataaaaggagaagaaactaaatctttgggtgaattatatatttcacagatgtctgtgaatgaggatggaattttaaaagcaagaggaagatttacgataaggaataatgaatcacttaatgaattgattaattacatgacatcaagtttgaatgttaataacaaggatgaagctatagagaagaatatcacattttatgggaaaggtttaatgtctctaaggatctttggaatattactaaataacataaatgtggatagagaactgagctattcttcagtttatggattgaatggaacatctgaaaggagttctattaatggaaaggaggttagagacagagtttcttctgataatgccccactttcgaacaaaaatggattaaaaattcataatatttggttaaacgctcacaaaatgggtggtatgagattaaatctagagcttgaacttgattttcaaagattaattggtgatgattcagaaaagaagagtgaaaagagcttttttttgccaaagcttcatatggagaatattggtaatttaaggtttgatgtaatatataggaatgaacttattactcagattacttggtatgatgcaaacttaaaatcaggaaataatctttggagtatttcattagatttccctgagaaacttaacaatgggcataaggatatgatcatgaagattattcaaaaagatgatatttccaaggaaattctaacaattaaaggagactcttctggaatggaggcttttagtgatgtctttaatgattttgaaatgaagataccattttcaatacttaagagtataatagaatctgaattaaatggtataaatccaggaaaaactcagtcagatatcattgaaaaacttattcaattcattaatgtttctcatatacaaattttacaagactctgatgatcttaacgtacttgctcgtattaaaattggatatattaatcctctaggtgatagtttgccaatagctttaaattcaatggtacttaattcgcaattaactgatcaaagtaactattatggtgatataacattgagtctgaaagaaataaaaatagatcagacttcatcattcagaaatttacaagaagctaatagaaatagttccacaattatcagtatgattgatactaataataactct

SEQ ID NO: 2785 - DNA, 525 bp, Cryptosporidium hominis
  misc_feature (504)..(504): n is a, c, g, or t
  misc_feature (517)..(517): n is a, c, g, or t
atggatgatatttatttggcagaatttcatggttttattgatgaaaaaacatgggaaattgctaaattaagtatacattatcttcatacacttaaagaaaatataataaaagtcttggaaaatggaggtacacttgagaaatattctcatttaagagatttaattgaaattgtaagaatatgtattttacatggtattttaattggaataaattatttaaataaatcagaagataattacaaatatgattatggttctttgtatcattttgtaagaatattcccagaacttaatgaattaggaaaagttgatgatatgtgttttttatcatttttattaatgaataaagtatttactggatttcttgaatctattaaaaatccttcatcaaaatggaatcaaagaataacaatgtattatcatcatgctagtattttgagatatagtgaattcttgaaagagtttattttaataatcaacagttttgaaaattgtctaagaatnaagaaatttcatnatttttaa

SEQ ID NO: 2786 - DNA, 681 bp, Cryptosporidium hominis
atgtggaatttttataaaaaaataccaaacattaattcattttattcagttggaaatggagaagaaataataaaaagattaaaagtcaataagaaagcattattagtttcaggagaaactgaagattataaaggatgtacaaatgatattatagaatatgcagtaatactttcaaatatatataaatttaaagaaataagaatcttattaagtgaagtatcagaaattttatatggaaattttatatcattatcattaagtagaattaatggagcaataatacaaatagtaaaattatcaaaaaaatctctcaaagaaggatttcaatggttaatttctatggaagaaaatacaggaaatgaaaactattactcagaattttcaaatatatatagaggaaatgataattttgggatgaatttctcaaataatatttatgatttagtatttgtttattctggtccagtaaaattttcaaagaatgatatgaatattgataataatacaaatatagaaaatgaagcaattaatggtccattttttttaatttcaaaaggaaaaaaaaatgataaagatgaatatgatgatgattatataagtttttcagattttgatagaatgatattagaaacgaattccaataataaaggaaatttgacatgttttttggattggaattaa

SEQ ID NO: 2787 - DNA, 969 bp, Cryptosporidium hominis
atgaaaatattcgatttaatgcatcatcgaatatcaacaatgccagaaataaataataataaagatttcttaaatattaatccaaataacacatcttattacaaaaagagagatctttttgtaataatattagcatcatgttcttcttcaatacaagattcacaagaaattaaattatgttcaaataatggtataggattatcaataatatatagaagattattttcatattttattcaatcaataataagatatcattttgaaaatataataaataaagataataatcaaaattttcaattaattccaagaattactttaaaatctttaattgaagagatttcaagaaatatgtttcattatttaacaaaaaatcatttaaaaaatcaaattccaatattattagcatcagttggaatttcaacacaagataatatattattaaataatgatatgaataatataaatatgatgaattatttaaataatggtgattatattattggtaattttgatcaaaaaaataaaatgaactctaatatatcattatcatcatcaaataatataatgaattttaataaatttccaataaagaatttaaatgtgggaaataataaaagaatatataataataataataataataataacaataataataattgttattatatgtatcaaagaaatattccaaatattagtattagtccaaattctaattctaattctaattctaatttgattcaagagattaatcaattaagatcagaattatcttatttaaaacaaactatcaattctgaaaatattgctcgaaatttcaattataatgaaaataattataatagaataaataatggatataaaagttattgtcctgttcaaattttcaattcagatactatttttaaaaaaagtgtaaaaccatcatcaactataactcatcatagaacattcacatcaaagtaa

SEQ ID NO: 2788 - DNA, 2046 bp, Cryptosporidium hominis
atgagagaggagtataactatgatagttataagtacagagagggtggaattaaaagagaggagttgaaacaaaataagtttggtagagcagaacttttaaaaaaggaaaatgaattaagcaaacgagaaggagcagtgttaaagtccaaaaatgttccaaagcttgctttggaatctgtggatccaaaaggcaaatggaaacaaataacgtctagtacattctacggtgactcgggaccattactttcaaagttacactcagttccagaggaattacaaagacactttgagatttatgatggaattgagggagtattaggtagaggagcgtattcaagcgtatttaagatcagaagtaaaagaagtggtaatatatatgcattaaaagttatgagcgtagagcattttacttgtagaggattgtcaggacaattaagaagagaaattcaacttcaatcacaatgttttcatcctaatattgttcaattatataaatgtttggaacataatggatatgtatttttgattctagaatatgtagataccaatttattcaacattcttcatagaaaaaagaagaaccatgtaattagagctggagctagacgaaatagatatattccaagtgacgaagaatatcaagaagaagaatcgtctctttttgcaagaaatgaagtggtgagttatttaacccaaatactcaaggctatcaattatcttcatgaaatgagtatagttcatagagatgttaagcctgagaatattttaatttcttgtgaaggaagagttaagcttggagattttgggtggtgtggagatttatgtaggagatgtaattcaatggcaggaacattctgttatatggctccagaaatcctcaaaggtgaaagacaaacagctaaagtggattcttggagcgttggaattttaatttacgagctttatatgggaaatgtaccatttattccaaataactcatctggaggagggagaggaggaagagagggagaatgtgatggaaatactaattctcaagtgatttcaatgctaaattctattagagaaatctccaaggatgcaagacccagtagatttccaccagatgcctggcatctttgttgttggctactaaggaaaaactccaacgaaagagcttctccaattcaagctctcaaccatccatttctagctgatggcaaccttacttctcccattcctattactcctttcagaaggcctgaatttcaattaaattctactccaaagactgtcaggcaagatatatcttcccctaaagtacaaaattccactacttttactaccctccctcttgttgcagttcccactccaagaaaagcctccgagaaggaaaagttgaggccagaaacccaaattaaaagaatggtaactgagataccaactaatatgtataactataactataattctgaaagaagttctggtttacatgccaataataactatctctcgcagaaaactcctttgaatgcacctgttgttggagttggaccaggaattaatgttgtttctgtccaaactgatcattacaaacaacaaaatcctagttctgaaactaggtactatcaatatcaacagccccgtgtcgcaaataccaaaagagtggatgaacctcagagaagagatctttctgttgttaggaatcctcttcccagagatcattttggcccaggatacttacaaaagattcctcaacaatatcctattgatcaaaaccctagaagcaactataatgaaaacttccaggtttcatcaaggcctgtatttaatagaaatcagttatatggacaagcaccgcctcagcctcaaggagtcatctctcgtgatatttatatgcctcctgttccacaaatgggatcaggatttccccaaaatcagcccagcaaacccatattaaggcaaaatacacctccaaatagatatgtcagtcaacctcccatatattactatgaccaacaaccatcacaagtaagaaggaatcactacttatcacaaaaccactattga

SEQ ID NO: 2789 - DNA, 6708 bp, Cryptosporidium hominis
atggaacaagaatcaaggagctctcatgaaggagggtcaaacactaatgaagctactgaaaaggtttttcaaagcttagaagagtctggttctcaaaatttagatgtctttgatggtaataaggccaatgaaaagacttttattgaggataaggatgaattagtgggtaatactgataagaatgaattagaagatactcaagatgattccactaagattttgagttcagctaataaactcacagaaaattctcgggctcaaagaccaaaaaagaagaagcgccgtcaacagggatctataataggaggaggatctttacaagctttgttgcatgctaccacatctgaaaatcattcttctcaaagcgattcttctgaaatttctgatgactctaggtcagaaaagcgaaaccgtaagaggaagtcttctgtctctaaaactcaaaagaagaatcgcgaaaagtacaaaatgtatattcatgacgaggccgaagaagatgatgaggatggggaagaaaaagctagagaggggagccaagaacgtcctaatcgtagaaaaagagactctcgttcatcatcagaagatgaagatgaggatgacgaagagggttacgatgaattgaaggattttattgctgatgaggtcgaagaggatggtatcgatgatagtttggtgtatagaggtccacatattttgtctcattcagctagccaaggtgaaggagatctacttgcttcaaatgacatccctgaaccaggtaatgagagttcagaggatgacgatgatgacgagattcttagaggaggcttagaagaggatgacttagctttaattgaggaaaacactggaatacgtctcaacaaagattctcagaaacaccgtttaaagaaagtctctgaagctcttgattctcccaataagacacttgtcggtaaggatattggagatttggaagatcttctttttaatactggtgctgatcaaaaggaggactcatcttataaacctagagattatgatcctgttcctggatttgattcagagaattctgaggatgctgatgattggatggtcgatgatatggatgaaaagggtcttagaggagacgagttcaacattattcaatcagtatttggtgactatgatacggttatggatatacttatgaacaaggtttcaaaaaataaagatgtattagaaggtggtcctatgcttgattctgaaaattataacaatgcaaagtttcccaaagtatcagaagagcttgacagtgaaaagactattgtaggtggagatcacgaaattgatatggtagatgatatggatgaggagctctttggtgagggaattgagagagaagaaggtgaggtggagaatatacaggataaaatgaagaaaactacccttcaaactttgcatagtatttctgaaccagctcaattgcaaggacagtttcttactgactttgatggcgaagttaaatatgctgatatacctgagagactatatctattatatggaagccgttggaagtcacttaaagaaaggaaaattagtaagcaggagctacaacaagaggctttatggatttcaaggaaattccttcaaacatacccagaactttttaaagaagagcttttaagaagatcccataatctggaatttaaaacatctttcccatatgtctcaaacggaggtgtaatgcaggtggtttctaatgctgtctttttagttttggattggattctgaatgaaagattggatgtcccatatatttccctacataaaatgcatctgatacaacctcctcttaatgactttcttttgggaaagattgttttcttagattctatatattataaactcaaattatcaattgaaagcttccaacagaaacttttatctattcgagaaaagaaatctatttctgatatatttagaatctctgaatcatatgaaattcctgaagatcatataatccaggcattccttactgtctcaggcttacaggaaacactccaatctagctattactttgattcatccagagatattgataatattagatcttatttcctttatcatatcgacactccaagatttaagcaaattgaagaaacttctattggagaatcatcaaatattataaaatctacacaaattggaaaagataatatgggatattctaatagaaaacaaaggaggaactatatgattgagctatttgagtacattgaaacaaatgagctctttaaagtttggagtccatatattgtttctccttatgttttatctctatatttaaagagctttacatctccacaatttcactgttctacaccatctggaactattcctggccttccaaatacatttagtctacttcctccaggaggtcctgttttagaaaattctaagacagctcttcataaatggttagaaaaattggttagacaggataatccaatgttttcaaatagcgagaaaatcttggattcgttaattgtatatgaatctagacgtcttgcaagctttccagcaattagagccaagatattcgagtacttcctctctaatgcttgtattactacagttacaactaccaagggtgaaaagacattaagtcctaatggagttttttggcttgcaagaaggctatttagaaagcctgttaatactttattacctggaacatatcttcctttgaatgatgattcaggttcggatgctcaaaactctaattctaacacattgtttgatggatgtttatgctctgaagttctcgaacttgagagacgtggattgattgagcttattgtccatcctctttgtatagatgatcctgctccatggagaggatcagatggagaagctagaatcaaagagcgttttttacatgaaattggactcctagattctggaatagaatcaaattcgattcaaaaaggatctttaccagctccaatcatgaatagatttgaccaggaattcagaatgtatgttaatagtgataatattgataacagaattgtaagaaatatattggatgaattaaaatatggatatgttagtatttcaggctcaatttggagtaagcttatccaaattccaattctgcatagattaattgaaaaagaactttttccaagctttagaattgaggtaattaattacctcaaaatgagatctcaggaatatattgctgagctttgctcacttaatcttcaaaaaagactccgagttcttcccccaaagcatcctggaaaagatgaaacaatgttggatacccaaaatggtaaatctggagaaaatcataaaggagagaaaactaagaaagacgatgattatgactcagatgaagatgattttgataatgattattctggcaatactattgaaagtgatgatgaaaactttatttctagaagatctagaaattccagatggagaggagcctctgaagacaattttaatacaatcaaagaagaatataatacaaattggggtcttaatataatatcttgtgtggttgagaaagctcagaatggatttaaagtctgtgtagtttctttagatatttttggagagcttagagactttttagtaatggaccatttattaggtaatatgtctcatcgaaattctagacatcatgatagtagatataatgataaaggagataattcaggatctttagaatctcaacgctttgaagaggatatggagaatctaattcgattcacaaaaatgtactatcctcactatatttgtgttggaatttcagatagaaagagtttagagttagcaggtctttggaataatattcttaagaaagttaaaagaaaggatcacaaatttactccaggatttctatttgtttctatggatgtctcaagagctctagtacgtagatcaggttgtgatcaaaagacttctgggacacaaaaaccaaaaggtcttcaatcagagtatccaatgtatgtcagtctagcagtttctgttggaagacttgttcaaaatcccttagctgaacaattacagctttgggaggactcaggaaatgaaattgaaagtgagctaagtgccaatatttttggtttagataatgaacttggagctattaactcatcctcttcaactggagcaaaagattggtttaatcctattacatgcctaaaattacacagacttcaagacagtgtagatccgaaaatgctccaattccacttacttttggctatccgctctgtagttgctaatcttggagtccagatcaacagaatgaaaggtcactctcatttacagtccccacttaagtttgtgagtggtttaggaccaagaaaagccaaatctttggcattttatttagactctcatccaggaccaatttctaccagaagccaattaagacaagatgacaaccataatgaaacaagccatagaaaatcatcatctaccgataataatcattatgaatacgactttagacaaggtgagcaacatcaagatggttgtctcacaaagaatgtctatttgaatgctcaagtctttcttagaattgatgaagaaagctgtaatgaaagagaatacaataggaatttgaacatatttgatattagtcgacttagcgatgtggaggataaggagctagttttgacaattctaggtaatattcgtgatcaagtttctgaggaaagtgtatctggaattagacaaaagtctaaagaaaaggatgagacagtgctttggacttggatttcaaaaagaagctcaaagcttgagacacttgatcttgaagcttatgcaaagcttatgtatgaaaaccaagatagaccaagacttcttccgtatcttaatagaatgcttagagaacttaagaagccttatgactgttcatttgtttcaagagaatttagaggtattgaaaagtctagacaactcagagaatcttttgagatttctaaagaagatttatttattggatgtgagattacatgcagaattacaggagttttaaataacgttagaggaccttctagatgtccaattacactttggtttgatcaatataatatgaaagtagttcttgaagattttgatacattatgggaagaacttcttgatgagtttcctaagcttcaatccgtctcatttgataatttatttaaattgaatactcctttacaagctattgttacaaatatagatttttctcaacattgtgtatttgttaatttatctcagagtaagatttgtaatatattaaattacttaattgatggagtttggagacaacaacagtatcgtcttgatatgatagagaaacatagatatgataataattctggtggatcttcacaatctcaaggtggacaaacaaacaatacagattcatcatcgatttctatgcataatatagcgattcaagaataccaaagaaatgactttaacttattacaagatgatctttctgctttaatttggacagatatccgtcactttgcctttatattgttcaaaaagaacttgaatgtattatctacaagctcaggactgaatctaaactctggattaggcaagaatggtattggatcaggagacagactttgggacagagagagtaaaggtgataacaagtatcgtggaacaatattacgtacaattcatcatccaaactttaggagttggactcatgagcagataattgagcatatgaagagtgagacagtacctttgggagaagtaataattaaatcatcaactaaatatatagataagttgaatatgtatgtaaaagtttgtgaaaatccctttatgtttaaggtgattaacatagatgagtttgaccaaaggcttcctggagagctaggaagaagattaagaatagatgattcagattttaatgatattgatcaaatattgattcaatatgtacatcctttgaaggtacacctttcaaatgtatttagtcatccaaagtatagatctaatatggaatatcagaatctggtcactgagcttttagtggagtcctctacaagtggtaactcgatagtttggggtatagcagctgataaacagattccttgtagatttcatttaatttcagttccaccaaattcaagagtaggttcaagtggagctaggatacactttgaagacgggatttatgtaaatcataaagggtttcagttatggaggaaatccgagaatactttgagaaagctgttgaactggtggaagactgagggattctttaagagatctaaacacttggaggattataagaggtataaggaatacatggtgagacagaagcaagggaaagcgaactcagaggacgattttggttccagaaagttcggaacttctcatcataacagttatcattataattctggaggtggaggtggtggaggaggaggaggaggaagtggaggataccagagccaacattcgagcaattattctcactctagacataatcatgcagcagacaactttgggagtcagacaggtggaagccatagcaagtctggagggggaggatcccaatatggatcccactcccactctggaggattcaggaaatccttccacggatatcctccttctcagatggagggtggatcggctcaccattacccttctgctcctgaaccttatgaatctagtttccaaggcaattataggtactcgaggagatga

SEQ ID NO: 2790 - DNA, 2253 bp, Cryptosporidium hominis
atgtgggaggacaaaagcatgctgatcattgataagaatgagtcagggacatctccaaatcaagaagatgttgcaaaacacatcgaacaggcttgcagttcaaagttggaagacaaagttgtgttagagtacttagtaaaggtagtttatgctgaaattcttgaaaataaaggaagaatgtctaaagataggctgtttgaaataatggatactttcttgaggcaatatggtgattttgaagatattaattcagttgtgaatgatgtatatgaagaattaggtattgaaccagaagagtccaatgaacttactggagtattgaaagttattgaaccaacaaaaattctcagatccgaggttgagacagacaaacttaagtacgatcctcttcttgatctagatgtgggaggaagtgggaacttcaacaaaaatatccctattggagaaagtattaagcttcagaaggccgcagcaaaggagaaagagagacagcttagattattaaaacaatgggaaaagcaaaagttggaggtacctgttcctgtgtgtcaacatccaattgataggtctagacgaaagctaaaagacattcaaattcccaatattactatttttatttctggaagagctctacttagtgatgcatcattaaatctgactcttaagcataaatatggactaataggtagaaatggaattggaaagtcaactcttctgacttatattgtaagaagagagataccaggaatccctgctgatgtttctattgcttgtgttgaacaagaattacattacagacctgaagaaactgtcttagaagcagttttaagtatagatactgaaagatttgagcttttagaagaagagaaaagacttctggctggaaatgatgaggaatctgggaattcggaactccttaaagaagaaaacactgcacgtttaagtcaaatatatgaaagattaacagaaattgatgcatatactgctgaaaatagagcttctgtcattcttgttggcttaggattcactcaggaaatgctcaaagagaaagttattcggctttcaggaggatggagaatgagagttgctcttgcgagggcaatatatgctaatcctgatatcttactcttggatgaacctaccaatcacttggatatacttgcagttacttggcttgaaaatttccttaaagaatgggataaaatttgtgtcattgttagccactcaagagatcttcttaaccaagtttgttctgatattattcattttaatgacaataaacttacatactataaagggcattacgatacattcgaggaagtgagatctattgatctaattcttaagcaaaaacatttggaacaacaagcagctgaaaaagaacgaattcagagatttattgatagattcagatataatgctagtagagcaagtttagttcagagccgaattaaataccttgaaaggcttcctattcttgaggaagtccgtaaagaccccacagttgtttttgactttaatgccatggatatttctgggtcgacaattactggtaaaagtgatgatacttatgtatctctcatcgaatgttgtggtgtcagcttctactattcacaggaatctagcaacacaaccaaacaaattgttcatgattttagtatgaatatacaaagcaattcaaagatagcaatttgtggaggaaatggaagcggtaaaactacagttctaaaattaattatgggacaactcaacccaaccaagggaatgatcaagagagatccaaaaattagaataggttactttgcacaacatcatattgaatcgcttgaccttacacttaactctattcagcagttacaagcaagatatcccggggctgatatttctgatgaaaaagccaggaatttctttggaaggtttggaataacaggcagcctcgccttagaacctctctacgttctttctggagggcaaaaaagtagagttgctattgctattatggcgtatctaaatcctcatttattaattttagatgagccaacaaatcaccttgacttggattcaattcaagctcttattgttgctctaaactcttttaatggaggcgttattattgtcagccacgatgcccacttaatttcttgcgttgcaaactcaatatggcatattgaccacgtaaataaaaccctcaaagagttcaaaggcggtgactttgacctatatagaaaaacagtagttagagcatcagtttga

SEQ ID NO: 2791 - DNA, 483 bp, Cryptosporidium hominis
atgaatattataaggctattttgcggactttatctagtcattatttatctatccgtttcaaatgaaaatcatgaagttctgcacacttctttggctaatattcaatcttcaaagaagaaaggaaagaaaccttctagatctgactgtgaaaaagctgcatccgaatacttagaatacttactattgaaaaatgggttcatgtttagagttagtttaacagaaagatatagtaaattgttagactctgaaactaataacagtttattggaattatataaacgtaaatacgagaaatcacttcaaaaaatgtcatccattgcaaaaaaaattgagtcgagacacgataaagctagagatctatttaatgttttacttgagtgccttatattatttggagaaagatacagtccagaatatatttttgcaaacaataaggatgcacttaaatacctggactcagttgacaagttaggaacccagtaa

SEQ ID NO: 2792 - DNA, 3348 bp, Cryptosporidium hominis
atgattcgaataggcggatttagggtaaatatggggttgaaagctttgttgggttgtattctcttaatttctggtctgctatcaatagttgatgagagttttgatgtaattacagtagcaggttcggagtcttatccatctcaaagccagatggagccaagtaatagttcaagttacgcaaactccgctgtgcttggagatgaagaaacagaaagttcaacaaaatctcaagcagagagtggagtttctcaagagaacagcgccatgaattttgaaacaagcaatgataaaggttcttcggaaccactaccagatggtgcttctttataccaagatgaaacgagtttagcaattgatgatagcctaccggaaggcttaccaaacgccccaaagacaacttctccagaaggcgttatagaatatgggtataataatatacaagaaagttcagtagatgctaagtcatcagattccgcaagagataggtcagaatttagcgaccctgtaattatggaatcattagaaaatgttccagctaagacagattcttcccaggcttcatttgaaacttttgatggaagcattctggaaaaagagctcagcaaaaatctcaaacaaataaaaacacaagatcaacttctcgaacctttgacagaaaatattgaagtcacaggttctccattaaaaactccgagaactgattctctcagcgaagccagtgcacagggagcacatgcaatgcatgcagatagccacatgaaaagcccgcccaaatctcctgacgattttgccataaatgattacgaaattaatgtagaggcaaatccaatagaccagaaggaagtttcgcaggacccaacaggatcggaagtagtttttgaggatactagtgaatcaaaactaccaacatttgtaactaaggaaggagatagtagagcgtctcagttgggcgagtcgtcacaattgacttcaggcatttcagaggtttctgaatcgagttcaggaaacttgataaatattgaaagttcgagtttgttttcccagaaggagggcaaaaatacccataaaaaagatcaagagcagacacctttgagtgttgatatttcaaaaagtcaagatttttcgatcaaagcaaagaaagagaacctagataattcattgggttttgaagaaagtaagacttctgaaagatcgagttctatcggaaaactaaatactgccgattcaagtttcttgaatccaaatacggaggacatcacaatgattccatcatatactgaaacttcagcaatagctggccctaaccaggttagtcaatcagctcagatagaaccttcaaaaacggcctctatttcagttgaacctccttctcctccaataagtgcgattgaagagagaaccgttggtaataagagaatttattctggcccttatgtaagaactagcgcaacagctggcaaggtaagcccaagaattgcttccgtaattaacactttagtggggcaatttgaaaagctaaatctttatggagctggtaacaggaatgaggaggtaaaatctgggcagcagaatgtgccaaacaaatttgtttcttctatgaagagtaactttgataacacttctagggggttttctgattttgttcctcaaaattctcaggaagaagaatttatacaaggcttgaaaaacgaaccagctaaaaacacattcatattcaaaaacagatatgaagaaatgaaaaatacgcaaagcacttcaggtaagactttgcttcaagaagaaatcgaaaagctaagagggacttacagaagcacattatcaaaacaattcagtactggaaagacttgggaaagaccttctggtgctcaaggtaataataatcttttaaaggttacttattctggggatgaattcttagaaaaggttaaacaaattaaccccagatttaatgaagttgaatcacattcggctgaggcgaccaaggaggctgataacaaaacattgcaagaatattatccagaacagtctgaaagtgaggaaaaaactcgaattacagaaactggccatttcagcaagcaggaaagccctgtatttgccgcatcaaatcctactgaaagtatcacggagaagattccagaatctgaggaaacaactaatgaaggatatagtgatgctgagtctttctctagaagactagctactggatttgaagattctgatccaagtagtatggatgaaactcagctgaatttcaaccttcaaaaggctgaagaggattctattagcgataattctcccaagggtactcagaataatggcgaattaaatactaatggctttggaaatacgccattctcctatattaatacagtaaaagagcttcctgttggattaaagccgcaagacgctcctgctacagacattccagaagctattatagaacgtagatcacaaattgacggatcagaaggccaaactgatcaaagcgaatatcccaattataataaagaagcaagtatttcatactcaaaagacgttgaactatctcctgaacaagaaaaggagattaatgtttgttataataaagcaaagaagatcaaaactattaactttggactagatttaacagaaaacccaaatagtgtcgttactgaaacatttattaatgagttcaccaaatacaggcccaagatcagagaactaatcaattttgggcaagaaacacttagggttgcagagaaatataataagaaaaaatcatggagaaagaaaacaagaaagtttaagcttgagttccttgaactttctaatgaatttttacaacatactaaagctattagatctcttctacatcatttaattcaggttactaatccaaatattatggatattcttcaacaaattataactggacacaatcacagtaaacaaaatttacttgtgcaatgtaagattctttatcaagcattttattcctacaagaattctgttaggagtagattactaaagaagatctctgatctaaattttgttgaagttttaaataaccagatcaaagtataccttgagcaacttttcaaccctatagtcaaagctattaaatcaaataagtatcttaagaaaaagctttcaaaacaaattccggatgtaactattcttatgaatactaaccagtatccagagctttctcaaattggaggtggtgaccaaattactccaagctcaaagaaaggaaataaatttacaagattctttaaaaggttatttaaaaagccatcatgtattagatgtgtgaaatctaaaaaacaatctaaaaagcagaaatctaataataagaaatctaactaa

SEQ ID NO: 2793 - DNA, 129 bp, Cryptosporidium hominis
atggttcataattatgaaccagagagtttccaggtatcaaaaggagatattatattgcagatcatgtttattcacaatattaaacatcatgtaattgtctctccttgtgatggattcggttatacttta

SEQ ID NO: 2794 - DNA, 216 bp, Cryptosporidium hominis
atgatcttacaaaatattcttccaaatccttcatttgtcacaaaaaaacaacctttgattgtattggattcctccaagtttaattgggattctactgatgatattgatgattctaatacaatctccaaagtttactctccctcaaatgtgaagagtaatatcaaaaacccaaaatgtaagttgaatattgatcttcatatacaagtaattcgttga

SEQ ID NO: 2795 - DNA, 1068 bp, Cryptosporidium hominis
atggctccaaagtatattctttcatttttatgtttgcaatatccaacaggacaagtacaaacaaacaaaaagaccgattcagatggttcactagaaatatttatcacttccaaagagaattccatggttgtggatgttcctgattcagaatatgtacatgaaggagctgtattacttgggatttggaatgacaatactgtatttttaaggtttgaagctaccaaagagattcacaaggtcaaaactgcatatccaaaacctcagatgattggtcagagatttcaaggaggctcttctttggttattatagagatatctgcacctttaactcctcaaaatacaattcctgaaaatcaaacaagttatttttctcatgtagagcctctaagggataattctatatcaacactagagcaaagtgaaaaagatgaaagcaatagagaggcttcagttagtggttttgaagtggatcaaagtattcaacaattagataccagtcctgctaaattagatgaatctgttgaaaatgaacattttgaaagtcaggatcctctaccaacttatattcacacagataaagatgagttacaagaagttagtaatagtcgtattattccaattcatgagaaacagccaatagaaacagctctggataactctgctattacatatgcgatcatgatgagaaatcagattaaaaagtccaagctccacaacttgaacaaaaattttgatttagtaaatcaaaaggccaaatggatagtcagagctccttgttctggaaccattactagcaaaaagttaactcgaaacataaaaaaaattcttcaaggtacactttatgcgacaattcaatgtaacagcaaaggtagaggaaagggagcttttgaaaataaaggcaaagaaatggcattgattatgcctttttctatcaaaattaataaaattaaagcagatttgcaggaaactgagcaacctggtctctattcagctcaggtttccaaaaatcaaagtatcattactggcaaactaattaaagaatctaaggatattcctccgcatttaata

SEQ ID NO: 2796 - DNA, 252 bp, Cryptosporidium hominis
atgaaattatttttatttttattatatttggctggactaaaatttagtaacgctacagacttaacccgattatatgccaatacattttctgttcccagtgaaaatgagattccaattaagttaaggggtctggttgcacaaaacagcttagatccaatgcaaattatttttcaagacaaaataattccaggatcagagctagaagaaggagaggtaggtttaaattatatatttttagattcaaattcttaa

SEQ ID NO: 2797 - DNA, 2814 bp, Cryptosporidium hominis
atggaaattcaagagccaatggatacaaagatgattgtagaagaatctgcaaaagagacaaatatagttccaagtaccgaatgcaatactgataatacaaattcatctcttgaaactgggcaaaatgttgtggttagtcaaaaagatgaatgtacaaaactggaacgatcagaactggaattagactacgaattaatttgtattgacttctttttaagatatatttcaaatttatatcctttatggggagaatatggggataatttaatgtttcatatagctcaaatatacggagctatcagcaaggaagagtttagtccttatctaaaaataatagaatctattggattaaagattaacgagaagatgaagcctgataatagtcaaaaattgtctagtgatatgattcgtaaaatgaggtctagtaatgttactgaagattcccagggttaccctttagatattgagaattgtgattctcaagtttgtattcgtgcaatttctcacctagactcttatagggagtggttagatggaatgtttactgctgcagactgcgaattggaatcagtatctcaaatatcagaaagccttgaaggaaaaatcggtaagccagaaatcgagtggaaaccggctaatctatctggagaattagtacttccattggtttatcagacatatgtcactatggaagtgagacgtggaggagattttacacaaagcggtagacataatgaagaacgtggttcaggatctgagaaagctacgagtttgagcaatggagggaagccttgtatttcaaataattcaccatcaaaaggtggaaatgaagttggcgttacttatgagaaaaatagagatcgttgggttgcagtttggacggaaaatggcattagaaggagtcgaatttttaatgttaaacaatatggatatgatacagcaagagaaatggccattcaatacagaagagagcaacttgctaatatcaataataaaattcaaactggcactccagtacaagctactagaactaacaaaagaagcagaagatctatagaaggcacagggcgttcaggtagatcatctccttctgcatataacacaagaaattcggctatagatagtataaatttgcaaaatcctgattatgaggtgttttatgaccaagaaagggattcctgggtctgtaagaacttggtaaatactctggaacaggagactgtcttttctattgaagaatttggtgcggaaaaggctaaacatcttgcaatcgaaaaagcaggaggtttggccgatgagacatcgtttactccagttaaaaagacttcttccagagcttcagcctcaaaaggagctgtatttacaccaaaaagaagggattctcaaggggctgatgggaatgtattaaatgtctcaggagaaggacagccaacgtcttcttcatcatttagaataaggattgcaacaaatctttcaggttcaaaagctgaaccaggaacaggccaatcagctaatgggacacaaagcttttcttctgagcacaatacaggaggcagatcagaatcaaggaaatctgcttctggggaggagtttttggtatatcatggaaagaagtactattttggaccagtgatagaaggaatacgttatgacaaaattcaaaatagatgggtaactggctacgttgggcaggatggtaggaagcgttataagtatttcagtattggagcttatggatttgaggggtcccgtcagctcgctattgaatatagagaaagtatgtattcaagtacaaagggtgttgaaaaattaagtgaatttttacagactgtaatccagggattccctgcatatgaagatggggttctgcaagatgtctcatttgaggatttaacaatacataagggacagttaaaggatggatcagaaagatattatctttgcattccatcaaagggagattttttggtgacaactccaactgatcaggaaaatgaacaggtaaattctttactgaatagatataaatcagttttacaaaaccacggaggtaaggaagaacagatacttagggaatcacttttggcttgcagtagatcagacttaaaatctcccttacccgttatgcattccaactctgagtcaattggcggccaaaaaggaaaggatttacagactttaactgaaactaagagtgaagttaatgatacaactaaatcaaaagacgtagaaatggaggatcttgagaaaagagaagataatgaaaagttagtaaaagtacttggaagcttaacaaatgaaacagcggatcaagaaaccagacaagaaagattaatccaaggattaaaggaggaaattgacccaaaaataagtgaaagcagtccattaaagaccaattctggagcggaattggatttttcaggaaatattctagggaatttggactctccttcaaaattgggaaccccatcttccagaagttcagtatcaatgcatggttgtgatttaactacatatagtgactcaatgtatatagatattgaagacaaatcaagccctgatggtcgaaaaagattcttcattgggccacatattgatggagtctcgtataaccctacaatacatcgttgggttactcaatatgatatagatggtgtttctatgacaaagaacttcagtgtaaaaagttacggttttgaaaaatctagatacttggcaatacagtggagaattaaatataatggagaaccatctcagctgaatcagctcatccaagctctacgggaggagggaatagagtatcctccaaagtga

SEQ ID NO: 2798 - DNA, 1887 bp, Cryptosporidium hominis
atggaactggtcaatcttacaaaccagcaagctcttcaaacgttatattcaacttatagaagtttaatcacttcatttaaagaaactcaaaagtttgtgcaggatattcaatttcaaagaggaaatgtgccccaaagcctaaaacgtcgtttctacatgcaaattcaatttattaagtatatggaaaagcatattggagctttgaaggaatatattgaatctgataacacggatatatattcagcctcaaatttaccatatggtatttcggatttgaagtctttttctgagttagccaaaaaagattggattcattctcttgttgaagataaaccatatgaagaaatggatcatttttcattattctgtccactacttcataggtctgcatttaggcttgctttattagtggtcggaatctctcatagtgttctaggaaagagcaaagttaagcttccagatgcatgtttggcaatatctcaagtaaaaaatggttatgactataaaagctctattaagctagcattagcttcggtatttgtaaataatcagaagatttttgatatggatgagctagagttactatataacttgattgtggcttctgtagacgaaactattaatgagttcttgcttggaattcctgaggaatactttaactttgaagatgataacgagattactgacgagaagcttgaacgttggattgcaagagttgagcacagacttactaagattattattgaaccaaaagccattttaaataatatgtctctatttgatgtcgatatgatcatgcaaaatatatctccattagaagctaaacttcagctcttaattggagtctcaattagaagaattcacgaagccttggaggatttgacagatattgagcatgaaatgaggattatcaaggacagaatagagtttgccaggattcaaacagatagtagtggcgaaatttctaatactaaagaatacgattatttaaaaaagaagagagaagaccagctgcaaaaggtcattgatctcggagttgaacatgctggacattgtgcaaaagctatagatgtatttgacatttcagatagaccaatagttcgaaaagttcatcgcgtaattgcagtaaatacggagtttaaaagactaagtgttagctatacaaaaattcaacaagaagaatcgatctttaaatcaaacaaaattttgcttagaacctccattataaaccatagaagagatctagcaaggaaaatccttgaagaactaattataggagaaccttatagtcccaccgacagtagatggtatacggatctcgatgaatgttttaacaactcagtcccagatctcaagttatccctaaaagttgatccaaattatcctattgaacgatcttcaggttttactgccattaatacaaaaaagaaaccaccaaaataccatctagtttgtgataagaatcagttgagaagatttaaaatatttcaaccagatttagaggaaatattcaaaattgctgatattccacttatagacttcgaggggaataagcctcttgttgcggatattttaacattagatggatgggctcctttaaagactactatacatgagaaagaagaacctaatattccttgttctattgctaaacaactatttagaaaggttgtttctgatatatctcaaagagcaacggggggaacttcatactttaatattcctcttcttcatttatggtgtgctgaccatataagattcagaaaaggtaaccaggctatttggagaaacctcatacccagaatctggtccatttttatagaagaacctctggacataaacaatcttagatccaataaatggatgattagaaactggtttagataa

SEQ ID NO: 2799 - DNA, 918 bp, Cryptosporidium hominis
atgtctatgttagatgcatgctatatagtatataacttaagagatggatacttttcaggttgttcagttgcattggaactaacaattaaagaaaatgagaaaattaaagataatagcttagaaatttgtaaggaggtactgaaaatagccaaagaagatccggagatcaaagatttggttcatgaagcgcatcctaacgatattagtaatatcttggagaaaattgaatttgctgttaagatgggaatggatgaacagcccggcggcccccccccctcgctgccgccgtctctccccggcccctgtacctcggtttcctcccccccctccctcccccttttcccccctctccccccttctttgcgtttgtacgcttgccgtgtcccccgtctcgtctgtggcggcgtgatgggtttcttttcgcgtcccttgccccgcctccccgtccgtggtgtgcgcgtccggggcgtcccgggttgtgctcccgccttcgtggcctgggtgccgctctggttcgcggcgtcccctcgcgcgtgtacgctcggttccgcttcaagtgggagggggcgccgcgccctcgctcgcaggcgtcgtggttgtgttctcctggcggatcttacgaggggcgggccggtcgtcagcgccctcgacgcgttttcaccccccgcccccaccccaaccctcctcgcgaagtcctctccggaccccgcgccctttatggtccccccccgtcctcggcgacggagggttttgcattgcgagccgcggccgcgactcgtgccatggagggcggtggcgaagatgggggtttcttggggtctcgttggcgcctcgcggcggtccggagtgtcgtgtgtccggtcgcggctgtgtctccgccgccccgccttgtggggttacggccgtcgttgctgttga

SEQ ID NO: 2800 - DNA, 1698 bp, Cryptosporidium hominis
atgaagagcatatttccttttttttcaatttttttatcattattaaagcattcatttggatatcaagctaaccaaccaaatgtttcagagtacaactctgagcaaaatctcttagcagctctttgctggtctctacccttcaaatttattaaatgtgatatcgattttgaggaaaacgtattagaacatttaaaacttgaacttatcccaagatacaaagtttctgcaactgacgaaattgtttataatattagaatgcagccagtaacaaacggatacttaacaaatgcaattctagcagtaagaccagtttatgggttgattatttcaaatgaagttggaaatcctgttcttcaaattccacatcaactcaagcattcatcaacggcgaagtttggattaccacatcaagcaaaaaatgtcttctcatctgtgaattgtgttcttatgtactccaatattggagaaggtttttactatattcaccctggaaagagtgaacataagtcaattccaagatctgtaccagaaaacataatgctaaaagtctctacgaagaaaacaagtactagagaaatgttttatatgactttgttatcaaaccaacaattccccacaaaacctacagctacctatggtgttgggacggattttatgataccttcagtagtttgttttgggactaatgagaatctaagccaacaacttcatgaaagtaattcatatctgggaggaattttgatccaagaacgaattatgggaccttctctaagggatgttatcaaatttttcaaaagtagtgcgcttttgaagtggctaaaaagtacaagaactgacgattttaattataaagctagaatttctctccgattagaagctcagtattccttggctcattctctaattgctgcaattttaactttacagcatcactcagttgcaggtagggttttacactgtgatctaaataccagaagtatctatcttgatcgtatagtttggagctggtcttctaggaagattgaagataatttgaatgcaataacacaactgtccccatctaacttcaaatttattaactttgggtatatgaaatcaactctcgaggtatcagaggagaatttaggctgttctcaaactgataatgatttagttagagtacaagaatttattaagactttattttcagagcaaagcaatagatcagacttccctgaaagtggaagcataagtagtggtatgatgacaatgagtactggatttaaaatgtggtggaatgaagtagttaattctgttggagcagagtccactaatcaagaagtcaatgagcaagaagttctacaagttgaaaatattctaaggactatttatacagataattcagttatatcaaatcttgatagaacagccaaattttctggtattgttgcaggcttgaaggcaattcacgcctccatcagcaaggcatttagatatctttatgagcaaggatatggtagaactaagaaaagggtaattcttggttggtcaagcaaagaccttgagcctgagcctgccacccaaattagtggtactgtcagaagaatccttagtggcaagaaaattgaaaattcttctaatatgaattcttctggtatagatccttcagattcagctgatttggagctttctgctgaatctattggaatctctagctag

SEQ ID NO: 2801 - DNA, 2100 bp, Cryptosporidium hominis
atggacatgtcaatcaatataaatttgggaatgaatgtttcaaaacaagtaacattggtagcaaaaaacttgacagttgaactcaccaaacgtgataagtttttccgtaaaatggtggttccaatcctaaagagcgtgaatttcatggcttctccaggacaacttattggaattatggggccttctggatcaggaaaatcaacattactaaatgctctttctggaagactcaaaggaagggaatataatattaagggttccgtggctattaatggatttactgatatagatctagggtatttaactagaatggtggtacaagatgattacttacttccttatctaacaattaaagagacaatggacattgtagctggtctaagacttccacattattctaagaaagatcgtgaggaaaagattattgaaatccttgatattatgggactcagacatgtacaagatacatacgttggaggaatttcaaagaaaggaatttctggtggtgagatgaaaagacttagtattgccttggaattgattcagaatcctccaatattatttttggatgaaccaacaacaggtttggatgctgctagagctcatgacttactatcatatctctcgtctctcgcccataccactggaattattgtgatttgttctattcatactccaagatcgcagacttttgccttgtttgataaaattactctcttgagtagaggatttgttttaggacaaggatctccaatggacgttgttaccttctttaatgatgttgttacacccttccctgataactataatccagcagatttcattatagatgctacgtctcttgttgaattagtacataagaaagtaatttcagcctccatatatgtacccaaggatgcaactataaaggaaattgaattagctgaacgtaatctggatggagaagaaccactttatgagtttgaaaaatcagtatcaagagatgatatttcaatgaagctatttggactggaagttccctctattgaatctttggatgagttccataagatttatgaacaatcagtatatggagaaaatgttaagaaaggcatcgataatcacttgagatgcgttgatacaagcaatcctcaaatcttatttgagaattatggaaatattgattctgcaaatatgaaaatccttccaactcagacaatttgccaaaagattgcaaggttatcaccaatcccaggccctatacgtttctgtagagaggttaaatatcttacaaagagaatacttctaaatacttggagagatccaaatgtaacagttggattactacttgttaacactataatggccattatcatgggaggggtcttcttttctctcccaagagctggagaaaacgattttgatactgctcaaaatgcaagaaatatcgttggtttgatcttctttgtatcaacaagtatctcattcttttctattaagggacttgttgtaaccgttgatgagcgttttgtaatgaacaaagaaaccttttctaagatgtatacccctatttcttactatttttcgaggatggttgcagacttcccagttcaacatattcagacattggtatatacaacaatcatttacttcatgactggagtttatgatcagaatctcaaaacttctttggctgaccagtttggactttggactgcttctactcaagctggagtatttctttcatactcattctcatacgtactttcctcgttcagtacgagtacaaatactgtattccagattttcccactcttcagtttagtttttgctttacttacaggttactttgtaacatttgatcaaattcctgtttggatcagatggttaggatggatatccactgtaaggtatacttataccggtttgatattatcagtattcattccaggagagagattctcaaaagttactacagacttcttcctagatcaatttgatctctggacaaacgatatttggcttaacattatagttgctatttgtttgggactcgccttcagaattcttggatacttcctaactgcattcacattaaggaactataagattgcaagctag

SEQ ID NO: 2802 - DNA, 1461 bp, Cryptosporidium hominis
atgaagctgctaataaggcttgcagttttacttggaatattagtgggagtgtatacaaatgaattgaatgatgatattgtaaaagaaattaatttagatcaatcttatttgaagtcagttattgaaattgttatggaccagtattatttcatgtactatcatcagggaagaagaggaggaaaaggaaagtggtcaaatggaataggtggtctaccatctccaagaatagcgaaaaaatatataatgacatttgttcagagtgatcctgaggataatttatttggaggtattagtttgaaattttatatacgaatgtgtacaaacctaataaatcatttccccagattgcaccatggagttggaggaggtatcttaattgcaatccattcctatcaggaagaagaatataccatagtaagaggattttgtacagaggcaggaatgatgcatttctttaaaaaagaaatggaaagtttgattcgggaatcttctaagccaaattctttgatccctcccttgaataaatcaatttttgatcagtataatgttggaggaaattgggacgattttgtagagaattgtgaagatctgattaaagaatttaaagaaataaacattaagagagacagttctagcaaatggtcaaagattgatttctcagaaatttctgacttttgtgaagaggtttctgatgatatttatccaaacttcagtcaaagtcaaaaggaatggaatcatatttatgctctccaaaactacattattgaaaggaagggagaaatgagagctccaatcattggtatcccttccaagaaacctgattactatgttgctggaaggcatcaatcatcaatgtatagaaaatgtctaagagcattatgggatatgtttcaatatgatgatgaaattaacttaaaaatttctggaattaatcaatatgaaactcttagaagcttttgcaatgctgctaaaaattattataccagaaatggcaggatttctgcgtatccaatgattaatattggtgatcctccgagaaaaagaaagttacctactgatgaggatggtttggtgaaacagattttgaagaaacaaagaaataaagagctcaaagaaaaattattaactatgcaaatgaggaataaatttgaaaaactccaggaagagaagatcaagagaagaagagaaattaggaagaacatcaaaaaatcaaaggtcatgccaaccactcccgattttcccctggaaggaatcctatcccctgaagaaaattcttctcctgaagagattcaagatactataaacattctaaatgaacttcctagcacaagttttaaagaagatggccttctagagccacaaccaaatatttctacaattgaaaaaaactccgaaagcaatgaagaattggacaactttggattagaagctgctaatgaagagtttgataaattattataa

SEQ ID NO: 2803 - DNA, 1038 bp, Cryptosporidium hominis
atgtatggaaccaattttaatgacctccaaggagtatattcaatggtttctccccttcaaagttttagaacacctcgattggagaatcaaaatcacaataatttttttcctgaaaataaaaattacctacaaattaatactgagagacaaattcattcaagtaaaaattttatagatgattctaaaatactaacatataggtcaggatcttttatacaggctaattctcaagggtacaaaccaaatgaaacattccaaagcacgaactattcagacaatacaactgtttctgaaagtcaactttcttcaaaccaattttttgaatcagaaaatgatagtttcatttcgcagagtgtaaaaccaagcaagaatttagtcaataatgctactaataccttagataacaaatctgaaaatgaattaaaacaactaattgttgacccaaaagatctttcttccacaaaaattgaaaataaaacacataatcatatagaactagatttgaaaagcccaaaaaatatttcattggaagaaatctatgaaactgaacaatttgaccatttctctcaacttattagtgaagtaaatgaaaaaatagatgtggaagaaataaaatataatactgaagatataaatcataactttgacaaggagtcaattatatcctcaagtgatactcagggatgtatggaaatatgtatcactcctcccttatcatcagaactaattacatctaacaatttttattttccagaagataacaaagaagagagtcagaatggttcaattttaagaacaaataaagatttttgtgaagaatttacagatatggaaactcataaaagtgatattctggagaatcagaatattctaagcgagagtggaaaaagaaaattcagattttcatcgttttgtcctaaactgctcaactgtctatttccatggatacgttctgaacaatattttgaagatcacgaccaaccaattttctatatcgtgtcaaataacgaagagtctcaaaaattaataaataactag

SEQ ID NO: 2804 - DNA, 960 bp, Cryptosporidium hominis
atggaaataaataacgaattgggaaaaatttatgagaagctacgtgatccaaaatttgtagataaaagcaacttttttcatctaatggcttcaacattaaaaacagacaaagagagaattaaatcaagaattattcatctggcaggtgaaatagctgagacagaagtaaaatatagtgatgagacaggaatcttaattcctaataatgtaagaaaattagcagatcttcataaaattaactcaatctcccattcagatattctaaaattaaaaggtgatgattcaggaatggatcatagtcaaagaattagagagttagagggaaagattaaaagcaataatattgaaatgtataaaataattgaaattgaaggaaatgatttacatgatccaaggtggtattctagtatggagaaatgtttgagtagttttattcctagaaggaaggaagtaaaatcaatagagccaacttcaggaattaaacagttttatcttgtttccaaaaattatagttatatggattcttctccaaaatgtacaaattctcaacttgaaatgtacaaatttgtagttaaagatttaaggaaattgtttgcgaaccttaatattccattaattaagattagaggaaaaaagctagaaaatgttaaaaaacatggacttattgacccaagacaaatggaatactgggaaaatttgcatgggatgctatatgaagataataaaactgcttgttcttacattaaaaatttactaatgaagattgtcccagttagaaatcttgatttaaaagaatttatggattctcccatttttattatttggtgtgctaaccatataagatctagattagggaatgaagatatttggagaaatatctttggattgatttgggttatattctatacaaaaccattcaagccaaaggatttcgtttggaaaaacatattgcttgtttaa

SEQ ID NO: 2805 - DNA, 1629 bp, Cryptosporidium hominis
atgaagtttcgaaatttatttgtctttttaatttttcttctgagctcaattgaaataccttcagttgactctaaacgaaaaaaaccaacaaaaattgaaatagaagatgtttctggagttctctctagcgatttatatggtagttctcagccactagatttgagtcaaacactttatggatcttctatattaaccgaaaattatgaatcaagtaatttagaaacttcttctcgtactattaatttgaaaaatatagaatctatttcccccacaaatgacattttcccactaagaaacaaagatataaaaaacctgtatatgaaatcaataaatgaaaagaaggtaggtgaaattagaaacttgaataaagatattgctgaaaactacccaaattccaatattttatcgcgaaacaaaaatggtgaaataatttccgatactgatatctcaatagtaattagtaaacttgaacaaattaagaaaaaggaccttccttcaatagaagaagaagaacttgactcagaaaaatctcgtgatttgaaacaattggaagactctaaattcttatcagaagaaattttaaacaaatttagcgatatttttggaacttttttaaccattccaaaagaaacaaaggctgatatattatttcatatacacaagatattggaagaatcttcagaatctctttcaaatttacctgatattttctatggaaacggtattcaaattttattacaaccattcagcgacctttcaataaatccatctgaaatacttaaaatatattcttcactttttgaagagaactctgataattttatgatttttcttgacgtaattaattatatacttgtatcaactctatcagcttcaaaagtcacatctctagctatctcaagacatctcaaagaatctgattcaaataattcaaattcgaaaaaattatttaaacaaaattcttcaaacttttggtataacacaatatgtcaaacaatacaaaacattgagttattaactgtcatataccctttcttaactcctccttcatataaaaaggttttgacccctgtagaagtaataagtactccgaaaaccccaacacttggaggattcaaagaatatcttgaaaaaagtgctgaagaaaagaaaactgaaatgattgaaactagtaatactctaacccaagaactgatatttggaggttggaagcaatcaataaatcctatgggacacaaaattacttcagatttcgttagtacaaaatcattatgtattaaatttaatttaataaattctaaaaaagaaaatattgatgatattagtgaatcttatcagattagaaagtttaaaggactattcagagattttaaagatgatgaagaattaacaaaacatgataaaattaattatttgaattctattggccttgagagctcaagtataaaactttcaacagatgaaagacaatcaatcattacaacaagtacaaattatcttctagaaatcgccaatatcctttcagaagttgatcttttatcaaaatgttattcttttatatcaaattcaaaaagtttagaaaataaaaatgttttgaaaatggatcctgtaagtttaaaaattgtttaa

SEQ ID NO: 2806 - DNA, 2343 bp, Cryptosporidium hominis
atgaagatactttttgctattctttcaattttgattgcttttgaattctgctctgtcgcaagcaacggcttggttggaaaaaaccatgttgatactggtattcaatttttctcaatagaaagttctgatttaaaaaaactacaaaaggtaataaaggctgcaaataatggaacccataacaagtactacagtggcttgaaactttcccccacttcttacttccaaaatactactagcactgaaatgttcaaactcattttagttaatggaactgaatacgctttagttaataatgaaaccgcttatccaatttatcctatggatgaagaatctatgcttaatgaaatacaaactatcggacttttgattaatcatacaaatttacagaagaaagatgttgaaactcttgttgttgatctggaaacaatgactgatgtgtcaagtggcaatcatgttattaaagataattttaataatttcaatatattatcagatgatatcttgctcaaaaatccttataaatatattgatgattcagaatcatctgactcttcttgttgttcttcagattgttctaagagttcagattctgaaggtgaggattctaaatcatcttgcgcttgttgttcttgctcaagatcagggaatacaaaggaaccaaaacctgaaaaagagtctaagtcgtcatgtgcatcctcgaaatcagataaaacaaaggagccaaaacctgaaaaagattctaagtcatcatgtgcttgctctaaatcagataaaacaaaagaaccaaaacctgaaaaggagtctaagtcatcctgtgcatgctcgaaatcagataaaacaaaggagccaaaacctgaaaaagattctaagtcatcatgtgcatgctcgaaatcagataaaacaaaggagccgaaacctgaaaaagattctaattcatcatgtgcatgctctaaatcagataaaacaaaagaaccaaaacctgaaaaggagactaagtcatcatgtgcatgctcgaaatcagataaaacaaaagaaccaaaacctgaaaaagagtctaagtcatcatgtgcttgctcgaaatcagataaaacaaaggagccaaaacctgaaaaagattctaagtcatcatgtgcttgctctaaatcagataaaacaaaagaaccaaaacctgaaaaggagtctaagtcatcctgttcatgctcgaaatcagacaaaacaaaggagccgaaacctgaaaaagattctaagtcatcatgtgcatgctctaaatcaaataaaacaaaagaaccaaggcctgaaaaggagtctaactcatcctgtgcttcttgttcttcttcgaagaaatctaaaaagcgtagtggcaaatatgataactcaggtattttaatctatacagatgaagaagaactcacaccagcaactcataactgtaattgtgaatcgttatccaaggagattggctctggatgtaattgtagtaatgttgaaaatctctataagaattacaaggaagctgaccaccgtgcattaatggccgaagaaggcactcaaattaaaacaaacaatggtcatgaatacaaagttaattcaggttcagtaggtcaaattatcgaagttcccataacctctcagcctgtaaaaccatatgataaagtattaatagtcgtagtcccatcaagtgatttaaataactcaactcagaaagctacttatgaattattttatttcaacaatactcaatcatacaaatatgaaaataatactagaaatgcattagattatggtgacttaaatgacccaggatttattattagaattgttgatgaagaaccattatatggagtttctgagacacaaagatctattagatctcccactactactactactactaccacaaccaccaccacaaccaccaccaccaccaccaccaccaccactactactactactactactactactactactactactactactactaccactactaccactactaccactactaccactactaccactactaccactactaccactactaccactactacttccaccactacttccaccactacaaagagttttgtaggtccaattatcatcccaatttacacttctactactacaaaaaccactacaactcaacccgttaagagatataccagttacttaagagggcccgcagaaagattaccagtttccaaaatttggagagctactccgcctgaaaacagaccagaggactctgtagtgttgactagaggtgcagaggaggaatcagaggatattgttttaagaccatctcgtttcccaagattggtgagattagattaa

SEQ ID NO: 2807 - DNA, 2160 bp, Cryptosporidium hominis
atgagagttttattatcactctttttgttcgccttcttgaaggcaatatatgctacagatcatcgaggttttctcaccatatcctcaccatgcgatggcaatctttcatttagactgccattgaatcactcctttgaaagatctgacatcattcttagtggcaaatgtttaaatggtatcatctttacagctatggcactcgatagtggtgtcatcaagggctcagtaatccctgattcttcaggtacaacagttgtaacaagtggtaatcccatttacactgttcagacaactgcaacttttgagttcctttacagaacgattgacccaagaattaaagatgcaccatacaaaatttccctcatgaaatacacttactctgtattatcttctcaaaacaaaatcaattctgtgttggttcgtgaacatacttcagaggaatgtaaattcccacagattgacattgaagactctaatctctgtacattacatttattacttaagaagtattctcagaacagaagtggttcaccaaactccaaggttgatgcaattctccttgcagaattggaacaatcaagttcttgcttctctggaaactctgttgaatgtactagcgagttacatgtgaacaaaaatagctcttatgaagatttggccaacagcttctcttgcctatttgatgaatcaacagaatgtgtacctgttgaatctggtactcagactgaggaaactggtatggttgatgctgcaacacaaacaattccaatagttactctgacttcaactgctaaaccactctcaaagagtgaacttaaggatatcgagagattggaaaaggaaaaattgaaaaaagaaaagaagttaatggctaaacaggagaaggaaaaacagaaattacaaaaattagaagataaaaagaaaaagaaagcattaaaggaagcagataagaagtcttcatctgataagaataaagccgatgatgctgaactttcgaagaaacaagaaaaggagagacaaaagagattaagggaagaggaaaaagaacaaaaaagattgaaaaaagaaaagaaaaaacaaaaattaccaaaagataatgagaaacagaaattatctaaagaagagaagcagagacaaaaggaattagaaaaagaagagaagcaaaaacaaaaacaattacaaaaggaggagaagcaaagacaaaaaaaattacaaaaagaagagaagcaaagacaaaaacaattacaaaaagaagagaaacagaaacaaaaattgttgaaggaagaagagaagcaaagacaaaaactattgaaacaacaaaagaaggaggcatctaataatggttcaaaggataatgttaaaccatcaaatgaaagtgaggagcaaaagaagcaacaaaagttaaaagagaagcaagataagaaaaaggctaaggcagaaaaagaattaaaggagaacgaagaaggtgactcatcttcatgcagttcaaaaaagaaatctaagaagacaaaaagtactcagactcaaggacctgaattagtgtctgtatctactcagacagaagatgtcatagttttaccagccccacgcgaagttgaagtaacttctgatattgaagacaatgaattcgaatattctaatcaagtttaccatgaagatgatatagttattgtagatgaagcttctgatgaagattcgctcaataaagtcaatgaagtttacaacccagaagttgaggttatttccctatctccttctgtgactccggtcgagtacattccgtcatctaccagcactactactactaccaccactaccaccaccaccaccactactactactactaccactaccactaccactaccactacttcaaccactactcatggtctgaagcatactagatactacaagaagcctgaagatgtaaaatacattattggcccatttgccagtttagtccagaaaagaggtcaggatcctagaccaactccaagcaagcaacctaagcttctttcaaaagatgtcgaatctcgtagcttcatcgtagagtcaaaggatttagatcacaaaactagtgcaaattcccaagcatcactagaagaaattttggaagatgcagccaaaaacagttttatcacgattgttagagatgagtaa

SEQ ID NO: 2808 - DNA, 1875 bp, Cryptosporidium hominis
atgtttcatgttatacaaaaaaataacgcttcttcgaaaccccaagaatcaaaggaaaacaagttcaattttatttcagaaaaattccctccaaactaccaaagtaaaaagatttggaataacggagtattgacaaaagtttgcgcagacattacaagcggaggtatgattaacaatattggatttggatttgtgtttccttttcagccgacatcaagggaggaaattagtgattactatggattttcttctgaaggaaatggagaactggatgtcgactcaaaagaatttacttgtccaggtatgcttcattcaccccgtgctcaattactctttagcaaacaaacagaagaaattattatgactggagagttacgttcaaggagcaaacgaactcttctaaggtctatcaacttcagatgtcctgaaaaaagtgtaataaatagagtggaagtcgcatggcaaataattagaggatcagaatctcttatgaaaccggatcaaatatttaataataatgctaataaagggccacttggctctataggagcgatgagattcttttgtagtgatggaaaatcggtttttaaggttggatcagacgctactccaactcattcaaaaagtaatctggaaattcatgaagttttattaggctacaaggaactaactagtgatgaaatcagtgccgttaaacgggaactaacaaaagaaagttctatcaaagttacggaggagcttttacgaaccctacctggagatccagttctcttcaaacttgtccatgaatcccgacccctttcaaagatacaattagaaattgaaggtgttaaatcatatagctcagctattgaagctttgaactctttaaaaacgagatcaaaagccagcaatcacaaatcaagaatatggagaggtagccgttggtcaggagtttgtattggcttactcaatcttggaggcggaattcttaaaaaccatgaattcagtattgtttcctttggatcctactttgaaaaacctcctccacttgctgtcctaccttataaaggatttattcaaactggaatcccacaaatacacctaaataaaattgtttctacatgtgatatgacaaatcccccctcctttggacttaattttcctggcttttctgctgcatttctttgtccaaatgggactcatatagaaagaattgggtacagcacacatgaaaataatagcaaacaaggctttgaaattttaaataatggtacacttcctctcccccatccattcaaggagcagaaacatgtcgggccacttaaacaaattactgctattcagttgttctgcagcgatggaatatctacggttactattggccaaccatctaaaagtacctctattagcaaacccggagaaattggagaaattaaagttggttatataaaggctaactctagtttattagataagaaaatatcaacgacgtcatttctagtacctacaagctttgaactaatatcaaaggataaaagacagagacttcttaaatattccaatcctaactttcctgagtatacgcaaaaaatatctacatgggaaggagaagacttacaggctgtttgcgttgacttcgctgtaattgatgatgcaaagcgttccaacaaaggcaacaactacttaagatgggcaggtagcgcaatcaaatacccagaaaaatatctaattatgagtattggatttgcatttaaacgaaaaattacaaggaatagatctacaggagctgaagttcctcagaaaaaaattaaaattgcagaaaatattcccaaggtaaaacttcaacacaaggcatcaatcaaaaataaccctcgaagtagaaaaaaaatctaa

SEQ ID NO: 2809 - DNA, 1491 bp, Cryptosporidium hominis
atgaaatcactttctttattatcagttttcattacttatttcctagtaatctataccgtctctgcaacggaattagattcaaccaaaactgttgtatccgcttctccagtaggatctaaagatattagcgtagagaaatctggagaggttggttcaaatgaaacttcaacaatggctcctacagaagtatctaaattagatggggaggctccaacggcggatcaagatttaggacatgaattgattgattcaagcggaaaaagttcagttcccacatcaactaaagaattagacttagagagtgatcctgaatccaatatttacactactgaagttcataataaggatgaagttgaggaacctattgggcaatctgatgaagtgatgactttagaagtgacttcattcactaaggaagatgagactccagccagtgttgaggtatctcttgacgaagtttcaactgcttctgagttatctggtgatgaagtccaaactactgacttatctggtgatgaagtccaaactactgacttatctggtgatgaagtccaaactactgacttatctggtgatgaagtccaaactactgacttatctggtgatgaagtccaaattactgacttatctggtgatgaagtccaaactactgacttatctggtgatgaagtccaaactgctgggttatctagcgatgaagccccaactgttgctgagttgtctagtgatgaggcatcagccactattgaattatctagcggggttgaacaaatatctgattcagcggaaaaagcaggcgaaaaggatcaggaagaaacgcaagaaagcttagttttacacaaatatgaagtgccgttaatatttgcatgtgaaacaaagaagttaatttgccacaatacttcaacatctaatgcaatcacaattcaaggatctagaaagggatcggctttgttcgcaagtttcgattctagcatgattaggaactctggaatcaattcaggagatgttgtttctgctacacttattttgaacaaagtcggaggtacaagaacattaccagttcgtgttgatattttgaacttagaatctaaatcatctcgcatttccaagtctacagttttggctacttatcgaatagttttgccaaagactcaaaattctccagttagtgttgatgtaacatcggctattcgtgaacttttggagaatgctaaggaccgtgagaaattctccattttggtttccgcttactctaataccagatttggtgacattcttacattcccgacaaaggactatccaaatgggttagcattagagcttagccttacaaaattaccagaaaaattatctagctcattagattcaacagaatctataagggaagttcaatcactaagagagcgtatcttttctggtcaaaatttatacatcgcaatgggcattcttgcgacagtatcaatcatagttattgtattgatgatgatgtaa

SEQ ID NO: 2810 - DNA, 3810 bp, Cryptosporidium hominis
atggagagaggtttgaagatgtttcttaatggtaaaacatgtttattattaacagcatgttttgcttcaacattatcagttgtatatggagcaattggaggttttccaacaatagattttgtggaagccccattagaaatatacactccaaaaaagccgtcccttgatgcttttaagacaagaggcgagcttgcatacagtagtgcattagcagcatctcaccaaatgcaaccaggttttgatggtcttccagatttggatacaacaactgaagatggcatctactcaaagagttcaagaactgttgagaggattcaaagagcaacaaaatttgaggttgagattgcaaagattttgtactggagaataaaaactgatacggaattaagtgcatttgatgtatctcttactattttggaaaagttagttatggaccttttccgtaagtatgggtttaatgctgctacttgccaggctttgttagtgagggagggaattccaagtgaaaaggccatcgaattttgttataacttagagcccttcgcattgttagagtgccatgctttaacttggatagacttttcagttgtaatggatattaagtttagaatgaagagaagaggcatgtttttggaaacaaaggatgtttgcagacttgttgagagaattaagccatctttaattcctaagccagagagaaagtcaatctttgggaaatgtcaaactgttgtaaacagtgagctgatgaggaagtatggtgtaacaaatatggatacggatatgatttgtacagtaatggattatactattcagccagcctgcgcagatctttctaaagatgaactctctgaggtaatgaaacttggtttacacttgggtgattttatttatccaagattattcccaatctttgcttccgatttgtgtatcgccagaaagatgatgaaacgtggaccaagcagagaaaaatgtagaaatgcattagtaagagtattggttgagagagctgatgaatatggtaactcagtcgttgcagaacaatggccattatatactgagatttggagatcatgtgcctatgtatataagagaaaagcaaccggtggagaaaagatgagacttgataaattatttacaagaattgcatttggatctatttggtcagacaaaaaatataggggccaaagcgttaactatcctccatcaaggtttgcctatcttcatggagaaactgttgaagctgctccagatgaatctgagattgattcagaattagatttaggttcagacttttcagattcagcaattgaacttgaacatggctctaagtccgatggtacaattgagttaagtgcagatgttggatccgaatcctctattgatttgggctctgacatgtccatcgagcttgatgaaggaaaatcatcagaaggtgttgcactcagtgatggttcaagcggtgccggcgtttatggtccatctgttagttctaaatatcacaaatcatcaagggaagcagcaagaaaagcagttgcaccaagagagagatggatatcaaaaacaaaagctttggaaactccagatcaattcttgtggtctacaagacaatcagttgccttaaactcagttcaaaaagtttgggcacaaatcttatactcattatactctcaagaaggtaataaagcttatggcattgaagattttgagattattgcagctaggatcgatccaactaatttacatagatcgtgttcaagacttattttcgcaaagattaagaaatacccaggacatcaaaaagatggagttggttctagattctctgagacaacaattgcaaactggtgtgcagctatagatggtgctagaagcaaggcatgccagagcttatcagtacctgctcaattgtggtcaaagagtattcttaaatctatgactttaatgagagatgaatcaagtttcgcaattgatttgagagatatttgcagatttgtaggtaaagttgagccatggatttataccaagagaagtggattcactaatcattgtataagcaatctttccgagccattgtccacagcaaagcactctagtcaaatttcattcttagaaaagtataagttgactgaaaaagaatctaagcaaatgtgtttactcctcaagcctgccaatcataaatcatgtaccaagctttcatcaggagatcttacccttgcttataaattggcctttgagttaggaaaaatacataatggagacaagaaattacaggtaacttatgattctacctgtaaagttattaacagagttagtagggttagtaccattgagcactgcattcttgcaactgctgagttcgtaggccatattgctgttgacagcgatgttgctggcaaggagtttgaaaccggtgtagctactgcatgtggaaaggtatttgaagcaaaagagcctgaagaatcagcaaagcttgtcagctctattattgaggatgtttattctgacattgcaaaacacatgccacctcaaccacaagatttcgatgtcattaggagaaagattgttattggagatgaactcattgaagaaacaagaaacattagaggaactagaggttttggtcaaggcgctacaggagctagattatactcaccaacatactttaaaccagctgctgcaagcgatgaagaatactggactccatttggaatagatccagctttacttaagaaggacattgattctggaattggagctgcagcaccaatgacagtcgaacaatattatgaaaaatctgagttcccatcctctggattcacaatggatattcaatgggttgatatcagcggagtcggttttaagaagtcattagcagataaacttaaggatgagtttgttagaactgcacctccatcattggttattgaatcatcaaatataccaaactttacaagtatcgttgatgagttggatttggcaccaaacactatttatgtcagctgcgttaaagttcttaagagacatagagtgcgatctgaacttgctcaggctgtatgtaagagaattgatccatatgcaacacctgcatgcaatggtttaatgattgtattgcttgatcatgccgaattcgttcactcttatttcacatcattagtgaagaaagaggcatttgacttagcagacttctgtaaggtaatgcatgcattgggtccattctctgataaatctggaacaattggaaacatttcaaatacatgtgttaagagcccggtgatgttcaacttccaaaagaagtattccttgtcaaacaagcagatgaccaagctttgctctaaattagatttcactcgtactgaatcatttgccagattaactagcccacagagagtaagagttatctcttcatcaaaggctatttcaatattgatttccgataaatatcaggatgtctataagaaatttggtggaatattttgggcaagaaatattccaagagtctcaattacaaacatgatcaatttgatttctcatactggtaatgaatctcctattaaggagaaatgcgagtatgaatgccaatcaggaagcccattcttcacacgagtcttaccagactctgatatttgcttcaaatcatgtatggcattctcaactttggatggtcaagttcatgttgctgatgaagcagcaggtactggttcaccttcagcaattggcttaagaccaagaacttacgaatcctatgacagatatggctctagccctgataaaccattaaaaaaagttgtctggtggatggctgaccaataa

SEQ ID NO: 2811 - DNA, 1932 bp, Cryptosporidium hominis
atgcataccgataagattgagtcaaaaccagcaagagggtctattttccctcctaatgcggatcagggagtttatttggcagcaacggacatttcttatcaaattacaagtggcgtttttgaacaaagcactgcaagaatattgtcaggaataaagttctttgctgagccgagaactatgactgcaatattgggtcctagtggatcaggtaagacttctttacttaatatcttgtcaggcaggctttcttcaactggtaataagctggtaggaggatctatatatttgaacggaaagaaggttacaagcaaagatttaaagtcccgttgcagttatgtgatgcaacatgaaatgactattccatatttaacaattgaagaaactttgctttactccgcagaattgagattgccttttttgtctgcaaaagaaagaagagaaaaggttagaattttgctaaatgatttgggtttagtacattgcatgcattcaattgtgggcgatgataaggtaagatcaatctctggaggtgaacgcaaaagagttattttgggtactgaattgattagtgatcctcaaatactgtttattgatgaacctacaagcggtttggatgcatttatggcttttcaaatcttgcagttactaataaaattggcaaaaacaggaagaacaattatttgtacaatacatcaacctagaactcaagtatttcaggcatttgatgaaattttattgttgtcgaaaggagaagtcatttatcaaggaccatctaaatcttcagttgattatttttccctaattggataccctgtaccagaaaattacaatccaactgactattatctagatttgcttgttccaagatcaaatgtggaaaaatttgctgacaaccgtcttcactccattacttatgaacaattgagagtattgccagagttgtacttatcatcagagtataacgatagggtaataagaaagatcgatgaacatttgagtagacagtattccacaattcctgagctactattgttttcaagaagtagccatacatgttttggatggataagaaagaagctatttgcttttagtgttattgtaaagaggtcttttatgaataacgcaagaaatactttaggttcattggttattggtgttttggtaaatgcttttattgcagttgtaattggaagtatcttctttaatttgccttcatttagcgatgatattggggttacctttaaaaatgcaactaacattatgggggcacttttcttttcagtaatgattgcaacatttggagcaatgatagcattagaatctttcacaaggttcaggataatattctctagagaaagagcgaaaggattatatggccctgcaacatatatgctaggtaaacatgttggagattttatctttgaaattgttccaattttggtatttagtcatatattctattttatgagtaatacgaattctgtttcgtacccaggttggaatactttaactcaatatctatgctatcaattaactattttattaacttcctgggcaagctatggcttagtttattttatttgcgggataacaaagtcattggagcttgcatatggaattgctcctttaataattatcttctttgtcatagtatcaggtttctatgtaacagttaataagttgccatcatgggtttcttggatcaaatatatttccttccagagatattcttattctgccttggtggttaacactttcccaccaaacaaaaattggggtccaattcagactgatattttacttaaacagttctctattgatcagacatcatttttactgaatgcagtggtattatttgttttgggcattttatacagaatttttgcctgtattacatttgctcttttctttagaaatcttggtttggaataa

SEQ ID NO: 2812 - DNA, 969 bp, Cryptosporidium hominis
atgaaggccattattcaaaataaagataaaattacatgtgatagtccaggtaaagctcttgtattattgttgttaatttttgatgaaaatgggaataaatcacaacaatttttaatacttttcttatttatatgtacatttagagagttttctggtttatctttttcagaaggattggaaaaagttttaagaaatgaagataactcaaggggaaaattaattagcatttctggagatacgttaaaaaatccaattagtttgcttttaaaacataattctgaatattcaagtgaaagaaaaacgagtaatggaggtgtagctcctattcaatatccgctgaatctttccacaataaatgttccgacatttggactaaaattatgctttgctttattagaattggtttttgtatctacatcaaagtatgttcattcatttttgttgctttatctagcttcaagattcaattcaccagaagaaattatgctggcatttgagttgataactttcttattaagatctggaggcaattttgaagaagcttcagcactattactttatgatagacagttatttcaaagttattcaagtaaagttttgagatcacataatctcgacatttcaaatttgaaggaattgtttggtatatgcttagaggcaaaatccagacattcaagattcaatgatattattttacaaacagactatcaattaaagtctatgaaaaaaaagggaaaaagaaggaaaaagattaaattatcaaggaaatgaatgcttcattgtggtaataaacctcctagatctaaagttaatggatattactctcatccatgtaatcttgctcctgattgtagacctggcttttcttctggacaagatttgaaaccaatttgtgcattttgccaaaatcgatctagtcatggtccatataaacatgaatcatcagaaagtgatgatgatgataattaa

SEQ ID NO: 2813 - DNA, 198 bp, Cryptosporidium hominis
atgcttcattgtggtaataaacctcctagatctaaagttaatggatattactctcatccatgtaatcttgctcctgattgtagacctggcttttcttctggacaagatttgaaaccaatttgtgcattttgccaaaatcgatctagtcatggtccatataaacatgaatcatcagaaagtgatgatgatgataattaa

SEQ ID NO: 2814 - DNA, 219 bp, Cryptosporidium hominis
atgagatgctatatggattataacactagtaaaataagaatggtaaattcaagtaatgatattacctataaagctgattatggcgagcttttagttgaagggttcaagatggttacaattaacatcttcaaatttaggataattatcgcaaaagatttggatgatgcaatgattaatggactctctggactgaattatctcaactctgatgttagataa

SEQ ID NO: 2815 - DNA, 1272 bp, Cryptosporidium hominis
atgactaatttatttaaaaaacctacacctggaggagagataaaaccttctattacgcaattattagttgataatgaaactagtaataaagaatttcttatagttactctagaagaaaatggggaggagtttagagttccttttcttgttaattatagaactagttgtcaacctaacaaatttgaaagattaattgtccttgatcataaaagttataaattctacataattacagtcaataatcaaaattctgaattaattattaataatgaaaatggaagactaaaatttatttttgatactcatatttattctattaatacaaataagattcttgaaaaaaagcttggatactcaaaagacttgaatcaagtggtcttaaaagattatgattatgaaaatattccaaatagacccaaatattataactctaaatataaaacacttgtacctggaaactttaatgtttttcgtgatcaactttccgaaagcactggccaagatggtgttaactttattggtgtattttctttgattgacactgaaattagaatgcctactgttaaaaccaatgatgtatatgaattcttttccatcgctagatgttatgctacatttaaagaatttggagcttaaatgactaatttatttaaaaaacctacacctggaggagagataaaaccttctattacgcaattattagttgataatgaaactagtaataaagaatttcttatagttactctagaagaaaatggggaggagtttagagttccttttcttgttaattatagaactagttgtcaacctaacaaatttgaaagattaattgtccttgatcataaaagttataaattctacataattacagtcaataatcaaaattctgaattaattattaataatgaaaatggaagactaaaatttatttttgatactcatatttattctattaatacaaataagattcttgaaaaaaagcttggatactcaaaagacttgaatcaagtggtcttaaaagattatgattatgaaaatattccaaatagacccaaatattataactctaaatataaaacacttgtacctggaaactttaatgtttttcgtgatcaactttccgaaagcactggccaagatggtgttaactttattggtgtattttctttgattgacactgaaattagaatgcctactgttaaaaccaatgatgtatatgaattcttttccatcgctagatgttatgctacatttaaagaatttggagcttaa

SEQ ID NO: 2816 - DNA, 636 bp, Cryptosporidium hominis
atgactaatttatttaaaaaacctacacctggaggagagataaaaccttctattacgcaattattagttgataatgaaactagtaataaagaatttcttatagttactctagaagaaaatggggaggagtttagagttccttttcttgttaattatagaactagttgtcaacctaacaaatttgaaagattaattgtccttgatcataaaagttataaattctacataattacagtcaataatcaaaattctgaattaattattaataatgaaaatggaagactaaaatttatttttgatactcatatttattctattaatacaaataagattcttgaaaaaaagcttggatactcaaaagacttgaatcaagtggtcttaaaagattatgattatgaaaatattccaaatagacccaaatattataactctaaatataaaacacttgtacctggaaactttaatgtttttcgtgatcaactttccgaaagcactggccaagatggtgttaactttattggtgtattttctttgattgacactgaaattagaatgcctactgttaaaaccaatgatgtatatgaattcttttccatcgctagatgttatgctacatttaaagaatttggagcttaa

SEQ ID NO: 2817 - DNA, 246 bp, Cryptosporidium hominis
atgaaaagaagacaggggattaaactagaaactcctaatgatttggattctaatacttgggatgaactatgtatttcactatatccatcttggtgtagtcaaaaccgtggaatcatattagcaaaaaaaaattacgaagctcaggaatggaatgtgaaaacatctctacacccaaatatagaaaagtttttctttgaagaaattcaagaattttttgataaaagctctgaagaaaagaaagggcta

SEQ ID NO: 2818 - DNA, 306 bp, Cryptosporidium hominis
atggtttgcaagtctaagcgttcaacaaaaatgggtaataagaaaactgacaaaataagttcggacgtaaagagtttgaatacaaaaaaaacagcaaaaaaggttgaaggcaaatcaaagattattggttctggcatgaaaagagtaataaaaaaggaaataataaagaatataaactccgagaaacctataaaaaataagaatacaataaaaaaaataaaaaaggcaaaagatagtgtaaaacagtcagttacaaagaaagaaacaaaaaatacacaaattaagaacacgccagcaaagaaaact

SEQ ID NO: 2819 - DNA, 1236 bp, Cryptosporidium hominis
atgagacgacaaaataatcaaaaagaatttgagagacatttggataatagtattataaatgaagataatagaaataattttatggataatgaagaatttggaaaattaaatcatcggggtaatgaaatttataataattttgaaaaatttaataataaaacagtatcagaaatggtatctggatttttggatgatacaattcttgattatcctttaaatacaaatgatattattgaagaaaatgaaatttctaatattacaataaatttggatctatcatatattcaaaaagagattttggagcataatattaattattcattattatcatcaaaaagatttactcaagattttagagtattagaaatactttattctggtaaaaatgtaataattacaaaatcaatacatttaattgaccaaaataactatcaagtttctatatataggataccatccaataaatttaataagattcaaacaaaagtatcttcactggtaatgcttcaacatagatatatggtaagatattatcaatgttgggttgaaaaatgtgataatacaaaagatgaaagaaatgatcaagaagattttatattattatatattcaatcagaatttatggaagaaaatacgacattatttgatttatttgagaaaggtaaaataacacaaagagataatcatttaatatggtctttatttagacaaatacttgaaattttatcatattgtcataaaaatgaagtatttcatttaaatttatcatctaattgtatttatatagaggaagatatttatggatattcagtaaaattatccaattttatttttggttcatatttaaattcaaattttgataacaataaagatgaattctcattaccaaatatattatttgaagaaattaatcaacttaataatgaattattaattatagatactagctatacttgtcagattttcttggaaatgtggttaagaataaaatataaagcatttgaatatgataaattttgtgagatttttaatgattggttaagccaattaataattgatcatcaaaatatattatcaatagataatacaaaaaatattcaagatttagtcgtatttaatattgaaataccgattgaatttaaatatataccaaaaactgcaataataattataagaaaattaaagaatattaaagataatataaatattgatgatttattaaaaagtgatttattg

SEQ ID NO: 2820 - DNA, 207 bp, Cryptosporidium hominis
atgttggagtcaataaatcctgcatcatcctattacttaaaaaggattgagcatttaaaaattttgattgattcaaaaaaattggatatacgtagattacatgcacagagaaatgaactaaattccaaaggtaagttgatttcctttaaagcttatttcaattatgtgaatataattaacttaataatgttaatgatttttagttaa

SEQ ID NO: 2821 - DNA, 126 bp, Cryptosporidium hominis
atgttaagaggtatgggatacaatccagaaatacacgatacaaagccaaaaatattcaagaaaaggaactataatcagtcaggacttggagccgataaggaaattggaagcatttctaagaaataa

SEQ ID NO: 2822 - DNA, 1662 bp, Cryptosporidium hominis
atgtcagattgtcatagtaaagctattgaaagatataaaaaagttcaagagctcaaagaaaaaaaacaatctgaaaactctaattcaattgaaaataaaatattagaatttaataaagttgagaaaaatgtcaataaaagaatagtcattgaaaaaaaagttaagccaaaagaaagtcactctatatacgatgatttgaatcaattattacgatacaagcctgaattagatcaaatttataagagtttagtacttacaggaagtatgtctttagaatcttttattcaaatgcatcaccaagatatacttttatcaaaaacacaagaaaaaggagttgaaaattctgattttttcttgaaaaggccaccaaaagttagtatcacaaattctggaggtattgatgtaacaattactgctgatgatttaaagtcaattcttgaagaaatgccatcaattaaaacaaaaattaaagaatacgttccacatcgtttgacagaagaagaattttggaatcgtattatacaatcaccattattttttgatatacttgggcaaaaaaatactctagtaaataatagtgatacattaatgattggtgagattcctaaaggagaagaattattatatgaattgaatacacttaatagaagtagtaataataatgataataataatggtaaccaaacaaatggaataagtgaattacttggaaattatgttagttctgaaatcaatctattaaataatgatacttataaaaaaataggatatggtacattaattgataatgatttaaatattgcatctgaaaaaagtgcaaatattaatacaggattctttgaaagatttaattgtcatggagctaaaattcttgaatttacaactggtaataatgcagtatttaatagacaaagtgaaatggattttgaatattcacaagattatttacaaactaaacaacattcaagcaatgcaaatagtaatagtcaacttttggatattaatcctgttaattttttttcatcatctagaaataaattagatgtcaatatgaaaaaagaagaaggagataataataataataataataataataataataatactcgaagagttaaattcaattttaataaaacaaataaaaataagaatgaccatgattctttatttaataatccaatttccaggaatgtattattaaactgtacaaaacaaatacaacatgaacagattaatcaacttggattgtttaataaaaacaatctaatacaaaaaaaaagtaatgaaattgattctaaaaatcaaattttttttgaattacaaaataatcaatctgataataatatcgatcaaattaaagaagaaaagcctatttggttgcaacaaatacaacaagaacatatacaagctattgaattattaaagtatttttggggattatcattatctccaaaagataatgatgaaagaagaaaaactattgaatcattaaataaaattactcataatattgaattacttgtaatgtggaaatgcagatttttgaaattttataaaaatatttatgttggtattttaaatgaagatgataaaagagaaaaaaattgtgaattaaacaaaaagaaaaagagaagaaatgacaataaagaaatagcaaggtga

SEQ ID NO: 2823 - DNA, 300 bp, Cryptosporidium hominis
atgtggaaatgcagatttttgaaattttataaaaatatttatgttggtattttaaatgaagatgataaaagagaaaaaaattgtgaattaaacaaaaagaaaaagagaagaaatgacaataaagaaatagcaaggtgaatgaagtcttggaccttattattaaagttcgatacctcaaatctggagaccgaatgtatgaaaccccaacaatctcctctacttgcttctttctatacgacttataattatcataaaatctgcaaaaaaaaaaaaaaaattattattattattagaaaataa

SEQ ID NO: 2824 - DNA, 324 bp, Cryptosporidium hominis
atgaagtcttggaccttattattaaagttcgatacctcaaatctggagaccgaatgtatgaaaccccaacaatctcctctacttgcttctttctatacgacttataattatcataaaatctgcaaaaaaaaaaaaaaaattattattattattagaaaataaatgaagtcttggaccttattattaaagttcgatacctcaaatctggagaccgaatgtatgaaaccccaacaatctcctctacttgcttctttctatacgacttataattatcataaaatctgcaaaaaaaaaaaaaaaattattattattattagaaaataa

SEQ ID NO: 2825 - DNA, 267 bp, Cryptosporidium hominis
atgtttctacaaattattgcaataccccaaacaatagcccagatccatccaacaaatggcaataataattggagaaccccagtgataatgtctgaagcgtcattatttagtattccaataataatcatccccaaaccaaaaataattatgttcaatactccaaataatacgtatttgcctttatcatggggtgaagctgttggtgtagaaaacttcttgagtctttcccaaactactctcaatgcatttgacattcttgatctttaa

SEQ ID NO: 2826 - DNA, 90 bp, Cryptosporidium hominis
atgctcattgtaaatacatgcatgcattgtattgctacaactactgcatatttgcgcccccttccctctagtccccccagccaaccctaa

SEQ ID NO: 2827 - DNA, 55 bp, Cryptosporidium hominis
atgaatgattttgatattattgagtcgcaacttgcgaagattaatgaacttagaa

SEQ ID NO: 2828 - DNA, 207 bp, Cryptosporidium hominis
tatttcccagaacctaactcttcatcatattcacaaaatatttatgaaaatccaactttattatatccacttaaaatttgtaatcctggtatttataaatgtccaaatataactatttacgatttttccacaaaatctaattatacgattaaaaaattacctttacttgtttgcgaatctctaccaaactgtaacagttaactttaa

SEQ ID NO: 2829 - DNA, 58 bp, Cryptosporidium hominis
atgaaactcaaatatatttcaagtggaattctaataataatcagttttttggaaattc

SEQ ID NO: 2830 - DNA, 156 bp, Cryptosporidium hominis; identical to SEQ ID NO: 2300

SEQ ID NO: 2831 - DNA, 209 bp, Cryptosporidium hominis
atgaaaagagagaaagaaagaaaaaaaagaaaagtcaaactatactacttaaattcaatcccagaccttaaggggggtggggtggtaaaggcggcagaataagaagaaaaaataaaatgaattttgccataaaaattgtgaggcatggcgccaaacttgtcacatattacatgtaaaagattaaagaattaaaatataataagttataa

SEQ ID NO: 2832 - DNA, 79 bp, Cryptosporidium hominis
gaatttgattgctattggttcaaataatggtatgataagtatttttgttaaattaaattctattatggatgatcaatat

SEQ ID NO: 2833 - DNA, 36 bp, Cryptosporidium hominis
aatattaataatattggtaatagtattaataataat

SEQ ID NO: 2834 - DNA, 2313 bp, Cryptosporidium hominis
atgaggattcttttactatttctatttgcattgatattctcgatatcctcaattaatggttcaaacttatcagaatctcctgttgataccagagcaaaatacggacttgttttacatccggaagaacgattatgcaaagagaagttgctcaaaacattttcttgccttaagttacatagccttcttgttaaagttaaatatatttatgcaaaattgaaaactttacttacatacctatttacatattttaaggagtcaaatattgacttagaaggcttacgagacattgtttcgaatgaaatttctcaactctcattagaaaatcaagcaatattatccgtctatattaggaaatcatgtgaaaaggagttccctggattttctactccaatggttaaagaatttgatccgaatacttccagacatcatgtagctccgctctctgaaagtaaattcgaaaagtcttatgtaacccaaactcttgaaatcctatttagaaaaaattccaaaataaagaaaattatgaagagagctgatcaactaacaactttaaaactttgcctttcgagattaacatacaatttgtacaggcttgctgtattctgtcaaactgcattgaaaagccttattagagctattctcaaagcaaatccaaattgtaaacaatttctttcgtatgcaaaatcaaggctgcctctctcctcaggaggttatgatacttcttcttcatcttcggatgaagaacgttacgatgactactttgagaaaatgaaaacttatctgcctggtggctcatcaggtggtgcttcaggtggggcttcaggtggtgcttcaggtggtacttcaggcggcgattcgggcggcgattcaggtggtgcttcaggaggcgattcaggtggtgcttcaggtggtgcttcaggtggtgattcaggtggtgattcaggtggttccacagctacacaaagcggctatagccaatatcaacaacttagaggaatttctaaagtatgtagaactagtaacaaaaaagaaactactagttcattagtctgcacatgtacaagtgatgaattttccagtaaaacttgtgtatgtaagccttgtgctatgagggataatcgtggatcagctgatagttcaatgctaccttcatgtggaattgagctacctaaaagaccgaaaaagtcatatccaaaaatcaatttaccgtgtgattatattccaaatcctggagatttgcgtccaattccacttaagactagtagggattttgaagcacgaagaaagaatttagaaagtattcttaatcttcctcttagagttaccctacaagagttagatattgaggatacaagcacagatgaggaacttttctgtaaagaagatttcattcaaagacctaaagaaaagaaaaaactctgtatagcggatctaaaaaaaatacatgaaaagtcgcttgagcagccttacgttaaatcatctgataaatcagaaatgagtaaatctaaaattcaaagacctggttctccggaatcttccaagtttccacttgcacatcaattagggctaatgcaacttcaaagctttaaagcaaaagatgagcaattaaataaaagatctccaagaacaagaaatactgcagtctctagctcatattcaacgaagtatcctagaccttcacaaactgctgatacattagatgatactaaaccccatgtacccagcccccatttatgttcagaagcgcatcaaagtgttcaaaagcctgctctctgtagccctacactggatatggcggaatcgaagaggcaatttgggccagacccttcagttagaccaaagactacaaagcctcaactcaaaattgaagatcatggtagtcatggcactcacaaaccgcgccgaagagtagatgtagcatatctggatggaggatatgaaagtagaaaagctagtaatctagaagaacaacttgcttcgctaaaaatttcttccacggattatcgcagcagtcatttgagtggaggacatggagaacaatcatcacacggagaacgatcaaagaatagagaaagatcaaggaacagagaacgatcaaggaatagagaacgatcggggaacagagaaagtggaagaaagatgacatcaaaagtgacttttgatggctctagctcaagatgcgctagagaaagatctcataaaaaaccaatgttgcttaatgcccctacatcgatgggtggtagctcgtcttcgggaagtgcagcaagtttggataaatatgatttgaacgatattcttcagcaatctgattaa

SEQ ID NO: 2835 - DNA, 243 bp, Cryptosporidium hominis
atgatttcagaaatgatctcgattgtttttgaatgtaactcagttggaattagttttatgagatcaatggaatatattgaaattaagtacttaagaataagaaataattgccagttagacaaattattctgcttatatatggacagcaattcttcaattaatagtttaaaattggcaaaaaatgatgagttaataagtttcgtgcaactaattaagccactatttagtagcgaagttgaatag

SEQ ID NO: 2836 - DNA, 714 bp, Cryptosporidium hominis
atgtttacgaatttctttcttagatcagatttaaataccaaattggtaattagaaagtatagcttaattggtcctaatgttattttaacatgctctgagcttttgagctcagtaatgaaagtacagagtttgaataaatctctttttgagctttcatttttaatatcagaagaattgttaagaatatgcttctattccaaagcaatgataagaaaagctattagaggggagctatttcacgatgaccacgtggagctactcaataaggtaatcttaatattaaaggatattgaaattccctctagctcaaaatttattttacaacctgaaattttggatcacatttcagagttttcaaaaaacggtctttcaccggcgactcttgattctatgtttcttttggttgcaatgttcctaagaagttcaacaaaaagtgtagaaatcgaagtaatagagaacctagctgaaagattgctcctttattacattccattcgaagagcaggatggttacttattgttttataattcatacagacatctgtgcaatagtctaggaagagttgtaaatcttcccgatccagttcaaataaatgaggaattcgctccaattgaatacaaaactcaacatatgcacataataaacgatcaatttttcatagataatattttggatagattttcagaatgtaacttagattgcattggcgaatag

SEQ ID NO: 2837 - DNA, 225 bp, Cryptosporidium hominis
atgagtgcgtgttctggaaagcaagagtgttttgatcttttatttcaggcaaatgctgatttaaacttaaaagaaaatattactggagatacaattcttcatgccgcaattaacggcttccacgaagaaattgcatataaaatcgcctcaaagaatccggaaatgctcatggtaaaaaacaaagtaagtttaccatcttatataactcaatttacctctttttag

SEQ ID NO: 2838 - DNA, 4848 bp, Cryptosporidium hominis
atgaaactaatagtgtggaagttaataacaaagaggttcacacattatggaaaagcagatttaaatgctaaagcaagttcttttgataatgctaacgagggtttaagcaagtcccagctacctttaataaggtgggtaatgcttgagattcttcccattctacataaattgaactcaattccacacgtaagaaaatggacagtttctgcgctggtacttaaatttataagacttacactttcgaatcctttgcctgaaagtcaagaagacttcaccgaagattctgatgcaacaatctggctattcagatgcctcttatcgatagactctccttcgtttcatcaactgatggctcttgtaatacctcctgaagatccctttctgacatttcttcagccccaaagcagagatatttctagcaggccaaaattgttagcagctaaaactggacttgaaattattagaatattatttcagagagataagctttttctttcatgggtaaactatcataaaggttctcttcgcagactttttacaggttctctttctcgtactggggctccaattaatattcaagagatcttattggacactgaggcccttgatgccgtcacatcctctgacagctctttaatttgtttccacgaacaattggctctgccagttcaggaagatttttctcctgcacaatttgagctacttaatttgaagaaaaacgaatactatcgggtttctcttctcagatatattattattggcactgactcggatctacttaagtcgtcaacttatatagcatgccaatttctacatagagaccctgaagcacttacagctcttctcacaagttcacccgcattattgctacaattaaggtcatcattctcacgtatattttcatctccagatcttgataaatttccaacttctatccatggattcattctagactctgaagactcttttaattatatctggaataatccaaattcatttatttcagcagaatcagagtctggtacaaaaagtacttctcttgttactgatcagcaagcagtttattgggatgaaattacagaggctgatccaacttcttcattatactactgtgagaataacctattgggcatgtcatataagacccttcttccaatccacaatgaactcgagttaaactacataatttatattgattcacttgttgagtcagcagatttgtctctttggtgctcattaaaaatcactcttcttggggagttgcccctttcttcaaaattggaaattacaagaactaacgaaacaatacttaatggatacctccagttacttcctcctactttcattccaaataaatcgtctttatataacaaaatctcgagattccacttaaccagcacgaggtctttaattgctttcgcactatctaagggcatagaggacagattcttaatttcatcctcattgacagattctttatcaatcccaaatattgcaatttggacacaatctaaatctcaagatacagcatcttcagctgtcccacttttactaggactagggcttggaatggcaacagatgtgcctacaatcaaagaatatcttattttttcaacatctaatgatgaaaattattcagcaaaaacttatgaagaaatctacattcctgatgcttcttcttccagtgatgagtccacattcccattacttactattatggatattttatccacacctccacaaattccgctttcacatcctaatgatcaaagaccatgctttccctctatagattttgcaattctttctcagttggagttttattatctcactcttcgcttgacagtaaaccttttaaaaataccgcaacttttggacttttctcttcgacttttaaatgaaaggcttaactcgagatttgcaattcttaaggagcgaattcttttacctgtaacttggatacccccagaatatcgctggcttcattttcttcatctggcattaattgtacatttaatatcttctgaaatatttgtggtatcgcaggtttcttctgcattgaaagagattcagtgcttagattttcacaactcactacttagagacccattttggctctcttgtatccagaaccttcatgcactgttcagattattccttactcctccaaaaacctcgtcttcctctcacgatcaacttgatatactttctcccattttgaatatagcatattctttccttgagaatgagtcatcgccggatatggagcttctaatccagcaaaatcccaattgtaaatttcttttctgctccttcattccatacttaacagttccaagccaggtttgtggcatttataggacatctttgcaatctatagtccctgataattatggaaaccaaaagttgattaaagacagatttccaattaccctcgcaccttcaattagctcaatttcttgccgtctatttattaacgagtacgtgcaacttcttggattgcttcttaataaattctcaaaagtctcacctttaaatcacacagagttggaatcaagagatctagatgctaactccttttcaattttacaagcaataatagagctatgcaggccattcattaacttttccttctttaaaaagactccagtaccactttcttcagcaatactttcaattttttcccaaactctactcactactttgaggcacgtccatgaatcattttctacgggaactagcacgtataattatgatgaattatcattgagactatacttgcctaattcttcgatttcggagatccagagacagaaaatatgtttcacaaccatccaagattgttgtgaagatcttgtaagacttttagttgatctggagaaggtaaattcttttaattatagttccaaccaatatttcccacctggttggaaaaacacgcttctgcttctcttatcaaattgtattgctattgactcgatccagttttcaaataaatctaatcaagatgcaagtgaagcattcacaagctcatttcttcgacaaatttggccagaagtttgggcaagtaataggaacaaagcttactcttccagcaaatccagttctggaaaaccaatttctacctttgtagattttgtttctttattaattaataacctgaggattccaaataaacaaaatgaacatgaaattctgaagagcttacatgattttcttccttgtaaattggatccacgaaacgcctcttgggttttgaagccaaaagaggtaatacttttgacccaattaaatcaattcaaaaaattgaaagattttgatgatggcgaaattgaaaatgaaaagtatagaatttctgagccttaccattggattcctttcaactgtgatttgttgttttgcacaaaatctcagcaaaatcactccttcctttcactttacttgttgttcttaatatacaataagatacatgtttccaaccaattaattttgacagatccttctgccttggttccatctattaatggtgatgagcatatccaaaatctttatgctctgattgaaaactcaaaattctctattcaatgttgccatggaagtcttattttttggaattacataacaattaactggattcgaatgtctccatctttccttaggaagattattgaatctgattatattagctgcctactttcccaagaagtgattttaactgcattacaagactgccaccaactattcttagatcttcagtttgttggttcacaaatttcttttaatttacagcttgaaaaggctttcgatagaattgagcttataatctcgatattttctcttttacttgaaattatcaacaggggaatattgccaaaaaatactcttgctggttatggttcaattgataattttgaagtcattgtttgttggattgtcaagcttgaagcattcttctcttccttgtttgaattcttccttaagcatttattattctgccaacaaaagaaatctgactggcaattccacactgaaggccagcaaatactcaactctggtagatttgggagtgttctagttgttgaaaaattctcgcccatactttgttctgtatattcattgttctcaaaagttcttattacaggatatcacatttctcatattaaatccaggatgaatactgggaaagagaacaaggttgatataaactctatgaatcatgggaatgctaaagaactagacacaaacttcatcattattaatatattacattctaggaccggtcaaatccttgaatcagcatctcaaatgatatcattggtgcctaaaattgatcaattgaattctctaatattttcatgtatatcttggtttgagtctgaagtagagtttctttcgcattacaagtctacgaaattaggatttgaaacaagtgctaccattcacaattccccttctcttagtccttttaagcttaagctcgaaattgcaagatggctttcaaattgcatttcatgtttaacttcatctctcaaagatggaatagagtcgaagccacctcatattgtgcagaatcttgtatctatacttgccagagcttctcttacaattcttctctgcgattcacaatttccaggtcaacctttaacttcaacaagcatactttctgcagaggacccattccaagaagctattcgaatttgtattagctcaattaatttgatgctaagctcagaaataaaaaacaattttttaaattcaaaattgtcagaaacctctagaaattgtaaatccgaactggaattactgaaacaaatcagattaaagctggaaagcatacactatttctaa

SEQ ID NO: 2839 - DNA, 2442 bp, Cryptosporidium hominis
atggaaaagaatcgaggaaaggctcgaacacctatcagtcgtcaaggctctaagcctgcaagtgggcttagaagtgctcagaaccttcatagtagtgaacggaaaggagcctcaataggatttgataaactcagggatggagttacaagttcaatagaaaacactccagttagacaaacttcaagcagaaaagttgaccaaaatagtagctgtaatcgaaagtgtcaaagcaccgaaagttatagaacaaggactaaacttgagagctctgagagatataaggctatgtgtttttcaccagctttcaaattgaagttcagtcacaatgcatttgtttctttaggctcattattagagttacaaaaaaagtaccatcttaagggagcaattggccaaggttcctatggagtggtcagagtcgcaatcgaaaatcagacgagagcaatccgagcaatcaagataatgaataaaaacaagattaggcaaattaatccaaaggatgtggagaggattaagacagaggttcggctaatgaagaagttgcaccatccaaatattgctcgtctttatgaagtttatgaagatgaacaatatatatgtttagttatggagctttgccatggtggtcatttattggacaagcttaatgttttcattgacgattctacagggaagtgcgcaatggatgtagtaaaaactcaaatatgtccctgcccagaatgcaatgaggaggcaatcaatgggtccattcatggatttagagaatctctagattttgttcagagggaaaaacttatttccaatataatgcgccagatttttagtgctcttcattatcttcataatcaaggaatttgccatagagatattaaacctgaaaactttttgttttcaaccaataagagctttgagataaaacttgtggactttggcctttctaaggagttttataaattgaacaatggagagtattatgggatgactaccaaagccggaacaccttattttgttgctcctgaagttcttaataccacaaatgaatcttatggccctaagtgtgatgcttggagtgcaggcgtgctactccacttattactaatgggtgcagtgcctttcccaggaataaatgatgcagacactatttcacaggtattaaataaaaaactttgtttcgagaatccaaactacaatgttctttctcctcttgcaagagacttactttcgaatttgttaaatcgaaatgtcgacgaaagatttgatgctatgagagctctacaacacccatggataagccagttttcggataaaatttataaagtgagtcctatcggtggaattgaagctcatgaatcacattcttccaggagaaacatctttggagctactgagcacagccctgttcagatttcaatgcttaaatcattaagaagatattatgtctctcctttgctaaaaaagattgcattgactgtcattgcaaggtattgcccagataaatggatagaaaacctaaggaatgtattttataaattagatactagacaaattggtaagattaatctttatgatttgcgtgttgcaactcagcagctggcagctcaacaaaagcttagagttcctcaacatcatatagatcttctcttggatgcagtagacagcgatggaaatggagaaatcgactatattgagttcgttgctgctgtaatatctccaaaactgtcttgcaggaaggatgtgcttactatggctttcaaaatgttggatcaggatgaagatgggcttatttctacaagagatatcaaaaaactagtcagtagtgaaaaaattcgactaagctccgcaacagtactagaagctgaggaggacagtattttggaagatcttaatgttgaagtaaccaaaattataggaaaaggaaatgaaaatgtcacaggaatttcattccaagcatttgaaaagctacttaatacaagctatgataaggtttgcagatgttaccacggcccaagagaaggggagaccaaaggaagacttcctgtttgtggagaagacagtatggacacttggtatgatgacttactctcttgcaataccgaaaatgaaaatctaacacaactttttgcaggaagtgagccaaggaggcttcaaaaaagttctctttatgtttgcagacgcacaggatttagagatttattggctttgagtcagggagcaggacaaaaggataaatttcaagtagaaatgaacaggaagaggagtctgggaaatcatcaggaaagagaaacgtatagtacaaagggagctaaagacgaagggcaaagtagcggtgaagtaaatagggaatacggcttgggtattgtggggttcattggaaatgggttaggggtaagagtgggaggaaatacaaagaacccttctaaagttctgttatgtgacagttaa

SEQ ID NO: 2840 - DNA, 381 bp, Cryptosporidium hominis
atggcgcagcaatatatctataatacagactacattaatgagattaatgaagaggtttataaagaaataggtatttcgcacgaattagaacaatttgcgaggaaaggaattataccaaataagaataataatttatccatccataacagcaccacttacgtgagtagaccaattaaaagtgtggcatctgagaatgctgcaaatggaaaattgaactcagtgactggtttcggggtggtagccttaactttgttaattatttatttgttaaacaaaatattattctggttcatattaatatctatttttgcgttttgcatttctgttgccactaggagcttagggaatatagaagctagtggcaagaagttgccattttag

SEQ ID NO: 2841 - DNA, 1272 bp, Cryptosporidium hominis
atggatgatacaaaccctaataaacgagtaaagctcaacgaagagcctaactcacagctatccattccaattaaaattgataatgtattgaataaaattttacttcatccatgtgagacattgagcgactttattgaaaataaagtaggatcatattctccatattatgctcatcatttttttcacaatgaagaaattgcgttgctagatggttataacacgctaattcacatttatttctcttgcaattggtttgatgtatatgtggaagtagatttaactccaataaaaagcaagtctaaagagcatattgagttaagtgaggaggacaagaactactatatagaaaatattattaagcagttaaaaaccattcctctcgagggtggattttgctctaaagaagaatttatggaaagattgaagattccattattatgggttcctggaacatcagcaggcatatttaaggcagggcttggagatgaagggcttgaggaagtggatttaagaaaaatagatttatctgaaaccgaaaatctgacttcttgcctaaataaggaacccaataattctaagcctcatcctgatgttaaaaactttcaaattctacacaggagaattgagtggttcctccattggtatattgaatctgcttcttccattgatcaagaagataggtgggcggtttggctccctactgtcaaaagagaacaatcacttatcattttaggtttaattactacatatttatttttttcaattcctaaatctagaattagaatttctcaagttttgatatttcctcagtaccaaggaaagggtttaggttgttcatttctggatattatttatagctttgcaataaaagacgaagatataatggaaattactgtagaagatccagccctttcaatgatgcaacttcgtgatatattaactattgaaattttactaagaaatcatgtaattaaaaagaattctttaaaaccattaaaaactgacgaacttttaaaaattcttcaaaatccaaatggatcagtaaatattttaaaagatgtggcaatgacgtgttttccttctcaaacttgggaagaagttaaagaaaagattcataagtatacaaaagagtcgccaagacaaattgcaagattacttgtattaatatcattctttagatatttaccaaatccattacccaagattgaatccaatattgaagacgagatcaggggtttcagagtaagaaaaggtaagttgaaaattatttga

SEQ ID NO: 2842 - DNA, 1233 bp, Cryptosporidium hominis
atgggggttggagtattaagactaacagtttcttggtgtttattaagtgatgtggtaattcgaattgtacacattattgggctattatcacgtggcatttctttggtaatgttaataagttatgcaataatcggaattccagacttagagattcctttggctttgattactggtgcagttatcttccaagtattatttgcaagtctatcaagctcattaagatgcccatgggtgatattacgattcctctttattgatatttggattggattattactatttcaaatttttctaagaatttcatcagaaagcaagtattatcgcgaaatatcaaaagacaattttacttgggaaacttcatctcaatttcatggaaatctcacgactattgccgagaaatttcagcaaattccgtcttggtgggttgttttttggccttgttggttttggtgtggagttatattctccttttcgacggttttttgtgttcttggagtagctgacagaatgctagctatatttggagttttttttggttgtttatctacaactatactcataacttgcttagatctagcagattttctcaatgatactatttatcttaaagaaaacaagtatgctgtaagttaccacgtatatgagcagaactcacatatcaggttatggcatatttgtattatctgcactcagacaatgattgcagtaatgtctgccgttatttcgcaaggattaattcaggaatctgatgaaggtttctctttaagttccacagatgatcattttattacttctaatataaagcaatttaaaaaaatgatttctccatataagataggatctgaagttattcttacaaaaatgggtactggcgtttttcataaaatagaaaatcagagtaataatacattacctcaaggttattcagattctaaagaattgctaagctgtgaagcaatttcaacgcatacattatctactgtaaattctcccacaagcactaattctctttcacctgtattgtctcataccccaaaatcaaaaagagaatccttttcagattcaaattgcacgctaactccatatgatgataatcatgaacaagtatgtattatctgttgtgataataattgtgaatcagtatttcttccatgtggacatggtggattatgcagtaactgcgctctaagagagttctatagggtaagttatatttttaacacaatttcctaa

SEQ ID NO: 2843 - DNA, 795 bp, Cryptosporidium hominis
atgacactctttggccaggtattaattggacctcctggttcaggtaaaacaacttttgtccatggaatgcaccagatgtgtactgcacttaataggccaaatattattgtcaacctggatcctgcaaacgaaaatgtcccttatattcctgatgtagacgtgcgagatctgataaactttgaaaatgttatgaacgagcataagctcggccctaatggagctctggtttattgtatggaatatttgcaagttaatattgattggctgattgatgaaatacgagccaaaagaaagaattcttcatatattctaatagatattcctggtcaagttgagctttatactcacaactatattttaagagaaatccttttagtattggcaaaagaccttgatattcgtctaactgcagtacatctgattgacagcactcttctatcatctccaacaaattatatttcagcattattagtctctctctctgctcaaatgtctatagagcttccatatttgaatgttttctccaaaattgatcttttggaacattttaaggatgacttaccattcaaattggaatatttctctcagttagaggatttaaatcaacttttgacattctggaagcacgagtcgaatatgggtgatcatccattatttctcaaatataagggatttcaaagtgagcttgtggatttagttgaagattccagtattatgcaatttattccagtagacatcaatgacaaggactcagttttgcaaattttgcaactaatcgacaaatctaatgggtaa

SEQ ID NO: 2844 - DNA, 2739 bp, Cryptosporidium hominis
atggatgagaataataagaaaataataaatgatacagagactaaacataagagtggtttaacaaaagagtgggatgaattcctcacgctttatcaacataggaatgaggaaattaataatgactttaagcttcacagcagatttcacagaagaagtaaaagcggttggagaagttttttatcaattattatcaaatccattcgttcattttttcagaatgaatctttaattggaataaagtatctaaagcaagcaaaatggacctggccaaatgtaatttgcgattttttttgtggtcttgcagaggcagcgctttctattccacaaggtctttcatactcttctttagctaatgtagttccatccatgggtctctgtaatggaattctacaaccaattatctatttatttattgggtcttctctatatatctctattggggtaaattcggtggaatctatcgttgcaggcacagcaattgatactctaatagggaaccgagcccctcttgatgttagatcagaagtttgttctgtggtcattttctttcacggaatttcctgctgtcttttaagaatttttggattggctcactttgttgactttctatcagattctgtattacaaggatttctttcaggagtcgcatgctcgattattataaaggaactcccttttatgcttgcaattgagcctccaaacactaactgtgttccgattaaagcatttttcttgttattggataagctatcaaatactaactggcatgctactattttctctatttctactatattttttctggaagctattttgtgggtcaaaaatattttcaagacaaacttcccattcccttcccagctggtagtaataataatggcaaacgttgcaagtgcttttgcttctcctgatattcctatcattggcaaaattcccaaatctagccttcttattcctaataatatcatttggactcaaccctcgggcacgtttccccagccaagtggaatcagctctcttccattttttgcaagggcatggatagctgctcttcctcttaccttcatttcattttttacccactactctgctgctcaaagcatggagattagagctcacaaattgccagaaacacctaaagaaagtgaatctaatttgaaggaaatgaatgtccaaaatgaaaaagatggagccaggctcataaattatagaaagcaaaatggagaaagaaatatacatactgtctcaacgtcatttcagttttcggggcaagtaatatcagaaacaaagactagcccggaaacagatcaaagaaaatgcacacaatcttctttagagatttcaaagggagatttagattcagtagatgatttgaattcgagtctttctctgtcctccttccagtccctagcttcgccaacttcttctaaatcttcctctattattctggataaagagcgaagggtctctttaagcattaggtttgattcaaaatcatctattccaaacccaataactacaataaataataaaccccactcgcatgactcggagaatgaagactgccagggttttatgcttaatactaatagctcaaacaatatttcagaaacatttcacaagttttcctttgaaagctcatctttagacgagaacaatgtagaaaaaataaaggagactgaagcaataataaaaaactatcaaccttcaaagaaaaaatatattgaacccagatttcttttttcagtaggaacagaaatacttgttcttggagttataaatattgttggggctttcttcaattgtcttcctggcgcagcatctctagcaaggacaaatttgaactttactcttggagtcaaatccccccttcataacattgcatattcaatgggagttcttttggttgcaatgtttctacttgaatatataaggtttttacctgaggcagtgttaggagcgatcatttctcaagcaatgataaggatggtcaacatcaaatatttcataaaactcttgaaaatgaggagcattgattccattttctggatgatagcatttattgggacagttactgcaggaataacatatggaattattttcgccctaacttcttcagttatatatctcataaagtttttatacaggcccaaatttgaaattttaggtaaattaccaggtactttaatatttaaaagtttggacaaatttcctcaagctgttcagcttccatatgttcgtattgcgagattcgaaggtcctttaacatttattaatgctgaaaggtttgttaaaaaccttgaagaaatggtcgaggtttggttggacgaagatttaaggatttcaaacaagaactaccaagaagattcaattgatgagtatctaactaagaatcaatatttccccaactttacaaattccattaattttggagagagaattcctacaattatacaagatcttaatgaaaatcatgtagaaagaataataataatagatgcctgcatgattaatgaaattgactattctgcccttcaggtcctgcaaagattcaacaacaagacaaagaaacttaatatacaactttggtttgcttcattttctcatccaaactctagttttctactcagatctggattctatgatattattcctcttgttcattgctttgtagacttatcagaagctgttgctgctgcacaaatatgcattggccaaagatattcaaatagtatataa

SEQ ID NO: 2845 - DNA, 1002 bp, Cryptosporidium hominis
atgtttgaatggactaacattttttcctccttttcaagaccctctgatctggcccttgacacagataaaaatgatgtgagtaaggattttattgaaatcccagaacaattcatgtgtccaatttgtcttggagcattcgtagatccttgtacactttcatgctctcattctttttgcatttcatgtgtcaggggctcccatgaatgcccgatttgtcggtctttactaaaagaagaactttggttgtcaaaaagtgaccaactcgtggatcaaagcattctaaggtcaatgaatgagaccaagactaaatgtcactgcggagctgaaatttctatatctgaggcaaatagccacgcttctaaatgttcctactgcaaagaagacgattctccaacctcagagagtaaattgattgcttctctaagcaaacaaagctttgtaaacaatgatcttcatgctcaaagtagtaatggcccttctaatactcgcactacctctgatacgactggtcctacctttgtctgccctttatgtctcatgaattcaaaaatacccaacagttcttgcttgaaatataacgtggaatccttaattagtcactgtgagactatgcacaaagacgaatattcagaaactcaacaagaaagtaaccatacgactaccatgtgtcctatctgtgttcatattggagatgaaaatgctgaggttgaatgcaagcgctttttacagcacctcaaatccaaacacttactcatttctacatttttggctgctgctagagcctccttaaattctggaagccctgaatccagattccaacttctagaagatatcctatttcaatatgcgcttagtagatccaggtatgaaagttgtatgaatctaggaaatgacaattctcaatcttttggaagctctgtaattgaaattattgggttagatgatgagcaggataattctgaaatgtttcaagatgatgatgagattcaagaaatctcatag

SEQ ID NO: 2846 - DNA, 3021 bp, Cryptosporidium hominis
atgaaattaagaatagcagcatttaaggtgctggtagtagctaagctactttcgattctaggttttgggactaattacgggcttgttaacgcagataaaaaagtcagtgtgagcgaaatagtgtttgagagcccaatagaaactttggaatgggcaggtacggaccataatgtggttattgcaaagacgcaaaaaggtcatgtctacagatcgaccaatagaggcaagaactggagagatatcactgatgtttttgcaaagatgacctcacactcatcttcttcaagtcattccaacctaaatgggttttctgttaagtcaattactataaatcctgtcgacaaaaatgtcatattgatagtaggttcaaagcatacccattttatatcatcaaatgcaggagagacttttagaagaatatcccactcaggtactattcatacatggatatttcatccaaataaagccaaattcgctttattttcttcttggactgaaggatgtaacaaatcttttcttcaaaccttaaagaaaagtagttcggctggaaataagtgtatacatcaattatttgttacaaaggatttaggtgctacatatcataaagttattgactatgtagttcaattccattgggatggaaataataaatcaaaccaaaataggattttctttactcaccacagaaagaaacagggagatcaacctagatatggtggttggatgaaaaccatagatttttcttatactgacgattttggtagtcatgtcgagactccagttaaaggaggaaataaattcttggcgtcaaatggctatatcttcgttgctaagatacttgactacgagagacaaactgtgtcactacttgtatctacgaacgatgcaaattcttttacacaggttcagctaccacatacattgacagagaaaagttatactattttggacacttcagagaagactgtaatgcttcatgttaatcatggagaagactctttgaagggtactggtaatatttatataagtaactatttgggtaccaggtttgctctgtctttattgaataacgttagaactgcaacaggagagtgtgaatttgatagagttatgtctttagaaggagtttatattgctaatgttaaggatgatgaacttgaaaatgaccttgaccatatttctacaactttacatgaatttacagaatcagagacagaagatgaggatgtagaaaccttaaaaactgaacataaaactaaaataggaaaagtagatcagccaatcagaactgtaattactttcgataagggtggtgaatggaattatttaaaagctccaactattgatagtagaggaaacaggataaattgtgacgaaagtgatggatgctatttacatcttcatggtgtaagtaattatcaaagcttggctccattttactctgttgagaatgctgttggtataattcttggaacaggcaatgtaggtagctatttatcctttgaccatgatgatatcaatacctacatgtcaagagatggaggtctcacttggcaagaagtgcacaaaggagctttcatttacgagctcggtgattttggaggtcttattgtaatggcgaatgatcttaagcatacgaaccaagtcattttcagctggaatgaaggtttatcttggtatgattttgagctgggtagcaaaactctacaagttgataacattttaatagagccaaatagctcttctatggagtttttactttatggttcaaggggtaaatctggagtcttataccatttagactttaatactcttggacaagttcagtgcgtaggagcaacaactccagataggccggattctgattatgagacttggagtccatatgacggaaggaattcggaaaagtgtatgttgggtaaacagcttgtatacacaagaaagaaacagacagcagagtgctacaatggtcaagactttagaagacccgtggaaaagaagcgttgtgcatgttctgaagaggacttcacatgtgaatttgggttttccaggcaaattggtagttttgaatgtagacccgaaagtcttgatattgtttttgacgacgtcaagtttgggcaatgcacatcatctggaatattttatgtaactgcttatagaaagctccctggagatgattgtattggtggttggctacctccaccagtagcaataccatgcccaagccacgctcccacaagttctcatgctagaattgtcctggtgattgcattatttattattattttcatgcttaagcaaggaatgtttggggattggactagatttggtgaattaggatacgacgcatatagaaatgttcagtataaagtattaggagtggcaaaaagaaggagttcttcattacaaggaattttgagtgctatttctgcatatattaacggagattcatccaaagttgtctttgggtcatcaaatataccagggtctccccctggtacgaagaaaaataactatacaactctaaacaactttaatacagaaaacatgtttatggaggatgatgaagatgaagacgatcatgctattggtaatatgacccaaatgtctggaaatattaataacatcaaaagtaacaattataacagtagaattggttcagggtcaaacctctcacaaaggcaaagatcaaatagcaataattatatttctgcaggccaagataatgtatcagtagatccaatttttgacgatcttgatgtatttgaggaagacttggattcgcatgcaatttttaatcaaaacaatggattgggtaatttgaatcctagccacgatattatatcgtctgaggctcctatcagttttgataattttaatccgacagaattggaaatcaatctatcttcaattcctaatacatctttcccaaagatcactcctccaccaacaaacaacaataaatctaatattggaaacaactttaatcaagacaactccaatggaattgaactattgtag

SEQ ID NO: 2847 - DNA, 825 bp, Cryptosporidium hominis
atgaaggattttactcctccaagctacccaaaaacaaaggagcaggaaaagcgtattcgtgaaaagctgttagaaagctttatgtttacgagtttagatgatgatgaattgaaaacagtaattttagcttgcgtggaaacttcagtaaagaaggacactgaaattataactcaaggcgataatggggacaaattatatataatagatcaaggagtagtggagtgctacaaaaagactagtactgaaccaaggaaacatctttgcgacctaaaccctggagatgcatttggagaactagctcttttgtataactgcccaagagcagcaagcgttgttgcaaaaactgattgcttgttatgggctttagatagagaaacatttaatcacatagtcaagggttcagcatcaaagagaattagtacttacgaaaccttccttaaagaagttgaaatacttaagactatggatgtttatgaattgaacaagttaactatggtcttaaagagttcaatctttgaggatggacaagaaatcatcaagcaaggggaacagggagatacattttacttaatcattacaggtaatgctgtagctcttaaagacaacgttgaagtgatgagctacaagagaggtgattattttggagaactggctttattaagaaacacgccgagagctgctacagttaaggcacgaggaagatgcaaagttgcttatcttgatagaaaggcattcaaaagagttctaggccctattgaagatattttaaagagaaacacagacaagtacaagacagtaattaaaaaaatcaccacaaaggtatag

SEQ ID NO: 2848 - DNA, 279 bp, Cryptosporidium hominis
atgaaggttaaagcagatcgtgatgagaactctccatatgcagctatgatggcagctgttgatgttgctcaaaaatgcaaggaattcggaattcatgctttacatattaaactcagagctgttggtggagtcaagtcaaagacaatgggtccaggagctcaatcagctcttagagctttagctcgtgctggaatgaagattggtcgtatcgaggatgttactccaattccaactgatagcaccagaagaaaaggtggtagacgtggtcgtcgtttgtaa

SEQ ID NO: 2849 - DNA, 216 bp, Cryptosporidium hominis
atgggacatcagcaacttgagtttccttcttctttggagccattttaccgtttattatctcaaatttcagctattgtgagaaaaattaatgttgcaatttgcttaattacaactggtaacgaattatcgatgtttccttattttgctttttttttcggagacagacttattttaacaggcgccaattttaatattactaatattaataattattag

SEQ ID NO: 2850 - DNA, 1797 bp, Cryptosporidium hominis
atgcgtccatctctacttttggggagttctgtgagaagaaaaaattgcataaaaaactacttggtatcctcagatactgaaattgatgatgaaaataataacataaatactcctgtaaaaaatctaactgtaaagctaaaagaggagcactattatagtgataattcaaacattaatgaatgctcctcaagaccatcaataagcttagcaacatctgttagaagaaaagtgtatcacatagactcaagcgaagatagttgtacagaagacgtaaacttaagctatttaaacagtcatccaagtacttttacgtctgatatactggaaaatctccatgagtccccaactcagccttgtattcactataaaagtgaatttgagccaaataacaatccctcttctaattactcaagtattggaagtagaaggagaaactgtatatttagtagcgaagaagaagatattatcccgttatcttcgaggccttcaattaaatatcagtcttcagttagaaggaaaaacaattcaagaaaaatttttacaataattgattcagattctgaagatgagttaaacaataatgtagcaagcaaaagatcgtctttttgtctaggcccagaactaatctgtgagccaaatattctcaactatacaccagaacaacacaatatctggaggtcatttgactctgatttagaaatagatgaaacaaatgtttctatagatactctacaagaattggagtggaaaacagctatttcatcttcagactttgaagatgaagaagtggaaagaaaacatcagattggttatcattctgaggaaattgagtctgaagacaaaactggagaatatcaaaatactcccagaatggatgaaaaagaagtattaccagaaaaatatagtttatttagtgatgaagatatagaggatcaaaagtctgatttggaggagatcaaggaaaatgttagttcaaaagatctgaactctaatcaagtaacaaacttgacaaaagaaatccccttgaaaaataaatccgaaaaatttggagcattcataagacaaagatcatcaattgcaaaacattggtaccaaaagtttaataaacaagttttccataataggcttccagaggaagttccaattaaatggacaggaaggcttcaaagaacagcagctcaaacactttttattactaatatagatggttctaaaagagtggtaattaagctttcaaagtatgttttggattgtgaattcagattaaagaaaacgctgctacatgaatgttgtcatgtagctcaatttttattagattcttgtattaagcctcctcatggacaaatatttatgaaatggggaaaagtagcttcaaaagtgtttcctgacttaaaagttgagatatatcataattatgaaataatatacaaatatagatatcaatgtttaagatgttttcagatgtttggaagacaaaccaaaatcaatgatgaaaccaagattgtttgctcagtctgtaatggtacagtaatatttattggaagaggaactttaagcaatagcaggaaggaatttcaagtaaaagcacagaaccctccaaatacacagaagagtaaatccaacccttactctgagtttgtaaaggagaagtttgcagagttcaagaaggatattagggatggtagaaccccctccagaagagctccaagcataatgaaagaaattgcaaagctttggaaacaaaaaaagtctgaagatttgattcaagacttcgaaaagctttccataaacgattag

SEQ ID NO: 2851 - DNA, 222 bp, Cryptosporidium hominis
atgattgactcagcttatattggagcttatcatatgaatagcatcggaaatattataagatacaaatatacattttataaatatgtaaaatactcgttaataattgatttgatactaatttgtttattcgtaataaactcattgatttataaatataggttagtaaaaatcaatagaataagagagcaatgtaaaactagtatgaagcaaactgataaatag

SEQ ID NO: 2852 - DNA, 468 bp, Cryptosporidium hominis
atgatacatccattaagtccagattacattgactgggaattacattatccaaattattattctgataaggaaggatttaaaaaggagcttcatctaaatactaagaagtaccccataaaatacagtgaaaacaaaatttcaagtgaaaaaagtgcagcaatttcgaaacatttaaagatattagatattggatgtggatatggaggattactagtttggttgagcgaaaattttaaagacaaacttgcattagggttagagattagagagaaagtaactaattacgtaggggaaagaatactttcaatgcaacaaaatggtactggaaagaatattagtgtagttaaaacgaatgcaatgaaatatttaccaaattacattacaaaacatcagttagaaatgatttttatttgtttcccagatccacatttcaaaaaaagaaactggagaagaagaattgtgaggtaa

SEQ ID NO: 2853 - DNA, 441 bp, Cryptosporidium hominis
atgataggaaatatgaggttaatatttattattgttggtttacttattggattaataagttgtgaggaaagagaaaatatttcgatcgaaaattcaataaatgaaacaaacattccaaatgaggaaactaacctaagaagattgtatggaaaaggccaatacaatactgtatatgagccagtatatatgcaaaaggtacaatatgtaccagcaaagagctataagaaagtaatgtatacagttccagaaaaaagcacctatgtagtacctcaaaaacagcaaatgagatatgttccagttggttatgcaaaaggaaacccttccccaccacaaatgtatgtgccagttacaaaatctgaacctaatgtttatgttccagtaacttatagtaagggaatgagatatttggaagaatcaccagaagagctcattcatgagtaa

SEQ ID NO: 2854 - DNA, 135 bp, Cryptosporidium hominis
atgccgtattctgatattcaaagtgcaatacacaacatttcccaaagactttcactcctagatacaaatagactagaaggaatttttagaagagtgcaggtaggttttgatcttaataatcaaagaagcaaatga

SEQ ID NO: 2855 - DNA, 558 bp, Cryptosporidium hominis
atgataaggggcacagaggataccgtatttgaatatgatccggagaataggaacgaacaagagtctcaaaacgatgagaattctctttcaaatgataattcttccatattgaaatcatatagaagaatagtacaaagtaatgaacagatgattaatggagaattagtgaaaacagactatttaaaattaattaaagctttatctactgatgagaatattaaattaaatagattaaagggaaccacgctgagcagtgaagatgtgaatggttcattggttcgtataaaatctgagatttctgaaatagaaaatactgtaaaagcttatgagactattaagaagggggaacatgaattgagtaaaagttttaatgttgcacttttgaatgactcaacatcgctattatccgatattgaagatattaagaacaacttaaatagtctgattgataaacaaaagtcattagagaactcaatgagttccttagatacactaaaacagcaaagctttacaacaaaagatttacttgatgagctttcaaacgtaggtttaatttga

SEQ ID NO: 2856 - DNA, 675 bp, Cryptosporidium hominis
atgcttagaaggctagttgcagatcaatttgtgggtattaacactacatcattatatagttccgatggaaatacaaagacttcgaatattgagaatgtaattgatacaaatggagaaatttcaaataccttaaattataataatactgctcatcctaactctaattcgacttccaacaatacagagcttttaagtaattggaacgaaactacttacttagagagaatggaagttcttgctacaacggaagcctttggtgactggaaagatctatggtctccttcaagcatactaaatagcaattttcagtatggaacagatatatctacaaacattaaaaaagcacttttggtacacaaatttttgtccaaaccaggaaatacccattggggagcccaatgggatgtaaactatatagagaaaatctataatgtcaaagttataatactatggaagaatagaggaatcttttaccctacacttggagatcaagtggattacacaaaaattgttttaatttattacgatgatgctatagggcactttcaagtaattgggctcaaaaaaatgaactcacctcccaaatctgacttaacttcagtgttcagtaaggaaaaaatccctacttcactcaaaaaattatataaagatgatacaaacaacgatttagactaa

SEQ ID NO: 2857 - DNA, 939 bp, Cryptosporidium hominis
atgtttaagttaatcggatttactttgtcaacaaagggttcaaagaacaataatgaatttgagtttagcgaatttggcttaaccttgtcacatattacattaacagaaggtactcaagttagtgtatacgtcaagtttccaaccgatcagggatatccacaggacgatttaatcgtagcgacagtaactaagtctcaaccaaatgcatgtattcatcaacaagaatttccgacaggctcaacattgtactgtaaaggaagtggtgtagtagattgcattgccaatctaccagtgcaagactgttgtgaagatggatgctgtgaagctaaccattctgatgatgaagaatctgaaatttcttcgcttgaaggtgatgaatcagagaagcaaggagaggatattgaaatgaaaaacttcgattcagaatcagagtctgattcattatcaacagcatcagagaaagagccacagaaaggtgggaaaaaagttatcaaaacaatagaaaaagtaaaggctgaagataaaaaaaaagcttctgctttgacaaaagagataaagaacgttcagaatgatgttatttctccaggattcaagaaagagtttccaaatggattaaaatatgaagttttatctatttcaaagaatgtgaaatcagatattcctcagattgctctcgtaggaagcaaagttaatgttaaatatgaaggtagattagcaaaaaccggcaaaaagtttgatagtggaaatctttcatttattattggaagcggacaggtagttcctggatttgatcagggagttaagggaatgatagtaacagaaactagaagagtattcatcccttcaaaactaggatatggtgcaagaggatgtcctcctgtaatacccaagaatgccgacttagtttttgaaattacattgcttagtactaaacattaa

SEQ ID NO: 2858 - DNA, 639 bp, Cryptosporidium hominis
atggcagctcaagcaccagaattcaagcttgcattggttggcgatggaggcgttggtaaaactacacttgtaaaacgccacttaactggagagtttgaaaagaaatatattccgactattggcgttgaagtacatccattgaagtttaacacagatttcggtccattaatcttcaatgtttgggatactgcaggccaggagaaatttggtgggctcagagatggttattatataaagggacaatgtgctattattatgttcgacgttacttccagaattacatacaagaatgttccaaattggcacagagatattgttcgcgtttgcgaaaatattccaatcgttttggttggaaacaaagttgatgttaaggatagacaggttaaggcaagacaaattcaatatcatagaaagcgtaacctccagtactacgatatttctgcaagaagtaactacaactttgagaaaccattcttgtggttagcaagaagattaacaaatcagccagctttgcaattggtcggtcagcatgcaaaagctccagaagttaatattgacccaactctcgttgctcaagctgagagagaattaagtgaggcagcaaatgcaccaattgaagatgatgacgaagacctttaa

SEQ ID NO: 2859 - DNA, 876 bp, Cryptosporidium hominis
atgaataagagttcactttggtatttaagacctgatgagtacttgaaccgcttcttggaacaaggagtaaggtgtgacggaaggaaacctgaagtttgtagaaattttaagctagaattgaacgagctaagctctagcaattatggagctatctctgtcagaatagggaaatcatcgtacattgcctgttgtaacccccagataattcatacaggccttgatcaagaatcaaataatgccataacaaatacaagaataaatgtttccttagaacttccaaccatatgtggatttacaggcaaccctaatcattccaactttgtctccaattcaatcacagagtgtttgaatgactcacgcattattaacaaggaagcattcataacaaaattccagggtaaagagttacactggttgattgacattaaagtggtttgcctatcttacgatggaaacccattggattatacactaattgcatcgattgcatcccttcgtaatactattttacctaagaacttggtttgggatgacgactacaattggttcaggatttcctctgatccggtttctaaagatgaagttaaaagagaacaaatgatgcaagatagttcaagtttctttctaaaaaaagttccaatatttgtttccttttcataccttaatgatagcatatgggtttgcgatccaaactacatggaggactcgataggaagcagcgttactatttgctgcgttgatagccaaatcaacactttacagacccaatgcattagcaaatacactccaggaaagttaaaaaacgacctgagccaacttattgatgttgcctctaaaagagcagacgaaatcagagcatgtctcttggggcaatga

SEQ ID NO: 2860 - DNA, 912 bp, Cryptosporidium hominis
atgcaaagctctaaaaccattaccgatcaatttgaagaattgattaagaaagcaaagacattgaataaaactcacccagtagttcaagaagaaaatgtgaacgataaaaataaaaagaatgaattaaattctgccaaacttgaaatttcaatgcttcagaagcgtcatgaaatgtgtgttgtacaaaaaaatgctattaaggatctaatcaacctccataaggaagaattacagcttttagaaagtgccttaagaacaattgaatctgaggagaagaaagtacttgaaataatacttagggaaactcttgatggtgattcacttactagagcaacatctgtggaaatggttgagcgtgataatgactctgcatatacaaaatccatcctcccatctgaagatttatctacacaaactacttatgagaatttagaacatgaggtttcaaaaagctatactagttctaataatagagatccagagtactcaaatgatgagtattcctataaagatgagctagaaagtgatgaatctaatgattattcagataattcttcagagcaagaagacttttcttcaagatattcaactaatagagtaaatacagaaagaaaggtcaggttttcgattgatgacttgggggttagctcagaaactaaatcgaataatgcatcaaagtccaactcaagttatagtgttacaaatgcggcaaggccttccaattcaattagaactacaataagtattcctcaaagatataattatattagaaacagaaattccagtctaatgaaagagatttcaattaaaaagatactggaaggtaacagaaagctagatatggaagaaaaagatcaaggccaaagagaattggtgagaaagcttcatacattatattcatctaaaagatag

SEQ ID NO: 2861 - DNA, 2259 bp, Cryptosporidium hominis
atgactctcagatcgaaatatcggagtctgaaatctaaaaatggcaattctagaccaattggtactacttccaaaaaaataaggactgatacgagaaaatttgattctgatagtactctaagcgacttagatggagaaataaatgggattatttcaaattcttcagatgtatattctaagtggatgcaatttgttcgaaatgactttcaaaataatttaaaggaatcttcaaaggaaaaggaagctgaaagtaatgacactgaagaggtcactaattcaattgatactcataatggagcattagaaggaaatgttgaaaccgagataacttttactaaaaaacatggcgaatattttgctgactataccaatgatggtatgcaacaaattcctgagattaattgcaaagtgactgcaggatctaaagagaaaactgagaaggagatagtaaatcttcctggttttagtccattcaaactcgagagttcccaagtgtctgataggattagagacattgaaaagttaatattagaaactccaaaatttaggaaaggaaaacttaatctggctaattttcaaatggattcaaaatttaggcaaaattggggaaagcatgtggaatcttttgaaattctagaatctcatgaattggatgagttgaataccttttatgggattgttaatggctacattgatgtagaatattcgaatttaaaagccattacttctccttgggcaatgtcactttgcatgttacatattagtagacatatatataactccagacagcttgtaatgaataataactcaaaattgcaagaagccattaaggataagggtaattctaatattgataatttaggagatgatagattcagagatcaaggtttcaatagatgcagagttttaattttgtgtccattcaaaggagttgctaagaaacttgtagatactttagttacaatattaccccatggaaaggtattaagaggatatgacaggtttgaagaagaatttgggcttcctgataattcttcggagaatgaggaagccaccaatgaaggtaaagagcaaattaagaaggatcaaaaggctgaaagcgtagaaaatcagaacaaaacaaatttattagaaagtaaattaggcagaaatgatgagctttatagatatctttttgaaggtaaagaccatgatgacgaatttaagcttggcattcagcttaccaaatctggaatgaacctatacagttcttttgacaactctgatattattattgcttctccattaggtattagaagagtgatggggatgagtgaaggaggaaaaggttcagatatttcgttctgttcaagtatcgaagtttgtttagtttttggagctgacataatttttatgcaaaactgggatcatatacttgatgtatttaaagtgatgaacaaacttcctaaaaaatcactaggaaactgcgatattagaagagtgtaccaaacattcttagatgggaattcaaaggaattcagacaaacaattatgatttctgcatgtagaatagaagatattaattcattatttagaaaccatacacaaaatagaagagggtttataagattatggaaaccactagagaagataataggatacatggagaagaatttaccattgtatattgcgccgaagttagtggagggaattcaacaaatgtttattaagacaggtgacacagggacgccagaagagtgtttgcttaattactttggttcaactctttatcctgatattttggcagctttagatgggaaaacagagagagtattaattgtactttcaaattatgtaatatatctgaggattagaaaataccttcttcaacaaaacgcaatatttgcttcatgtaatgagtcaacatcaaatgcttcactttctagaaatagatttgcattttataaaggagagctcccgattttaataactacagagaggtttttattctttaggagataccttcttaaaggtgcaacaaaggtgatattctgtggtcctccaatctacccgagtatttatctggattgtattcaaagcattaacttttcacaaggcccagataaaagtaatccaaaatctactgctccactagcaattactctctttcattggcaaaattccttagctcttgaaagaattgtcggtacatcaaagtgctcaaatttgattcaaaatgcaaaggcatccaagccagtagtttttaaaatacctaaataa

SEQ ID NO: 2862 - DNA, 603 bp, Cryptosporidium hominis
atgggcagtctattagcagatgcatttgctatgtcagttggagagtatgttagttctaaagctgaaaaggagtttgttcattctgaacaagaaagagaaaaatgggaagtcgaaaattacccagaggaagaaataagtgaaatgtacaatttatatcagttaaaacatgggttttctgaagaagatgcacagaaaatggtagatttaacttttaaatacaaggatttttttatatcaaacatgatgtttgaggaattgggattgataattgagcaaggtgactcctctcaaccctcaccactaaaaactgctactttcatgtttttcagcttcgcactatttggactcataccaatgctttcctttgtttcatttaaatacatattttctctatctgatctactcaacgagttttcccaggcactttctttctctacggcatgtatttgctgtgctgttacactttatgttttgggatatgttaaaggaaaattctgcaatatgcctccaattagatctgcaattacaatgcttattagtggacttatcccaggcactgtttcttattctgttgcagcttttgttacttaccttacaagttaa

SEQ ID NO: 2863 - DNA, 3495 bp, Cryptosporidium hominis
atgaacaatatatttggggagccaagaaatgaattttggtatagaattaacgaacaagctgcaattagaagaaaccatccagaaaatgatcttcttcaaatttcagattcatacaataccccaggaattaaaaataggtttgaaggactaatttcaagctactaccaagagaataatggtagtaaaaaccttttaatgagtacaggataccataagaatgttacagataagaactcgactatggataagaaaaatattggaagtacctctattattagatttcactcgcactttttaaacatgatgaaaaagggattaatatgtttttcatgtggtagtattctgagatcaagctttggaagcaaaattaactccgatatcaactcaatccaaacatgtcccagtaattctgatgctacaggatttacatgcgttgttgaaacatgtggaagatcaatctgcaatccttgtcttcagttttctagagttcatgatgtatctctttttaactccgagctaagtacctgcataatatgtgaatatcaaaatgagtataatcagagaaacccaattaacccgagagctcccattgagtggcactggacatttcatactccagaagatttaacttttcttagaaaggtcagaagtggattgatcaatggaaatgggttacatattgaacttagtggaaaacgccagggatgttggagaaggagaaaagatggaaaaagaaaacacttcagttttaaacaacacggtggcttttttgagagtcgagctgttgccctggaattcaaagctgttcaaataaaggcaggaggccaagattaccaatcagctccactaatgattactgctattggagaaagctactcggaaattgtgcctagaagaattcataggggaaaccaggaactacatagtcaccaaagactcatcctaagcagtattaatgatggatcttgtgcaatttgctttcaaaaacaggccaatctttgtcaaaatgcaagtgcaaacgccacaattgaatctagattttccagttgcgttgcatgtggaagatttttctgccacttgtgtatcttgtatatccgaagcagcaatccatgtagtccaatagctgctcatttcctaagtgaaaaacttatttgtgctttgtgtcaacacttgagcgttcagccaactgacaagtttgctcagtttatccacgacttttgttctcttttaccatcaaatactcccctaatcaaatttgacaagtataatatgaaatggaaaacgccttatggttctgtcagtgttgtagaatctggagggatcttggaatccagaagagaggcctactgtcaacttgaaactgggcaaagcttagaagttacatgctcatatgataggaatatattttatggtgaaattgggaacaagcttggttactatacacaatttgcaaaaaatggaatgctaagagtctatggcccatttgaaacctatgatgaagctggaagaaggtgggatttggatgctctcaaatactatggggcagagaaagcaatgagaaaggcattctttccaaaacttttgacctggctttctctccctcaaactttacaaagatacttccttgctccttggattgtatggtcaatggataaagacgatagttgtcagaaatcccaaaaaaaagttggacttacaaataatcctatcaccaaaacatacgatgttataatcattggagctggagtttctggtctcaaatctgcagaagccctacttaacaaagggttcagtgttcttgtgctagaagctcaaaatattccttttggacgaatttccagttacaaccagtggacaaatcataaaagaagactttccagtgaaatttgcttttacagagaaaaaagagatactagggagagctccagagaagctgataggaaaaagaataatgacgaaaatacggaagaattggttagccagctttctgaggaaacagtttccatggcaaatgaactcatccggctttctctcgagttacttgaagaagttgtgattgacatgtttcatcctctttcaacagttctcgagcctccaatcaaagaatttatgtgtaaaagtggaaatgattactttgaaagggttaatccagctaaattggtccttcagagaattaaggaatttggagaaactgtcaactggaggtggattcttattaactactgtcttccgctttccttgaaaaggttaaatattaagaatctctccaatttctcaaaaaagtacatagaaaaggcaacatgtggtgattatggagagaatctattcaaaaatatcgaacagttctactgggaaagacttccaagatttgtaggatttgaagaactcccatggagggagtactggtgttaccccaaaaacaaccttgaaagacttaaattctctgcaagcatattccatcatatccaactgcagaaagaatctattatagaaagaagctttgatgagtgtgatcttattgactgtgaacttcaaaagttaatccaaaacaacgaaatacttaataatactcattttaatagtccggtttctgatatactatacaataacgagacagatcaggttaacgttagaattagtaatggaacatggttcagctcttcatgcgttatttgtactcttcctattggagttttaaagaagagtgtccaatcatctgagaataatcctgggaattctaataaagtacaaggagctcaatgccaactttctaatatatcttcatttaagaattccatcaaatttatcccaccattgccttatgaaactattaggtccattaagctattggaaatgaacagctacactgaattatttttaaaactaagtattaatccaattctttctaactcagggtctactccaagtacaaattgcaacgcaatctctagctctccatcatctatcatcacaacctcaaactccgtcaaatgcgaaaaggagtcggatatatacttttcgagacttgcagataaaatacaccatctagaccacccatgcataactatgtatacccataaagatatcccaaatacaatcatgtgcggaattactcctcccttagccgaaaagatatgtccacagattgaatcagagtctgattcaactccaaacccagaattcttgagtcctcagcagctcgcgaatatttgttttgggatacttaaagaaatttctccaaaagatctcgaaattgatcttttggacttttatgtcaaaagctggaaagatgacccctattacttaggaagcattccaattcattccagcaatagtaaggagtccaatattaatcaactaatcaaaccacattttgaggggcatttgtattttgcaggggatggaactactgttgatggatttggttctattcaaggagctcttttaagtgctaaaagagtgactacccaagtttcccaatttctatctaattaa

SEQ ID NO: 2864 - DNA, 1179 bp, Cryptosporidium hominis
atgcaacaaactacggtgattaaatcaaaaacaacaagttatgtagttttgcaagatttaggaagtggaacctacgggcgagttgtgaaagcttatgaccaaaacaaccccacccaccttgtggcaataaagctatttcaccttgaagagcacgaggatgaaggggttcctgccacttccattcgtgagttggatatattacgtactttaaaccacccgaatatagttgacttatatgaggttcattatagcaggccaacagatggctctccattattaatgggagtttttgagctctgtgcaaatgatttgaaaaaacactgtaaagttcacactcagcaattgagggatagatatcctgatttaaagaatccaatagcagaacataccgcatgggctaaagaattaatgtttcagctattgaatggcatggcatattgccattctcacaatataatgcatcgcgatttgaagccgcaaaacgtacttatgggaatggatggcgttcttaagattggtgattttggccttgctagggcctgcagactaccaataccagagtatacccatgatgttcttactatgtggtatagagctccagaaatcctattggggattgataaatattctccttctgtagatgtctggtctgttggatgtataatggcagaactactaagaggcggtcacgcacttcttccaggagaatgcgaaatagatatggtctggaggatttttaggtattttggaaccccaactgaggaaagttggcctgagattggtaagctcaaatactttgacaagaacttccctgtgtggacatgcaatgtacaggaaaatcttaaaaacctttgtaagctagctgatgcttctgcaattgatttgctatccaaattattggtttgtaatccaaacaaaaggatatcttgtaaaaacgctcttttacatccatggtttgatgatattgataggtctaaatatgttatgtgggatagcagagttgttcttccatctccaagaaatttacattcaaggtttaatgaaatgattaatgatgaaaatgttcagcagaacaatcgagctagtcgtagatctttaaccaaaggtgtttcttctgacaaaaggaggagggattccgataagagaaatgcaaagccgactgttggagctgtattatga

SEQ ID NO: 2865 - DNA, 1938 bp, Cryptosporidium hominis
atgagtctagaaaatactcatttagctgagagttctgtaggggaattttctattttgaaatatgtaaagagcgaaactctggtaaatttgtggttaacagcatatttcgagaaaagaatcaaaaagaaacagctgatgagcattaatattgatgaaagcgttcaagaaatcatcaaaattacaaattcggaaaatcaatggatcccactgaggatttcatgtggtttattaacgggtgtagttaaacttttttgccataaagttgaatatcttgataataaatgtacaacagtattcacaagaatgcagaacttcagtaaaaacttgcacagcaatccaaataatttgaattctatcaagtttattaataaggaaggatcaaatcccaaaatagataggcctcaaaatcattcgaaacaactaaaaagtgtaatagacattgaggatataaatttaactctgaatataaatgagaattcaatagaccagttggaaatggttccattatcccaagtaactgagaggagcgagaatccaaatttagaactgactttgagtcaaagaagcgaccagaatctgtatcaagcaggttcaatgccaattttactagatatggaatttgatgatttcattaacaatgaagaaaatgaagacgcagatgtagaaatgatgatagaagatagattgatagtcaatgagtcaggagtagagattgatttggaggcaaatattgaaaaacgccgtggtgcaagcgtggattttagtgaaatcttggctaatggactagaggaaattggctccattgaaagaggaaagctatccgaacatggtagcaatggagatttgctagatattgataatagccacgaatataggggaagtattaatacatttagagcatctcccatttccggctcaaatagagatagcatcggaggattttcagctgttttagatacgcttgaagattctggaaatagattgagtatttcaggaattactgaaagtattttggacaaaaactcaatattaaacaatatttcagctttgaatcttccagaaatatcaaaatctgtcaaagttagtgaagcttatagcggaagagtaggaacaaaaagaatgaaagtaatcgagattcctcaagatattgtaacttcttctaggccattggaaaatggagataaaagtctaagtattgctttctctaatagtaaatcggatgtaaagatattgaaaaatttaattaatttaagcaagaattctgaaatgggggttttaggtctcaacaagacccttccaatacgactttctgacgaattcctcatgagttttataagtaatgaaggacatagagttaaaaatatcaggaaaagaaccatccagaaaaacaataagtcttcatttgtatctgagtctgttaaaagaacttcaaatccttcaataaaagcatactcttcatttgaaagccttgaagaccatgctgaacaggaaatctatacaaattctgtttacgaagaactaaatcccgatgaagaattccaaattaatactcctgtaagaggcaaaaagtcacaatctcaagactttgacgaaaaggatgaattaacctttactccttggacaaattattttggtactgcacaaagaaatattataaacttatccccaaatacttactatgatgatgaggaaaaaattcaatcgctattttcatcaagagaggtaaaaacaatggaatatttaaattctaagttttcaaaaagtgataacctaacttttgatgaacttgtaaaaggtagcgacgcttctgtagttgctcccattttcgtccaaatactacatttaaagtcaaagtctatgatagatattcaacaagaagaaccatttggtaagattagtattttcccagtagtaaataatgcacataaagtaatgtaa

SEQ ID NO: 2866 - DNA, 4356 bp, Cryptosporidium hominis
atgagaaacccaattcacaccttcttcggaattaatttcacaggtttgttagttgttggtgctccaattgttcaattaacaagtggtataacatcaatgacggaagaattctgttggcaaattgaaaatggagatatttattcaaagggtgcagagctcgtattaggaagttgtattgaagctgtggcatctggagatagtagagaaatctttgaattcaatagtaagggtcaattatttaacccagtaagtaagttgtgtgtacgacttaaagacaatgttgtaggtggaggagctctggttttagatgattgtcgtaaagctagtgatggaagtggattattcgaattaatgccaaacaatcagctcagattagctagaggtgggaatctatgtttaacaagtccaggggataagccaggagttgcgaatgttgcattaaactcagcagctagttccacaagtgtggttaaaacaggtattgagaatggtccggcaatggctgttgatggaaaggatacatcatattggttatcagattctttaactcctggtaaagattctgcaaatgttaactttttgattgataccggttcagttacaaaacttaaagatatctttattgagtggaaatatcctgccattgactttaatattgatttaagtgaaaatggaaaggaatatcaaacccaagtttctgtgaataataatggattaatgtcaaccacttattcattagaaggaaagaaagcaagatatgtcaaaattcaaatgacaattccaagccaagatgagacagggaaatatgtgtatggtatcaaacaggttagaatattcagtaatactatgagaagtgctgttgaggattgtagtactgttaaacaacataatgatggtagagacaaaatattcccactcccatataatggtgataattttgcacccggattattgttaaaggctcacggaattagtgtaaagaatagattaaatgaattacaagagctttctggtaaggtaacttcaatattaccaaatttggatgcctgtagaaagacttctgatggaagagataacacattaaagatgcaggcaaccaaattaggatttttgtcagaaaaattggagaaattaacttccgactataatctcgagtataagtttacaaagccatctttaggaggttccgagttatatccaggggaagattgtgttgctattaagaatgataagactcaggatgccattagtggtttttattatgttagaccattctgttcaaccaaaccattgagagtttactgtgatatgaacactggaaacacaatctatccaatggaaatgagtgttcattcttccagagcagcctcttcagcatgtgcaactgttggattaaaaccattattgttaagggacaaaaaggaatctgttgcaggtattaagaagatgttgaatatgatgaatatcaatgataacagaagagttattcctttgactcacgactttggttgtgataatcctaaaggatgcaattcacaatttacacagttaggcagtggtgttgaagaatttgttgctgcatctcctcagggagcagcttcaaactctacatctgaagcacttccagaactggttctttgcagtacaaataccaatttgaagcatgaaagcaatgcaatttctttgtcttgtgaaagcagattctctgatatgaatgtatttaaatcatctcctctcttaacttcaattctagtcaagtgtccaacgtcatgtaatccagaaaatggaggagttgtaataggttctgatgtatacagagatgatagcagcatttgtttggcagcaatgcatgctaatactctcaatagatcaactggacttgctcaaattactccaattgaagggttggaaagctatggagcatccattaaaaatggtatttctagtgttgcttatactggaaagcgttggaagaagagtttcgtaacttccaaatacgaaggattatgcccaagtgatagtagcctttcaatgttaatttcatttgtggaactggaaaataaaggaaatgaaaatgttaacgttaccagcaactatacaatgcctcaagcaaaatctcttggaatgggagtagctgtggatacttttgaagcaatcaatatgatggaacgttatatggataacattggtggtattacttattctccagcaatgaaagagtctattggtggtagccaagttctggtttcaaaggttagaagtcaattaaaaccaactcaaattatggattaccatacaagaacttcagctgacgatatgttggtaagattgcatactgtctcaagtgtattatactatcatatggaagaaatcttggagacaattgtagaacaggaagatttattaaacaaagttcgtgaactgaaatcaactcaaacaggatttgacagctttaagatgccaattagcgattttattcagtttggtaagatattcgaatcttgggatactccaggattagttaatggagttggaaattggagaattctttatgaaccaattggtggaggaggaagaagtggagttttgggtcagacaagttcagttggtccaaatctccctgatagaactgtagctattggatccttctcaagaatcaaatataagaaattctatgatattgattatcatgtggatgtttatgttgatagttacgaaggttcttttggtttgacattcagaatgcaaaacttcgagagatactatcttttagagattaatcagaataaaaatggtggatttaaaagactgattagagttatggatgggcagaagagtatattgtccactaagtatgatggtggatatgttacaggttcatggcaccatgtcagaattcttttaaccggttcaagaattcagatctgggtaggaaccgaagctaactcagtacaagatgaaaataagaaatactcaagtccagttaaagtttttgatctatatgacagcacattattatcagggtctgttggattcttctcgagtggaattagaggaggaggagtatactttgataatattaatattgaagctaaaccatgtacacaaccaacaataatatcatcattactaaggccaagcgcacctccaacagctccagtttgtagcagctacaagtctggctcctttggaggagtacataatgaatttatgtttgtagatccagaattgtcaaatgatggtccttcaaactgggagttccgttcaaatgttggaggattacaaaccagatcattgatccaaactagtaatattcacagtattagctctgataatattggtactcatgcaattttgggtggaaatcgtcaatgtaactccggagtatttgaatattcattcttcccacaatgtccaaatggtattattggtggaattattcactatgaatcagagtcaaactatttaatctttgaaatgggatcatattattccagaatcagagctatcaaggatggtgtaattaagactatagcatctaatgtatttgttggataccaggttggagtttggaataatgttgaaatccaatttggtactcttggaacaaagattcttgcaagtaccaataactatggtaagacacaattattgtattctggttctccattgggtatccatgatggttctgttggtctctcatctttcagatgtccaggtgttgctttccagactatacaattaaagcctttgtcaacaatgaaaagtatctcaggtttattttttgaaaaagattcatcatcaaatacgaaagaagaaaccaagactcaggatggaaagaattttactactacttctgaattcaatttggatagtgaaatgacttgtcaagctggtcatactactttgagaaagaaggactgtgagaagctttcaggaggaaaacaatgtgagacaaattattgttcatactgttgtgaaaatggtgcaaatagaacatcaaaagagcaattaaagtgtaagcaggaatgccacaaaaaagatgttatggatgaaaaaagcagaaaggtattaaagaaacttggagattgtcacagtgaagatgctatcaaattatattctgataagtgtaatttcactgaaagaaaaggtcaatttagcattaatatgctcgatgatgaatggactaaacaattcgtatgctttgtagatatgtgtcagatgtgttgcaatactcagcctatggatggagtcacagaagattccaaagctgacgaggcatcactatcagaatgttacttacaatgtattttacaagattataaaacaatgtcaatatctaaaagcaggaaataa

SEQ ID NO: 2867 - DNA, 1377 bp, Cryptosporidium hominis
atggatggggaaaaattaagtcaagatttgaactatttggtttttagctgggaatcaaaatatgtaagaaatgataaagttttgaaggaaaaaataactccaattaaagaacataactggaattctgagaaagcagaacaagatgaggatattgtctcaccaataattaataggcatattcaagaaattgaagaagaaattcaaagaattaataaggaaaatgaggataagaggaggaaagaagaggaggaaagaaagattaaagaaagaaaagaacgagaaaagagagaacaagaagaattaagactaaagaaggaacaggaagaactaagactgaagaaggaaaaggagcaggaagaattaaggctcaaaaaggaacaggaggagttaagattaaagaaagaaaaggagcaagaagaagaaagacaaaaagctcaagatgaagcaaaaagaaaagaatttaatctaagtcaagattaccccaaaaatgaagcgaattttgaaacacaaggaaaagcatacattgaaaagattagtaattatcagaactccagtgaatataaggaaattatttcaagtacagaaagctcaataaagtctacgaggatgaatgtaaagaagactattcaactttcgattaaccaaatatcatccacacatcaacagattttatcttcttctaagagaatcaaggagttactttctggtctaagatcctcttcaacttctattacttcctctgacactcaatccccaatgtatagctatggattatatatggcagcatccctatttatagatcaatgctggactcagatctctgctttccctgactcagtttggagctatgcatattcctgcgtttatattctggatgaaaatgatgaatttgaagcatttcttgaaggtctaatgcttacagagtgtcgggtattatattcaagtaatcttgaagatttgaataaaaaggaaaatgaaactgaagaagattttggaaaaagattgaattcaatagttcgattttacttatcaatcaatattctgagaggaaactttggtaaaatatggttatggcttgtaaagttactaaataaaaaatcccctcatagattatttgtatttgtcgtattagctgtaacacaaatcgttcctcatttcttcttttctcaattcaagaatcaattcatgaaaattatcgattatattctgagattcaaattacctcaaatatatacattaatagagggaaatccctttccgattaaaggtcaatgcaaacaacttgaggctattttgagtgatctcaaatcttcctgtaatgctcctccaccgagtggtttcatcctcaaagacaaacacttggatgttgaatgttaa

SEQ ID NO: 2868 - DNA, 558 bp, Cryptosporidium hominis
atgaagtcgatgccagatccatcattacaaatgaaagttaaccaatatatggttattggacgtggaaagccaacggagcttaatccacacccaaaagttttcagagtttgcatttttgctccaaatgaagttgtagcaaagagcagattcttctacttcatgtcaagattgaataaggtcaagaaggctaatggtgagatcctttcagttactcgtattttcgagaagagaccaacatatgtaaagaactttgcaatcttgcttcaatacagaagtcgtacaaatgttgtatatatgtataaggagtacagagacattagcaagactggagctgttagccaaatgtatgaggaacttgcaggatcacaccgtgctcaacgtagcagcattcagattatccgtgtttctcaaattgatgctaagcttgcaaagagaccaaagactactcagttcttcaactctaagctcaagttcccagctatcagaaagttaccaatggctccaaaggctttacgctcaacatttactgcatccagaccaactactttccaaaagtaa

SEQ ID NO: 2869 - DNA, 1818 bp, Cryptosporidium hominis
atgagaaaggaactagaaatgctattgaatgagtggaagaagatagtccttttgatactatttttaagtcaggtctttacggctgtacatggatacaaacatggagacattgtgagtatagttatgaatagaatatggaaatatgatgaaaatattgtgacatcagaattttcattctatagcaaagtcccactttgtcatgataaccgtaagattggggaaatgtcctttaatgaaattgtgagaggagaccaaatgaaaattataaaggcagtttttggacaaactgaaagtaataagtcgttttgcagtattaatttaacaagtgatcagctctatagcattaggtatcacataagaaataactacgttttcgaaatttacgtagaagataaagcaatagcaaagactcttggctatgttaatgaaaataacgaggcaattctaattactggctatgatttttttatagggtaccgaaataatgaaattgtatcgttagatgtaaagactaaaagagaacatactataaatatcgacaaggctttagagttaaataaaccaggaaagttgcatctaattaacatgagctattgtgtgaactgggttgacaagagtaatgaaccagcagagaaggttggaaaaagtatggtaaagattccaatgattagatggcttggagtttttaatagctcatttcttacaattcttattattatgatgcttctgttaatatttatgcaggttcttagatcagaattttcaaggtattttccaatgggagaggatgatctaaatcttgcatttgatgatgatcctatagaaatgaaaggatggaaactgttgcacggtgacatattcagatctccaaagtacagaatgatcttgtcatcatttgttggtaatggaattcaaattctatttgttggccttattatttgtataactgacaatatctcaatgttcagaaacctttcttttgatcttgaaactctcaagttcctacttgctttgttcacaatttcttcctatatctctggattcgtctcttcgtatatatacacttccatggggggaaagaagttcaagtataatatcttccttacatgttttatatacatcttaccggtatacttaatggtaatttctgtcaagtcactaactttaggttcaggaccaaacttttttaacatttactcctccattaaggtatttgcaatctattcaatgatctctttacctctttgttttattggaggactttttggtcaaaggagatccaaaaattactttaagtttccttgtaagactaaccgtcttcctagacagattccaagacaaaagtggtacaattctcaaaagttccagcttatggttttaggtattttacctttttctgcagtatatgtggagttacattatctatttatatcattctggaattacactccattttacttctataataaccagcatcataacaatttcttattattaacaatcagtacacttctacttattcttgtaggttcgacttcctcgatcattctcatttatatccagcttaacctcgaaaactataaatggtggtggttttcattccttaatggattatctccatgtgtctactttttcctcttttcattgtattacttcctttcatactctaatcacatttatggattcatccagttcaggcttttcttaatgtcaaatctgattattgcatatactctaactttggctttatcatgtattactttcatgacatcttacatatttatccactacatttataaacatataaagtcagattaa

SEQ ID NO: 2870 - DNA, 2202 bp, Cryptosporidium hominis
atgggaggtgcgcaaaccaaacaacttggagggtttcgcgtatgcaattatggagaaaatagtcttggaagacttttagaattggaaagaagctttgattatattgtagggattgatggagttcctctaactcaggtttcagatgcttctcatgacttttttttgaaaagattgaaagggattggaaggcatcaagtaaaaataaatatctataattctttgtcaaccagaataagaactataatacttaatccacataaacacaatgaaaataatgagggtaatacatctaataggagattctcagtcgaatctgaaaaagatggtctaggaaagaatgcatttgttgatgggattgagtctaatatggttgaatttgatgctcctttgaattctcttagagtttaccaattcttaagttacgatgagcgaatatctgggctcggtattggagttcattgggaagaaatatctacaaaagggattcgagttgtgaatattcaagattcatctcctgctcaggctgctggactgatatcaaatgaagattacatagtcgcaagcagcacattaatgagaccattctattcaactgacgacttcttagtatttgttaagagaaatgataaagtccctttatctcttgttgtatataacaccgagactgaagttactagggagatatttataactcctaattcaggctggggaggcaaggggctactaggatgtgatattgctgcaggtccattatacgatattcctctcagagaaaaagaggtgtcattttcaaagcctcaccatgggaacattacatatatagaggtgatcatccaaaataataatggaaaagaaacgatccagtttgatttaaaagaagaacatgaagttatatcgaaagatttcttacacggggacgaagataaggataaagatagttgctataacaaaggcaatgatcagcaacaactagaacctcagatagatgaaattcctagagaagacttgcttgttaaagattactcttttgatctttatagaattaagcagtcagaagaatcttcatttgatgaaaaacaaggcattattgaacaggctttgatcaattcaggttgccagaacatcccagatttttcaataaatccagctcaacgcctaagggaggctacaataccagaaaatgatcacgaatttacggaaaatctttctaactctagtgtaaacaatacatctgagtcatttatcattatttcagacctcaaacgttctagcaattctgatgaagagcaaaatgatgaaaataatactgcactttctaccagctctccacaatccagaaatcaaacgcagatacaaataactacagaggcttctacaacagcagaattgcctcacaaagaagctcatgaggagtgtcaaattcaaacaatctcgccaagctatactgaattctcacataaacaagttgagaaccggactcagaatccagatattgaaataaactccttgcatcaaaaccccctcctctccgcgtcgcaacaaagcccccctgaaaatgtttccggaaaaaaaccatgtgattctaattgtatgcctgaatcaccttcagaacactgtcccgccattctaccaaaatccgaggatggctttagcatgcaattgcatgcacttccacatggacaggcgggaaatgctgccgtccgttctgaccaaagtagtgaagaaaaggcttcgccattggaattgcacttaaagccacaaaaacacgaaaatggagaggataatacagttattactcatgaaaagcttctagaacccttaaaagcagaagatttaaagaatgagatcgagaaagcttccaactccaatactgatcggaggatcccccttaacttggaattcaaagaagaaaataacgcctttgatgaaaataatgaaaataaagcttttaagatgagccaaaatgatcaaattgaagagccctataatggagttactcaacctggaaatctagataccttggaagagaaaaaccaagttcatgagaagaaccaaatacaaagcccccgcaaaaatatggagaaaatgtctcccgaagatgaaagagcatgtgaaattctcaaaaaacttatggaaattgagccaaaattcaactatgaccctccagggacaatagaatacacagaccaaggagaaatataa

SEQ ID NO: 2871 - DNA, 1125 bp, Cryptosporidium hominis
atgcagaatactttggataatagtaattcagcccatactgcagaatctgcctctgttaataaaattttagcaaatgtacaaggatattatagtggagattatgattggaatgacttttacggagacgatgatgacttttctgttgacgaagatgatgatatgaagttagatcctaatgcaattctaacctcaaattcaaataagtttgatagtattattcaagataaacttaaaatattccaaaataaaggtagtacggataattctaatttaggtgatgttagatttagacagagaataagaaataggagaatgagacataaagcaaatgaagatgacaatcccgattttttgcatgacgaaattgagcaaattcaaagaggagaagaaattgccgcattaagtccagaagagatgaatgaaattagaagcacggcatggattcctaaaggagagtatataccagaagatattataatgggctaccacacagcttgggatataggaaaaagaggttgtgttgctgtaaaactagtaggaaattgggattcacatatttctccaaataaagtaagatttttcatcatggatggaactgatcccattgcatttctatcctactacacaaagagtgaccttaaagttagtagaggtgaaaaatcagaaaagaaaggaataatatttgcaaaagaccttagggatgggtattgggactatggtagatctaaaattatatttacaaggagaaacaaatcggggcaaactacaattatagaaaacctccctacacagttcatggatgctatgatggtttgtattcgcgagatcgaagtccataaaaaagtcaccaaaattattaaagagagaagaaaacaagccaataaaaatactctcgacaaaaatcccgccaaaactattgttaattctggtatttccaactccgatgatccaaactccaatctcttggacactgatatatcgaaaaataatctagtccctgataaacatgacttcattgaggatgcagaggttgtagtccctcttggaaatgctctcacaggtaaaagagcttctattacaaaattagtcgctcccaaaattgattttgagaaattaaaaatctaa

SEQ ID NO: 2872 - DNA, 1368 bp, Cryptosporidium hominis
atgagccaacagcagcagcaattgctttttggtttggataagaaagctgagaagagcattttagtatacgatttgggtggtggtacttttgatgtttctctcttgaccattgataacggcgttttcgaggtcgttgctacaagtggtgatacccatttgggaggtgaggatttcgatcagagagttatggaccactttatcaagatcatcaagtcaaagacaggaaaggatgtaaagtctgacaagagagcccttcagaagcttagaagagaggtcgagaagtcgaagagagccctttcttcagctccacaagttaaggtcgagattgaaggtttgatggaggatgtagatctgagcgaaaccttgaccagagctaagttcgacgagttgaatgctgacttgttcagaaagactatcgagccagttaagaaggttttggaggatgctggaatcaaaaagtctgaagtagatgagatcgttttggtaggtggttctactcgtatccctaagattcaagccttgatcaaggagttctttgatggaaaggagccaaacagaggaattaacccagatgaagccgtcgcttatggtgctgccgtacaagctggtatcttagcaggtgaaggaggtagtgatttattattattggatgttactcctttaactttaggtattgagactgttggtggagttatgacaaagctcattggtagaaacactgttgttccaaccaagaagagccaagttttcagtacttaccaagataatcagccagctgtacttatccaggtttatgagggtgagcgtccaatgactaaggataacaacctcctcggaaaattcgagctttctggaatcccaccagctccaagaggtgttccccaaattgaggttacttttgaaattgatactgatggtattttacaagttagtgcaaaggataagggtactggtaaatccgagaagattactatcacaaatgataagggtagactctcacaggaagacatagagcgtatgattaaggaggctgagcaatttgccgaagaagacaagcttgttcgtgaaaaggtcgatgccaagaacgcactcgatagttatgtccactcaatgagaatgagcattgaagataaggacaaactcgcccagaaactcgaggaggaagacaaggagaagatcaaggaagcactcaaggatgcagaggacttcctcagcagcaatccagatgctgatgcccaagagatcaaggataagctcaaggaagttgagggtatttgcaaccctattattgctgctgtctacggtcaagctggaggcgctgctggtcatgcaggcggcgacgactactctggccatgatgaactctaa

SEQ ID NO: 2873 - DNA, 1839 bp, Cryptosporidium hominis
atggcatcaatattatcaagtttctcctctcaatataatgagctatggaaagcaatcataagacctccaagagacagatatagtattcgtgatttaggcccaatgcgttttgctattggaaagtcaatatttaagagatcagacttcactctaagaaatcgtcgcttccaagctcttcattgcagtcattttgagcctattgataatgaaagacaatctgagtctcttccttgcgtaatttatcttcacggaaattgcagttcaaggagagaggctcttccatatattccattacttcttccaatcggaattactgttatggctgtcgatttgagcggttctggtctctctgatggagattatataagcttaggataccacgaaaaagatgatctttcagtcttggttgaatacttaagaaattcaaaacgatgtagctctgttggggtttgggggaggtcaatgggagctgctactgcattaatgtactcaggagttgataaaggtgatggtttcttaaaagggattgttatcgactcaagcttttgcagtcttcgtcagttgtgccatgagttggttcatcattatatcccattattacccaattttcttgttgattctgcactttcatttatcaaatctacaattaatgacaaagcaaaagttaatattgacgatattgctccaattaagtctgttggtcaatgcaaggtccctgctttgtttatttctggaactaatgatacattggttaatccaaatcattcaaaaactttgcatgataactatgctggagagaagatgcttatgatcatccccggtaatcacaattctgagagacccaagtttgttaaggcatcgatcgttattttcttttatacagtatttgattgtttcattattccaaaatctgcagatgctctgagttcttttttaaacacggacttggaccttctattcaactatgatggactgtattgcgatgaaaatggtagaattccaaagccaatcactcaatctttttatgctattcagcaatacataaggcacaaaactactaacaatgtctctgctcctatgaatactggattacaaaagaagaatcttggatttagtaaggaacattcgagaagagaagacatgattagatcgagttcgaatgaatctttcaatgaccaaagtcaaggcaaaggaatccaaatgcgtcctccagacgttgacaaatacattgatcgtatgattcctttaagtagtgaaaatattaagcaatcttcatctacaatatattctactggtgcttcatgctctagaagtactacttttgagactattagtcaggggtttgagaggggcgacacaatgaatactgtaagttcttttgaggaatttaaagatacttttagccctgtgacacagccaaataggtcatcaggtacagaaagcggtattgaagagagagtagttggggctgaatttgggtcagaccatttagaaggaatagttcattatcaaatctccccttctctacctggaatgaagcatgctaacaataataatagtgacaatcaacaacagtattttaaccagaatcaaaatattcatcagcattctccttcgtaccacccgtatggtcttaaccagaagggggttacttatactaatggtgccataagtaatggagctaatagtttattgctatctactggaggacttgctccttcaactataggtatgagctcagttcagcatcaggcgccaacaggagtgggagtcaaaaaaccaagtattgcttcaagtttaccaaaaagggtagctaattataactaccctgggaattaa

SEQ ID NO: 2874 - DNA, 1740 bp, Cryptosporidium hominis
atgggggaagatcaagagtggagtgattcaagttatgttttaagaagaaagtatcgattatattggattgcaatattaagaaatgctccagaaggacttgaaggattatatgatagattttcaagatggagtgttttgttaggattttcattaccaaatttagtagaagagtcagaggagttgtgtatacaaagaggggaaaagaaagtttacaaaattagttttccatctagaagctctacaagaagctttataaggctatcaaagcgtaatatatggagggaaatatcaagagacagttatagtgaattatatgtatattgtgatcctgcatataaattaaggccattttgtgattttcaaacaatgaatttatcaacatgttattggataataaggggaatttctaaagatattgaaaacgaagagatgatatgggatttagtaggacgaaggaaccaatttggtgaattcttgaggagagtagtgtacattagagatgaagaaggaaacaatggtttttgtttcttgcagttttcctcacctctaacatcatatagagctttaaagtgggaacttaaacattttaaaggatttgaacttgctcacggtaaaaaaatgtatttaactccagaatttgttggtacaagccatgtaaaggcattactactattatgtagaggattagataagtttgagataaaaacattaaagacagtagaaatgagtttaaatgatttaagaaactctgatagattaaatggcgaaaatgcgatttctcatgaaaaagttttgcaaggatatttaaacttttggaagagatcaaatggtttaccagttccagtagatagaaactcagaatttcaatataattgcgatgagaggaatgaatacatgtatagggaagctctttataatagtgggatagatttattcccaaaaaaacctattagactttattactgcaaatctttggattttctttgggactggaatagtcgtatttttatggattgccaaagtaaatcactttttgagtttgatcctgaacttcaaagtctcaagtttatttacaactcaggtgaattgtctcgattatcgaatgttggggtcggctcaacttacggcgaaattatatgtgatagaaataatcgagaagattttcaaataaaagcacaaatctcacaggaaaagctcaaaaaagaaagagaaataagagtggcctcttttcttgaaactgcaaggtctcagctaaattgcaacatgaatactaacaacatatataagaactcagtggaagaagggtacgactcaaaaagacaggagataacgcagtttttcgatatttcaagtaacgtaacttacgaaaagagtgaaacctatacaagtcaaagacccgagccacgaactccgacttgccaaaactcaagtcctggggttcaaagctcatgcgtagccaacgcatgcgcggttcccgccaaatgcgagtctgaaagtatggacgcgcggaatgtgtgcatgtggtcagtttctgatggtggagttacggagggaacaataggggaggagattggtcaggtaaagagtggaagtaaaagtggggacgcaaaggaggaggagttgatatgttttgtgtgttgcagggcttttggatcgatttgggaaaaagtgaatcatgaacaaaattcattgttgcataagtataatctggagatatggaaggtcgggagcgagcgatag

SEQ ID NO: 2875 - DNA, 1158 bp, Cryptosporidium hominis
atggcaaaataccatcaagttgactgggaaattgtgggtatatttgaagaggacagtaccgaaagtcattcaaatgagtttaagttttttgataatcacaatcccaaaaacaacctaactctgaaggatatagaaagctgttttctagatcctaataaatattgcaaaaattcttataataataatattctaaaaaacaatgttattttaactagaagctgggtttgtaaactatacatattatctggaataacaggcaaagatttatcgatttgtatggattatttagagaatctaatactaaataataataatttttctcagcttaatcgcatattctgctactttaaaaatttgccatatttgatttcttttccattatctcaatgcaaatttgaaaaatatcttgcttgttcgaaaaacaaagtccaaaaaaatgaaataattgaaaaagttaataatctaatcgaaaaatgcctaattcatttattctcagacttttctggaaaacctaatattatattaatagcaggtacttcaggcagtggaaaaagcactataagctcttacttagcatcatttttaagagtcaaatgcgttatttctaccgatactattagacacgtattgagatctacagaaaaatataaacacaacaaagctcttaattgttcaacttatgaagtacataaatataccactactcaacaaacacaaaaatataaggatcaatattcagaatcgtctattgtgcttggatacctaatacaatcgtcaattatagaagattatatttatgaaattattaagaattttgttaataaagaaaaaagtatcattttagaaggagttcatattaccccctcattgtttgaaagaatccaatctcttgcaaatcttgaaaatgcaaatctaagcacttttctaatatatattcaagatattggagaacacatacaaagatttcaacaaagaagcaagggaatcctaaactcaaaatatcataacaacattgacaatattagagaaattcaaagttatcttgtcaaaactattggaaaactaccctcagttacttctattgacaacacctccagcaacattgacaatattgttcaagagaaaatactcgaacaggttacattcaagttcctttaa

SEQ ID NO: 2876 - DNA, 1044 bp, Cryptosporidium hominis
atgaagttctgtcaaaacgtattatatataatttcaataatcattttggtggttagaggagcacccacattgaatgtaagaaatccaggagagcatggtcattcagattcaattattacaacatcaactactaaggctacacatacattgaaatcaaacaatcaatcagcttcagaagaattattatcaatgaaatcactacaaaatgagcctaattgtgaaaacgcagtattcccttcagaagtttttgcatctcaaccaagagatgacaaagtttatataaaaccatctacgatcccagaatcaggattcacaagagcaggattaacaaagtttacttctgcttttggaattcatatacttggtgattatagagtaccagacgataaattatcatatttaacagaattattagcaagtgtcttagataatgatcaagatggattggtagatgcaacccaaaatactattttagatacaatacgttcatctaacgcaatgatggttattttatctggaaatgaagaatctgttgataaattattggatccacatgaaggattaccaccagagtactcttgcatgatgtttttacttgtagagcaagccaaaaatattatacgtgggggaccacatcaaaagaattgcccacaagatttggatagagttaatgatagaggattaggatttgttgtagattttatttctcaagcagcatatcctgtcacattttcattaaatgaagaaagttctatgagaatggagaatttgtacaattctgcattaagaaagggatggtttttaccacagaatattcctgttgcaaataatgaactttgcgatgaagattgtaaaagattatctttccaatcctggcttgcaacttcaatattagaccaagataaatgttcatgcattaaagcaaacgtattcaaattgtgtacatctgaggaaatccgaaatatttcaccagatgattttgcttacttcgctagtgcattaaaacgtccaacagcatattcttctccagctattattgcttaa

SEQ ID NO: 2877 - DNA, 465 bp, Cryptosporidium hominis
atggatgttgatcaaattgaaagtaatgaaactcctaatgatgattcaaactgctcagcattaattaatagaatagaaaaaaaatcattacataataaactaatcgacctaaaaaacgaacttaatgaaattttaattttatatccaaatggcatattattaagtttattaaagagattctacaatagatattggggaaaaaaactttcaccaacaacttttggttatacacatatttcaactttattattatcagatgagctaaaaaaaacttgtagattatattttgattcattaaaccatgtaattgttcaatcaactcaattcaatattccagaaaatgtcagacttttagaagaaaagaaatttcaaaagaaaacctcttttttgaattctgacctttttgttcccattagaaatatgtcagatatttcttttgagtatatgagactattaaataaatag

SEQ ID NO: 2878 - DNA, 5379 bp, Cryptosporidium hominis
atggttagatttaaagcaaaaccattgagatatggaggagttttatatcaagataaagaatattttattttagaagaagataaattaaagaaagaagagaataatttggatttaaaattggatttagataatgatttagatttggatttatatttaaaaaagccaaaaatattgaataagaaagaagaattaggaataaaatataataaaagacagataataaccaaatttaatgatttaatttgttgtttaaatatatgggaaaatattaaaataacaattattcaagaaaatgaaaatattgattttatagaaattatgaattctttaaatgatcaaaataaagagtttattgtacaaattggattattagaagaaaataaatctaaatgtgaatttgtgatattgaatgataaatttgagaaagaaaatatagaatttgatgaattaaatataaaagaaggtattttaggacgaggatcaataagttggttaaatttaaaaccaaaaataccatactttaatgttagaaaggcattaatattattacaagatgcaggatttataacttttacttgtaaaatattgggtgtaaagaaaagttatagttacaatatgagaaatttttgcattgtaaactctgagactacaaattccaacactgcaaactctgagactacaaattccaatactgcgaattccaacactgcaaactctgagactacaaattccaatactttaaactccaacactgcaaactctaatactgcgaattccaacacttcaaactccaacactgcaaactccaatactgcgaattccaacacttcaaactccagcactgcaaactctgagactacaaattccaatactttaaactccaacactgcaaactccaacactgcgaattccaacacttcaaactccaacactgcgaattccaatacttcaaactctgagactacaaattccaacacttcaaactccaacactgcaaactccaacactgcaaactccaacactgcgaattccaacacttcaaactccaacactgcgaattccaatacttcaaactctgagactacaaattccaacacttcaaactccaacactgcaaactccaacactgcgaattccaacaccacaacctctagtaattgctcgagatccaaaggaatcgtattaaatatgaatattaaaatgtatttaaataaaacttctttagatggaaaattgttatctagaaaaaaagatggtaaaaatagcttcaaagtcttattttcatggcttaatgaagaacttaaacttccatctattgaaaattatacttataatcaaatcaaaaataaaaaaaattcctttcaaacaatacaaattaagccaaatgagttatattcaatatttcaagaatataatatatccatgaaaagaatgggatcttcttctactataaaacaaaataacgattggattaatcatttaggtttagtttctgagttaagaaattaccaaaaagatgcagttttgtttgctttaaatgttgaaaaagaaacagtaaaattaaatattgaatatccaccatattggtattgtttaaaaataccaaaaaaagaagaaaatgaacaagatttactttattttaatatgataacaggtgaactttctttcaatattttaccatcaggaggtggtcattttactataagaggaggatttctatgtgatgaaatgggattaggtaaaagtttggagattattactttaattttaatgaatccaagaaaagaatattattattatttgaataataaagaagaaagttttaaaaaaaattcttctttttctattttaaattacaaagataataataataataataacaataacaatatagaaattgaatgtccatgtggagtttttaaaccttttaaagattataatatagtagaatgtaaaaaatgtcaagttaaatttcactttgaatgttgtataagtgataatataatgaatcttaataatttaaataatattaatttactttgttcattatgtcaaagtattgaattaaatgaaagattaatagtaaaagctactttaattatagctcctggaagtattgtagatcaatggtatgatgaatttaataaacatttagaaaaaggaagacttaaagttgttaaatatcaaggagtaagatatatacaaaattatttgaaaaatagagcattaaataaattaaataataaaaatattaatttagattcaattactaataataatggaataatattaactagaagagatattttaaattatgatgtagttttaacatcatatgaaattttaaaagaagaaatatatcatgtattagatcaaaatactattacaaacaaaagatcaatgagatttaaaaaaagttatcctattttagcatctttaattactaatattgattggtggagaatagttttagatgaagctcaaatgactgaaggttattctcttgtttcaaaaatgacaagtaaattaatatgttataataaatggtgtgtttctggtactccaattgttagatcttgttcaaatgatttgattggtttattattaaatctttcaaatgttggatttgatttaattaatgacactttatataaaaagtatattggatacttgtctagtatattgtatattaagtctaacaaaggtaatgcagagtctcaaggtggatctgaggatctagctgaggatcgagctgaggatcaagtcgaggaccaatcccaagatcgagttgaagatcgagttgaagatcgagttgaggatcgatcccaagatcgagctgaggaccaatcccaagatcgagctgaggatcaagatcactcccaaagtcgaccccaaaatcaacccaaggacctcaatcatttgaatgagaatgaaaaagagcttttaactgaggaaaagttactaaaggaagaaagatggtctgtatgtgaaagtggtttggattatataaccaatgagtatatttcaatgatgaatttaatacgacatttagagtatgttgtaggttctttgttttacaggagagaaatgaaacaagtaaaagaggaaatatgtataccaccaacattttatggaaatacttatttaagtttatcttcagtagaaagattcttttatataaaacaatgtgaatcaggttataatagtataattaattataaaagtcaagaaagtttcttaagaaataaaaaagaaatggattcattgattacaatgttaagacttgcttgtatacatccacaattaggtattatgggtatccataataaaaataaagatggtgatagtaaatattataatttagataatcataatgatacgagtattgtttctttaaatacaggattaaagattatgactatggatcagattttagataaattattaaacaaatgtagaattgatattgaagaaagtgtaagaaaatacgtcatgaatactttaggtttagcaggtattcattttacaaaaaagtccaaatatgatgataatgatgatgataataataataatatgcaaatgaacaaatcaattttctattataagcaagtacttgatattcgtaaggaagatagagtcgatgttttacaacaaatacatacattatggaatcttggagaaatatgcaatgatgaattggagaaaaaagaactaataaaagaatgtaatgatcttgaaaataaatatagaagtaaatattttaaagaatatatagaaaaacatgatttgtttattaaatctaaagataaagcaaattcattatattctaatgatcattggtggtacatatttaaaaaaaagtttaatatgtctactaaaggaggaatcagtgaagaggatctcttattagataggattgagaattttcaatatgaatttaagagtgcaaaagatggtaacattgaacataatttaccaagttttaatagtattcatggtctcattattactttagatcttaaagttaagcaaatggaagaatctcgaacaaaacttttagaccaactgaaacaactagaactattgaggtttaataatatccaagatcaaaatacgtgctcaagccaaagtatgagccagaacttggatatgaaccagaaccaaaaccaaaacttggatgtaaatcaaaaccaaaacttgaatttaaaccaaagtcaaaacttggatgtaaaccaaaaccaaaacttggacgtgaaccaaaaccaaaacttggatgtaaaccaaaatcaaaacttgaatttaaaccaaagtcaaaatcaaaatataaaatcccaactaattcttgatgaaatcattgcaaaagtctcatcctgctttttctgtcaacaaggacaaaatagtcaaatagaagataatcatcaacaaaaaaatataggaaaaaagaataataaacttattcaaaaacaagaatcttgcatattttgtattatacaaacccatattgaagaattagaatattcactatatactataaaaaagaaaacttttacaaggcttagtgaaagtagtaataataaccatagtatagaaattgataataatcaacaaaacaaaataattcatcatgattctacatatttaagagattcagaaactattgcaatcttaaagtttttaaacaaagaattaagaaaaaaaatctttaaatcaggatctaactcaaaaggtgaagaaaaagaattagaattcgaacaaaaagaacaagaacaagaacaggaacaagaacaagaacaagaacaagaacaagaattgaatgaaatggatgatttttcttctatttcaaagatttctacaaaacatatcaagtatattgaatctttaaagattgaactttataatattaaagcatttttatcagctactagacaattaattaattcttatttagaacttattgattgtaaacaaagaattcaaataattcaaaataatcaatcaaattcatcttcaaatcataataatattatacatataagtgaaattccatttttaatagaaaaatatgaatctgaacgtatatctgctcttagtgtaagaagaaatctaaaatcacaacaaaaatttctttgtaatcttaaattacaacaaagatctaaaaaaaattggaaaaatgaaattttacaagaaaaagataatgaaaaagagaaagaagaaaatcaagatcatgatatttgtccaatatgcttaaataaattaaaagatgattattcacaagttcttttaccttgtgctcatatcatttgtattgattgttataaattaattagtaaaaaatcatcatctaatcataaacttaagaatcaatgccctaaaatgtag

SEQ ID NO: 2879 - DNA, 963 bp, Cryptosporidium hominis
atgttttctatttcagaaagatatgaacaaattaatgcacatattggacaaggtacttatggtaaagtagaaaaagcaatagacaaaaatagtgatactatagtagctataaaaaaagtgaagatatgtgaattaccttcagatttaacagaatctagacaaaaagttggacaatgtggtattcatttcacagtattaagagaaattaaaataatgaatgaaattaatcatccaaatattatgggtttaagagatgtttttgttcaaggagattttattaatttagttatggattatatggaaagtgatttaagaaaagtttttgaaaatagaattcgattttctgaatcacatattaaatgtcttttaaaacaaataattcttggaattaatgaattacataattggtttattatacacagagatttagctcctgctaatatctttattaattcaaaaggtatagcaaaagttggtgattttggattagctagaagttatggacaaccacgtagagaatatactcctgaagttgttacattatggtatagatgcccagaattactttttggatccacaaaatatactcatgctgttgatatgtggagtataggttgtatttttgcagaactcttaacaggtggaaaagctttattacctggtgatgatgaagttagacaacttggacatatttttgaacttttaggtaccccaaatgaagataattggccacaagctaaagaattacctttatattgtgaatttagtccaagatctccattaaattttaaagatatctttcctaatgcatcagaaatggcaattgatcttattcaatcacttttgagacttaatccattagaaagaatttcagcaagtcaagctttagaacatgaatattttaaaagttatccacttccatgtgatccttccgaattaccacttaattactttaaaaactaa

SEQ ID NO: 2880 - DNA, 495 bp, Cryptosporidium hominis
  misc_feature (36)..(36): n is a, c, g, or t
  misc_feature (91)..(91): n is a, c, g, or t
atgaataggcttgattatttgaatacaataatttcncaaaataacggaaagaataactcagatggatcagaatcacatgataatagtgaantctcacatgaagaggatgattcaactcaagaggatgaggtagattacgatagtgaggaagaggaagaggaagaagaagaagaggaagatgatgatgaatacaatggtcgaaaccaagaccaggacaatagcgataacgaacatcgagaagaggaagaatacgatgaaacaattgacaaacaagagtatgatgagtttaaggcaagagctattaatgaaagaataaataatttatggcttcctaggaagaataagacaacacaatttgataaagacaaaataagaaagtcttttgtgagtcaatatgacaaacatcatagttctaaaggtaattctggatccaaaaagagcagagagtataggaaaactaaagcattgatagataatataaaaaatgattattaa

SEQ ID NO: 2881 - DNA, 210 bp, Cryptosporidium hominis
  misc_feature (207)..(207): n is a, c, g, or t
atgaaaaattcaagatatataagaaataattcaatttttgatgatacagaacatgaaactgagtctgataatttttttagtgaagttgaattgagaagaagaaatggaaatagaaaagaatcatctgaaaagaatggacataaggaaggaaacaaaaatggaataattgaaaacagtaaagtaacaggaaaccattcatctacaaantaa

SEQ ID NO: 2882 - DNA, 735 bp, Cryptosporidium hominis
atgattttaagccttttacttgtggtaactcaatcagtttttatgattgctaatacttatagaggcctaatttggttcatacttccttcatgtcttgttatatgtaatgatatatttgcttatattgttggtaaaatttttggaaaaactcgactcttcagactttctccaaagaaaacggttgaaggatttattggagcttctattatcactatttttgctgcaattattcttggtaatgttctctccaaaagtcagatatttatttgtcctcaaaatgaattacttgaaaaacctttttcaatgtggtatgaattaaaatgtgatcctaatcctgtatttcttcaaaaaccatataatattccaccatttttacattttattttcggtaaagaacctattctaattccagattcacaattccatgccattgctattggtatttttgctgcttttgttgctccttttggtggattctttgcatctggtcttaaaagagctttaagaattaaagattttggttctgctatacctggccatggtggaatcactgatagatttgattgccaaattcttattggtttgtttacatatttatatattcgtgcatttatctttacaaatcccaaatcagtatctttagatattgtcataaaattagctaaaatgctaccagaaccagaaattcaacatttaatttctgtactgtctagccatatatccagtcaacaataa

SEQ ID NO: 2883 - DNA, 357 bp, Cryptosporidium hominis
  misc_feature (334)..(334): n is a, c, g, or t
atgatacttattccatgtaggaaaaatatttactccaatatattcagatatactttgaattttttgacagcaattcatttaatattaatcccattagttacttatgactcagtgagtgctcctgaaagttcttccatattatattggagaaagaaagctgaagttttcttagtggaatatgttgttgctttagtaatttgcataggaagaaaattatttacacaaagaattagactcactttgataatgccatcaaatctttttgattgtaattttgtatgtttgtgggtacgtgataataataataataacagttatttttatattaaatatnaaaaaatctacaaattatattaa

SEQ ID NO: 2884 - DNA, 3003 bp, Cryptosporidium hominis
atgaaacgtattttcttttgtccaacttttattttacaatatttaatgctctcaacaactttctttttgaggtttttcacttggtcattttgttggtcggctttgattttatatacaaacctatttagtttctttaaagatatttttagaaatagaaaactcttaaaagaaacccatgaaattaataatcgaccagttaaagtaatacgtgggaatattcaaaaatcgattaaagcgtctgatattgtcctttttgatattgtattatctgaaacaggagatatcgcaccttgcgatatgatacttatggaaaaattagtacttgttgatgaatcaagtttgacaggtgaagcaacacctgtttttaaaaagcctcttgatttatcaacactttcaaattctcaaatactttcagctggtgataatattcttaaagactctttgattcatgctggatgtaaaattattaaagtatttggcggagatgaatcaaataattcattaatttccgtagtcttgaatactggtgtttttacatttaaatcaaaaattctgcgtacagcctctcaaaatataatttctgatgattttcataatgatattccattactgtggttattagctttatcagttgcatcagttgttataacagtacaatgcttaatttcacaatttaatattgggtccatattcttcattttaggtactttactacaacttcttccaatttgggcaccagcttttgtacaatcatgcattaatagttcagtttcaatattaaaaaatgataaaaatgttgaaagttcttacccaagaagaatcttgtttgctagtaagttggatacattattctttgataagactggtactttaacaatgaatgattacgtacttgataatgttgaaagattaaattctgatttacttgaagatcagggattctttactggaaatgaacgttattccgaaagaatagttaggggaataaatggagaaaaaattgatatattaaaaatggcaatttcaacttgccattcattatcttttgttcctgatcaaggtgacggagggtattacggagattcaattgaaaaggaaatgcttaagtttacaagatcttgtatttatgagaagtcctctttaaatgatagatctttaagaaggtttgtttttgaaaaaggagctgaatttgatcttgaaaatatctatgcaagcgaaaatactgcaaatcttgaaaaaaagctcagtaaaggatgcgaaatactgaagatattcgattttaatggcgttagtaggtcaatgagtgttattgttcgttgtaacgtcacagatagagtctttttatttactaaaggcgcatctgaatccattttaaagttttcaattgagaaccaatcgactgaggaaattgaatttagaacatctaaactatcttcttcaggattttatgtaatattaatagcttatcgggaattgaaatccgataaaaagtcaattgaattgtatagattattaaacgaaagtgaaagaattaattttgaagttgacttaactccagttggaattctttgcttttcaaattgtattagaaacgaagcaccatttattattaaggaaattaaagatcttggaattaagcccataattttaactggcgataattcagattgtgcattgtgcgttgctaaacaagttggaattattaatagccaatttaaagtttctaatattgaagcaaaacttaacctttgcgaaattgacttgaatggtaaccaaagtgctatcttgtgttgtattatttccggaaaattagtttttatgaatgaatttagacatgaaattgatctggaggaagttattaaaaatttgaataagataagattagttgtaacatttgaatcttacgaaatgatgagcaagattgctttacataattatgaaggtattgttaatccattaaaaaatgattccaagcaggcatttttgagtaatgagactcttttggacttgtttaaagataatatttcagtaatttcaagagctaaccatattaataaacagagtgttattagacaatttatgaatgaaggaaaaattgttggaatggttggtgatggaacaaatgatgttgctgctgttaaagattccaatctgggaatattcgttaataaaaatggaagtttaagtagccatttttctttggataaaggggatttaaatggaatattaagtattattcgagagggatgcggttgtgctgctaattcacgttcattgtacttgttcatgattatgtatggattcacaattgtaatttgtaagaatattttattatattccgcacaagcaactcttccaaccatggggtacttttattatagtatttttgtaaattttccaagtgtatggggaataaaaaggagcaggcctgcaaataagattaaaaagtatcctgtagatgcaggattggtatcaagaagttccatattaactgttatttgttttgtttctgttattggaatcaacctgggtgtcgtattgttttttttatcaaataagtcgtggtttgtttctagttatacaagaaatttgggaattccaattttcacttctgcacgccaagatggatttgaatcatccacaactttaatttggatgtgctctttgcattcgcatatggctctgatttttggaatgggaggatatcacagagaacctttttataaaaataaagttcttgtttctacgtggtttttagcacagcttgggcttttatttctaattttttcggagccaagtcttattacatgcttctttaaaattaactgtcaagaaagcataactcctggaactttatttggaatgaatatcccaaaattctcgagtaacaatgttttcccattttcttggaagtttgagctcgttggatggatagctgcttccttcctaatttgcatatttatttatcgcaaattaaacttcaattcagcttccaaaatttga

SEQ ID NO: 2885 - DNA, 951 bp, Cryptosporidium hominis
atgagaaagaaaatttcaattattggagctgggcaaattggctcaactatagcacttcttttaggccaaaaagatttaggagatgtatatatgtttgatattattgaaggagttccacaaggaaaagctttagatttgaatcactgcatggcattgattgggtcaccagcgaaaatatttggggaaaataactatgagcatttacaaaactctgatgtcgtcataataacagctggagttcctagaaaaccaaatatgacacgttcagatttacttactgttaatgcaaagattgttggttcagttgcagaaaatgtgggtaaatactgccctaatgcatttgtaatatgtattactaatcctctagatgcgatggtttactactttaaagaaaagagtggaataccagctaataaagtttgtggtatgtcaggtgtgcttgattccgctaggttcagatgtaatttaagtcgagcattaggtgtaaagccatctgatgtatcagccattgttgtaggtggccatggagatgagatgataccattaactagttcagttacaattggtggaattctgcttagtgattttgttgagcaaggaaaaattactcattcacaaatcgatgaaattattaagaagacagcatttggtggcggtgaaattgttgaacttttaaaaactggctcagcattctatgcgccagctgcttcagctgtagctatggctcaagcttatttgaaagattctaaatcagtattagtttgttcaacatatcttactggccagtataatgttaacaatctttttgtaggtgttcctgtcgttattggaaaaaatggtgttgaagacgttgttattgttaatttatctgatgacgaaaaatcattattttctaaatcagttgaatctattcaaaaccttgtccaagacttaaaaagccttaatatttaa

SEQ ID NO: 2886 - DNA, 966 bp, Cryptosporidium hominis
atgattgaaagacgcaagattgccgttattgggtcaggacaaattggaggtaatattgcatatattgtaggtaaagacaatttagccgatgtagtactttttgatattgcagaaggcattccacaaggaaaagcactagatattacccactctatggtaatgtttggttccacatcaaaggttatcggcacaaatgactatgctgatatatcaggctctgatgtagttattatcacagcctccattccaggtcgtccaaaagatgatcgttctgaactcttattcggaaatgctcgtattttggattcagttgccgaaggtgttaagaaatactgtccaaatgcctttgtcatctgtatcacaaacccattagatgtcatggtttcacacttccaaaaggtttctgggcttccacataacaaagtttgtggtatggcaggtgtattagattcatctagatttagaacattcattgcacaacactttggcgtgaatgcttctgatgttagtgctaacgttattggtggccatggagatggtatggtaccagttactagttcagtttcagttggtggtgttcctctttcatccttcattaagcagggtcttatcacccaggaacaaattgatgaaattgtgtgccataccagaacagcatggaaggaagttgctgataacttaaagacaggaactgcctactttgcaccagccgctgctgctgttaagatggctgaagcttacctaaaggataagaaggcagttgttccatgttctgcattctgctccaaccactatggtgtaaaaggtatatacatgggtgttccaacaattattggaaagaatggtgttgaggatatcctcgaattggatttaactccactagaacagaagcttcttggggaatcaattaatgaggtcaacactatttccaaggtgttagataatgcaccagcagctggtgcataa

SEQ ID NO: 2887 - DNA, 645 bp, Cryptosporidium hominis
atgtcaagtttaatcgagataatgactatagttggaagtaaaggagggaaagaggatgttgaagtggaattaagtaaagatcttccagaagcagactttaataagctaagggaacaattatttatgatgggatttgagttgcaggatcaaaatattgaaaaagatcaaaaaagtggtagctctgacaatactggtgataattgtagaaaatttaaattgaaaaaagaatcgtataacgaattaattgtaaaggaaatatcgaatatgtcacttaaaaatcaacaagaagcatcaattcctctaactccaaaatcagctttgaaaagtaagaaggataatttcgtggataagagccagaagctggatgaggagcttgcagcaattagagcagaaaaggcaagacaatttaaagattcatcaggtcattcatatagaaacacaaataatacatgtaatagcaataatagtagaacttctacagattctcaatcctcttttagaagatttatgaattttgattggttcacatcaatgttttcatccagaagaagagggacaagtcaaagagatagaatgcatttggattcaagttattatagatctaagaatacaggatgttgtggctcaagttgtggaggatcttaa

SEQ ID NO: 2888 - DNA, 1767 bp, Cryptosporidium hominis
atgcctaataactcaaggttattcaaggaaaagcttagaaaggagttaatagagaaacatgttaaaaatatagaaaatagcaacttaatatctctaaaatttcaggaaagattgatagataatcatggaaggttggatgatgaagtaatactgaagatacaatcatttttgagaccatgtgatttggaagaaatatcaattgaaagatctgataaaagtaaatgtggttggattcagtgccaagtagggatttcgggaggatcttctaacaatttaaagagtaagtgggctttggataagagatcaggcaatataattgagagatcaattttgagtcttttttgttcaacaaattgctattacttgtacttggatctttccatttcactgtccgagactcatcctcaccttagaactgatgcattgatcgaaattcaaaagtggttaggcttagatcaaaatgaagaacaaaatgacaaagacaaagcttttaagaatgaggagatgaagattgactgtgaaaataagaaaaacgaagaaaaggagaagcagcaggaaaaagagaaacatctggagaaggagaaacagcaggagaaggagaaacagcaggagaaggtagaaaatgaagatattgggatggttaacacattaagtttctcacaaagcaaaattcctacaaattacacttttgataattctcaaatggctacagataaagaccagaaaatgataaatttaaagaaagtagaaacaaataaagtagaaaataccaaagtacatgctgaactttcaaaccttttaaacagtattaaaaccttcaggaggaacaatactcaatacaaatttgatcaaattgtcaaacattttgattacttagatattgaagaatcagagcctactagatcttcggagcctagtgaattaagtatcgaaaatcataagccttcttctgagaaccttcaagatagagacaaagaaaactctgtagatgaaaaaaaactggataatttggatagcttagaagaattagatgacccagaatatacataccaggatatgatgcaagtattgcatgatattactgaagatgatgaggatgactacgaggacgaggatgaagatgatgaggaagagaatgaagagaaagaggaagaacgagtagataataacgaatacaagaaagattgttctggaaagaaacataagaaaaatggcgcagttcaagactatgttctcttaatgacacagttttatgataacttatcaccagaagttgttgttttggatttactaacatctcttatttctgaagaaactagagatttaattaaatctaagtgtattgtagagcagggtaaaaacaatgaaaaagaagaatctaataaagaaaataataaaaataatgaatttgatattattcaaattgacagaagaaacgtattaaaagataatatttcaggatacattacctcaatagaatggatatttcatactaaattattggtattcacaatttatagaatacttgatacatttgtattcccattttctataccaaaccttaaacaaccatgtttggaacttttaacttttattctaatagatattattatggataatgaaattcatttcaatattaccaattattttaaatcattacaagatgaaataaaaattaaagctgagcaatggcttcttgaaattagaaggaaatatgatgacaaatttatcgataatattaaacttctatttattagtaaagattaa

SEQ ID NO: 2889 - DNA, 351 bp, Cryptosporidium hominis
atggtgcagttttgtattcattgccacaatattctattacttaaggaacatgaggagagaatggcattttattgtcccacatgtccttatgtattcaaaattgtgagccaaattagcaaagtaacagattttgttcccaaaaagatggaagaaccttctatagatatgaacgaaattgcaagctcaaagacaatgggtaagttaagattatatagtggtagtactattatttgtagaagagatctttatttattactgtattatacaaatgaattatatttgtatattcaaagtattatttatcaattaataaaaaagggaatatggaaaaaaaaattaaatatattataa

SEQ ID NO: 2890 - DNA, 2325 bp, Cryptosporidium hominis
atgagtttgcaaaatcaattacaagaaggtgaaagctcggatggtagtgaagattttggtcctgattttacagattttgttgataaaagtaagaaagatgaagatcagcaattcagctatctagagcctgatttttctaacgataaatatgaattggactattcaaataaattgaaaacaaggaaaattgaagctataactaataatcaattaaaggaaataaaagaagaagataataaggatgatgatgactctctaggcccaatgcccacaatgttaacaactaatgactttattgagaaagttgaattagaaaataatgataatagagaaagggaaaggaatagagagaaagaacttgagaaaatagtaaatattccaagaacagatttttatgaatgcagttttatgcataaaaaacaagttactcacatattatctagtaataaaacggggtttattattacagcaagtaaagatggtgtgataaaattttggagattaaggtcagaaaaagaaatatcaagggaaaaagaaaatcaaacaaaagaatcatcttctccagtaatcacttcattagagtttgtaaaaggctttcaagctcataaaaatgaagtatctgatatttctatttcaaattgtgaacaatatatggcaagtatatcagaaaatgaaaaagatattaaattatatagtatatcaaattttgacatgatttctataataagaattcctatatatcctaatagatgcgtatttttatcatcaataggaggaggattatcttccagttctatcaataatcatgggaataagaatgataaaaataaaagtaatatgcgaaatataaatacatttaatttatcaagtggattaatatatccccaaattgtgctgtcagaattgaaaacaggatctatatatatatattcaattaaaggaggtaatttacttattaataatgaaaaagatcaagataatgaaagctttccaaaatataataatcataaaactcaagttacatgcttgaagtttttgccaaacttaggaataattatatcaggagatatatcaggaggattagaattttgggatccttggataatgactttaccaagaagaaatatccaagataatgaattgaatcctatcaaatttcaatataaaatagaaacagatttatttgagttacaaaagaataaatgttatgcaattaatatggtagtaagtaacgatgaaagaaatcttgcaatcaaatgttctgactataaaattagattatttttaattcaaacaggtaaatgctataaaatatttgatgaaaatatatcatcttataatataatgcagagtaatccagaatatgacttcttgcatattgaccatttagaatttggtgttagatcatcagttgaaacagaaattcaaaatcttccagaatattataacatgcagaatatggtttttgatgaaacgtctagatttctaatatatacttgtatgattggtatatgtgtacttgatataaaaattggaaagcgtgttttaattattggtaaatttgaaacaggaaaaagatttcttaatttgggattattacaaatacatagaggaattaattacaatgataatcatttaagtaatgttgattcagctattattacttctgcttataaatcaaatcgtatatatatattttcaaaaagattaccattattagataatggtgatgttaatttaaaaagagatatatttaatgaattaccaagtaatgaagaaattgagagacaaaaacaattggaacaattctcaaataaagggaaagaaagaagtaatgcatatgttagaattgcaaaacaagttatactacatacaactaaaggagatattactttagaactttatccagaaattgctcctaaagcttgtgaaaacttttcagtacattgttttaatggatattataataattgtatttttcatagagttattaaaggttttatgatacaaactggtgatccaactggacaaggtattggcggagtatctatatggggtaaagaatttgaagatgaaatttcaccaaatgtaaagcatgatgaaccattcactttaagtatggcaaatgcaggcccaaatacaaatggtagccaattctttataacaacagcatcttgtccatggctggatggagtacatactatatttggtaaggttgttcatggtaaagagattgtgaaagaaattgagcatgtttcaactaataggaatgataggccaatacaagatgtatcaattatatcagcgtcaactatatttaattaa

SEQ ID NO: 2891 - DNA, 453 bp, Cryptosporidium hominis
atgtattgcgttgcatctgaatttagactatattttcaaatcattttgggatcttgtttaattatatatgcattcattttaaatatatctcttgaaaaaataccatttaaagcactacaatcacagttattactttgcttcgtattcaaatcaaatccaacttttattaactatttattgatattcttcttcattcttttcgattctgttactttatttgaatcaaaatctggatttcttgcatcattttcattcgttgcttggatgatatgtattccatcagcttttctaattagaccaatttggattcttgaaaattctttggattctaatttttactactttttaactttagctggtaatttctccattattatttttattggcgagtggattaaatcacttttcaataatttagttaaatactccccaaatccggataaagttagttaa

SEQ ID NO: 2892 - DNA, 1209 bp, Cryptosporidium hominis
atggataatcaacattcagaaaccttattgggaactttacgtgaaaaatatgaaaatagtgcaatcttatcactaagtagtctattcatattcattacattatgtaatatgttcataatgtacagattattgttggatgtgattccatatcctattggagttacattttcacaattattggttggtatgatgttggcatatgtattaggaggatgcgatttaagaaaggttaaggatgagactttgagtagatttagtgaatatgctgtaccagttggtgtatatttattaatgtttactattgcaaatatcttattaaaatctactccagttatcgcagtatatccatgtattttagcattggctgtggtattacatcatatattcagatatttattctgtgatcagagaaatttattatcatttaaaactgtattgattactgctttatcatatatagtagcatgttttgatacaaatttggtaccgccaacattattgggactttcaattttgtatgctatttcatctgcaattttcagagctgtatgtttggagaaagcacttcatgttactgaaagagatgcaaataaactttataatgttcaagtcttctgtggtgtttttgctttgttatttgcaactataatatttgagcctgaattctttttatcagtacaatcaaagagtttctctgagttcatattatctattggttgtttagttactgttggtacaataccatttgttaagaatattattgcaaataagcttgtaactattggtcaacaagctccatggagattttctgaaattgtttctgttgcattgttctttgtatttggtgtcatcttttttgaatgtgatataactattacaatcattatctcatttattcttgttatttctggtagaacaatgtcaatggttgatattattaataatgataataagagacattcaggatctcatcataagaagagacatgcaccaaagaatactttggcatttaatgatgtacatgaagatactgcagctcaaattgcagatcctcctatgagagatatgagcatgcaagacagtccaaatggttatgaaggagatcatgagtcagagatggatcacgaagcaattaatgaacaaggtatcatagatcaggatgatgttgatccagagagtggaatagttcaaaatgagaatgaggaataa

SEQ ID NO: 2893 - DNA, 762 bp, Cryptosporidium hominis
atggcgataataagaacaatcaagtactattttcctgtttcttatatatttttaagagatgaatattcatttccagcggcagtacttccatctcctgatggtacaacatcttcaataagatttaaccctgttacattttgtcctttgaaatcctcaaatacctctcaaaatcagttcttctttaaaagaataactccacaaggaggtgaggatagctggatattttcaaaaaatggaaatcacggagaagttgttcctagatatatcttttctgtgattactttggctggaactataaacatatacgatactcaacactttcatccaattgtatgtattagaggtcttcatttccaaggtatgaacgatgcctcttggagtagtgatggccatactttagctgttgcatcatctgatggatatattacaataatcttttttgaagatggagaacttggagaggttcttattccttcatctgtccctacgaatactagtattcacagtacgataatagaatccaaagaaaaaatttcacaaaactctgaaaatgatgaaaatattgatcaaaattcattcaaaaataatgaaagtgtacctattccaattaatgacaaccctagcagttcagtagtttctgagaaaattactgctatttttgataatatatctacttcagatcaggttgacaaccaaattcctcttcctgctaaaactaaaaggagaatcgccccgactgttctcatatcatatgattcatga

SEQ ID NO: 2894 - DNA, 1173 bp, Cryptosporidium hominis
atggaaaagttagaagataattcaacaaattcaagtgaacctcagatgattacaactgatgaaggaagtgttggtggtgtaagcttgtatgaagaggatgatgatattgactgggaagtaaacccagaagctgtaaaaaagttggtagagaagtatcagggtgaagagtttcctttgtttatgggagaagatgtattagatcctaataatcctcatatccaagctttacaagctttagtatatgatgatgagaccccagaaagtttggctagacaattcaggacggtaggaaatgaatactttcaagatggaaaggtgagatataaagatgcaattatagcatacacaaaaggtatagaacaaaaaagtacagataaggaaactaactctttattatattcaaatagagcacatgtgtatttgttattgaaaagatatgtagattgtgttgatgattgtagagcctctttgaaggagaacccaaagaatgtgaaggcagcatatagaggatgtagagcttcaatgtgtatgcagttatatagacaagccttgaattttgcattacatggattaaagtatgagccagagaaccctgagttattaaagcttaaatcccagttagaggaacgactttctgagattgagaagagaagaaaagagcgtgaagagcttgaaaagagagatggtggcaagaatgaaagtttacaaaaaagagacaatatacttaatgaaaggaaatatgttttgggagaagcaatttacgatgttatacatacttataatcatgagataaagtgcttaaagaatgaattggtatatccaatattaatattattggatgagccaatgctatgcgagtttatatgtggagctaaagagagttcaacattgggtgatcatcttaaagtaatgtttccaaaagacagaaccttgccttgggacactaatggaagatataactgggagacagtatcagtattttatgagcccggaccacctcaccataacacagtatgggaagtttctattgaaaaatcaatacgtgagattttagatgtggtacgatacattcccaaaattccaacaattcacattatcgcaaagaactctacatgcattgaggagttttctaaaataacttacaatgtagttagagatcccttgttgatttga

SEQ ID NO: 2895 - DNA, 3168 bp, Cryptosporidium hominis
atggggttatcaggttcttcatcagcagagaattgtggagtagggaatgtgaagttgagatgtgatggaaagtcaagaaaggagagtatctcagcaggaaatggtgggccaagcagaattgttagtttttatgaggagttaaatgagtaccttgacttggagtttttggcggaggacatagaggaatcgaacattttatcagaattaggtgagagtttgaagagaggcaaatcacatgatgcttcattggtttcagttttgaatgaaaatataagagaggaaataaaaccagagttaatgaggtctggaacttataatataggctcaaaggcttttggatgtgaatgcggtcgttcttcatcaggaagatctggtcgaaagttgagaaactttttaagttcagagctttgtattcaaataccagatgatgaacataagaagttatttcagggaggcattgcaggtggtaatagggttatagtaggaaaagatgatttaatagacacagcaatgaggtatatttgtgatacggaaaagaatacttgcctaccattatttccatcttcattatatacgagcaacataacatgtaactcttggtactccttgacaggatttttggaaaatggaatatcatttgaagtccctgaaggtgttgaggcgatttcattaatgggttatagcttttcagttgaagattcagatattagaagatcggccaatttgcatactctttccttattggagaatttgaggttggtattgcgagaaaagaagatagcaaagttcactataataaaacctcaggtatggtttaagcgtacagaagaaagtctatcgcaattggaagaggaaaatcttactaaaacatcagtagtttcgactaataaagatcttcacgatgaacagcagggtagattctattttcaaggaataatttactgttcaatattaacaggtactgtgagtctagtagaaggaaaaacagggatagaggtttggtggagttttgaaggttcagtttcctctctcccaaatgaggcgattaaattgcctttagtggcttcacttgatataggaatttcaaaactggaaaattggttatttaatgaaacagttcaacatcctgagacctgggttccattctttgtacctcagaaaaaactgggaaattcaaccccaatttgggttcataaattggagaagctattattaaatgctcagatcctttggaaatgtcaatatctgatcaaatctttgaatacttacaattcatgtttgcttgcattggcaggaactaattcaattgaacaagattataagactggagcaagcttagtcttatcaaaatttataaatgaggatcatatcactatttatactgtttgtttctccgaattgattagtcagtttgagagttggagagtaaatcatcgtattacaagtgactattgcatggaaatgatgtctctagtttgtttaagtagcttattaacttcagaaagcttattaaagacaatgttgggtcttaaagaatttggatttgaacttaagctggctatttctactcaggaggaatcacctttcacaggaactaaagctacagaggatattctaactggaaggtttacttcagtaatatcaaaaatacttttgttgagaggtttatccttgaggagtttgcttaattataatacaagagaatttttggctcaacatcttagatctaagattcaaagtttgcaaaccaatggaagcgaaaaagtgaatttgaaagaatcatttaatcaaattttggatatttttgaaaaagatcaagtctttgaaaatgctattcaaacatttatcacaggattacatttagctaatcatctattacttgagagaagtagttccttagtagttagagagacaatattgtcagcaatgcttttctttgcagaaatggacagaaatataacatttgcgaagatgataggaaagaaattacttacagataagctaaaggtagctgaaggtgaagctgtcaaggatatttcctggaaggaaatttcaggaatagatattttgtttaacttagataagatttctggatctgttgatgctttaagctgccaaatagaggaggaagcaattcctctatttgtggtttttgatgaaagtatgataacagaaaataatttgttattaagtcaaagattagaaagggtctttgaatcaattcaaatccaggttcatgtactcagagtgagactaagcccagcattcataaactttttactccctaaagcagtggatgaagttaaggaggagctatactttcttagaaaaggtgcattttccagatttcaagataataaagagaacaatggaggaatgatctttgagaattgttgccaaagcagaagttatacagattctaacaataacagttatttgcaagaaactgagactttcaggtcaggaatagattcagttcagaagagaatcacagagaaagaacaggaaacacaacagatgatttcaccttcattttcaaatgaagataattcaccaaagaaagaattaaaaaaaacttctatttcttcaatgatattttctgtagcaaaatctctcatttcacgggaaagaagtattggctttgcaggaattcagtgttgcaatactgataggactgatttcagaaacctactagatcttgcagattcaaattcgattggaggaggcatttataatcctccaacttggtctatttctgaaagaaatattaatcagaagataccaacagagaaatcaaattatatgatatctcacaaaaaaacggataaacttgaagagctaatttttgattggattaaacttagatgctggaactttacagattcagatctcagatggatcgatgggtgtaaatatataggtggtggcgaatttgagacaactctaatgcaactttctcctgatttaaatatagcaggagtagcaaagagaattttacaagaggtcgaccactctgaagttcgacaaagtcttagacatattacttttgatcaaagctctcctttaattttagtgagaaatcatgttttcccctatggagaattattacttcctaatccacaagtttctaaattaattaatgctgtgagatcttgcagtttcagataa

SEQ ID NO: 2896 - DNA, 246 bp, Cryptosporidium hominis
atgcttacaatggacccgaagaaaagaccgcgttttcaagatttacttaaatcccaagactatgaaatactcatgggaaagggattctttgaacagcttaaagggcttttcttaatgaaaccaatcgatgaagctgtagaagaccttctacaaccagaagatgaaattctacacttttcaaaactttctgatggggttgttctaagggaaaaaaaaactaacgaaagtgcatgcaattacatgtaa

SEQ ID NO: 2897 - DNA, 687 bp, Cryptosporidium hominis
atgagaggacaatggaggtatattctactttactgtgggggagattttcaagaatctggtttagctcctttaattgctactactggtacaaagtattctcatccaaagtacaagataagacatgcattagctctcataactccatactgcgagtatggaaacggaatctcattaataaaaaatttatcaggtcaaagacatatttactattatacatgtgatttacttcattataatcttttattgattattaaggctctatcttttctagaaagctatgagatattccatggtaatattaaactatctaatatatacgtaaatgctacgggattcatactacttcttggggactttatgcttccattaagaattaaacattggttcatagaaataatgaaaaagaatgcaaatatccctttaaatgtttcccctgaattgaggtatgcattaactaaaccaaactataaaacatatgaggattttgaaaaagaggttgatctacacaagaatgatgttttctgtttagctatggttttcctctcattatcactggtttatgaacctaaagagaaagattataagagattaagaagctttgtcaaggagagcttgttgaagttagctgctgatcctgcttggagtgctggtaagtttttaaaatatcaacagtggtttttatgttaa

SEQ ID NO: 2898 - DNA, 375 bp, Cryptosporidium hominis
atgaagaacttaaggtcagcaactttactttttaggtgggacaaaaagtctttacctcctgatcttcatagattagatgcaccttggatacatttgctcaaagtacaagttcagagagataaagattttcagaattggattcaaaagcaatgggatgattctagggacaaatttttcaaatctagaggtttaaaaccaccaaaaagaaagaaaactattaatcaagcaattggaacttctgaggagaaagcacaagtaaatgataaaacaaagaaaaaaaaaggatccaagtcaaatgatgatacagaaggctctgataagcctccacaagttgcgaatgatgatatgagatttgcagcaaaaatggtgagttaa

SEQ ID NO: 2899 - DNA, 1881 bp, Cryptosporidium hominis
atggtggaaagtttggtagagtttgattacttgagatataaggatggtccagatgtaccagtggtagagaatcctcactattttaccttgattagattcctaggattaattagtaatactagcatggcaattgagtggacattcgaagatgttcaggctatgtttgaaaaggaagagttaactgaatactctaggaatcttcatttgaaattacttggatttttaggaaaaaggtttcctcctcatgtcacattagaaaggaatttgaccaaatttttagatgaaaggcctatagatgttagcgtgatattttgggacaaaatgagttttaatgctgataatcaaagtgaagatttggatgaaaatcgagaagacgaagatttaaaggaagttaagtcagaagaagttgataaagaaggaaatgatagttttgagccatataaggaagaaagtgaactttcagatgttcaattatacaatccatatagagacaatgaatataaaaatgttcagagttatgaaagattgagaactattagaatattactaaacacttgtattcaagaaagtaagcaattaagaaatatttttcaaggtatggaaaattactcaatgaaatgcaagaatgtaaaaccaggagaatgcttttttggactttctcctccatatgttggcgatgatcaattagggcatcattattggtatattaatcctccaaatgacgaagtaatttttaaattatatagagaatcatctttaactggagagctaacattgctttcagataactcagatacattatgtagcacgttcaagacctttttaaatagtgaaggcttacaagaaattggtcagaaactagaaatcaagtataatgcattagttgttgctgaaaaggctaaattaaggaagatcagacaaatgagatctattcgtaaccaactagaatcatcatggggaaattgtgctcctactgatgaaatgcttagcggaggaagaacaaaaagaaaagccgcaatgaatattgactattcttattctgttagtgagaatgctacaagaagatcctccagaataaataaaaatggttacgattctgattcactaaattatgagcagagttccacatttaacaatgttgttaaagatagaagcgatcgacttgctttaagaaatgcaaagaaacaacagattgaagagtctgagaaagatttagatgaatcaactgaagacagttctcaaacttattgctctaaacctgaaattaatccagacccagctgataatgacttgactaactctagccaaactcctgtattgcctcctttactcaacttggaaaacaagaactataccactcaatcttctagttttacctcaaactcttccacccaggacaacaacaacaacttaaattcaataacaggttctggtattttattagatacccagaatcaccatccttcccatatacaatcgatagatttggcgccaaaacatgtaagcatgcaattcccttcaggggttattcctgcagtaccatctccatcatataacttttcttcaagtttacctgcttttaatttggctcagatacaaaaaatgccccaacttaaccaaatttcgcaaattcctcagatccatcagataccacaaatatcacaaatttctcagattagtcagatacctcaaatatcacacatttcccaagtccctcagattactcaagtggcacaaatctcccaaattccaagttttcagacaaacagcactgttccaaacagtcctttaattaccgccaacggtaacatcccaacaattacaaattttcctaatccaggtacacctaatatccaatctgaacaatataacaagaattga

SEQ ID NO: 2900 - DNA, 600 bp, Cryptosporidium hominis
atgatagaaaatcctcatgattatgcagcagaaagaaacgggataagtgttcttattaatgcctcgaagattggatttggcgattttaggattgaatattgcactcgaattatccaattacttaaaaagaattttccaataaaaatgggtcaagttttaatttttaaaccaaatagattgattaaactttcaataaaattagcattacttacaaaaaaaaagataaaaaggaaaattcaaataatcaacaaagtatttgagccactggattcaattacggactttgatgccctttctcattttatagatagaaagtatattccagaagaatttggtggaaatcattattttgattttaataatttttgggaactcaagtatcaaggtcatatgcttgctgaactatttcaaaagcgtggagcttctattaaaattcaagagccaacaaaaatgctcacaaatgataagataaagaatgacagtaaagacaaaggcaaaaaaaagaaaaaaaaagatggtaaagtatcatctattaatgaaaaggataggctagtactatctaatttttactattcaaagacaagttttgatatcaattga

SEQ ID NO: 2901 - DNA, 945 bp, Cryptosporidium hominis
atggggagaagtaaaaataagattatttgcaatattaagccatcagataaagaatgtagaccattaacttgttcagtaccagagatgctggatgaaaaaggaaatattttagaggataagtgcgatgaattagaaaataaatatgtacatgaaatttatgagacaatggcagagcatttttctcatacaagaggtattccttggccaaaagtgaaagattttgtttcatcatttgaaccaggttcactattgctggatgtaggttgtggaaatgggaggttcttggactgtattaaggattcaaaagtttgttttatgggaactgatcgatgcaaatcacttttaggatcagcaatagcaagaaatcccgatttacaagtatttgttgatgattgtatgagacttaatgtaagatccggaacttttgatggtattatctgtattgcagttttacatcatctttctactcctgagcgtagaattcaagctgttagtgagttaattaggtgccttagaagaaatggaactcttttgatttacgtttgggcttttgaacaaaagaaaggaacagttggctcaagagacttttctagtaaagatactatggttccttggcatttccaaaaaaaatatgcaaaagatgaaaaaggtgaaaaaatacaagaatgcacattagatcaatttagagaagaaaaaaattaccacaaagaggcgggaacacctggaaatatagtaaaagtttctccagaaaaatacttaattgctttacagaggtactatcacttatttgaagaacaagaaatagtagaaatttgcaataaaggtattgagaaatataaagaaagcacgaaaggtggaaaaagttgtgaatctgatgagaatgttaccataatagaaacatattttgactgtaataattgggcaataaaaattgccaaaaattga

SEQ ID NO: 2902 - DNA, 393 bp, Cryptosporidium hominis
atgtcacctgatgggagaggccaaataaaagaaggaggaagggatagaggccaaggaagagtatggagaggtagaagtaggtatagcgtgaatgagcagacttggaatcgtgaaggatcttctctaacagattatagagtagaatcaaagtttcatgaaaaggagcaacagagtcaaccacctcaagaatatttccaacaggacagaatttggtacgactcttatgaggatggaggttctgcttctctaaatgaccaccttgggtttgaatctggactactattatatggagaaggaattcttggcactcataggaatcaaacagaaagtatgcaaggattaggaaagccttttaaacgaaaaaggatcagccaaaaaaaaattcaaaggtaa

SEQ ID NO: 2903 - DNA, 1341 bp, Cryptosporidium hominis
atgatggataataaggttgcatttagtcagaatgagtatattggaggtgttaaccagaatattggtataacaggagaaaaggctcaaataaatgctcagaattctagctctatgaataataacaacaatgtgggaggctcaaagtcattttcaacatgtagaagatggatgatttctggtagatttcaagatatacttccaaaagagtcattaacaatgagcctcatggattgggaagacttatatagaagggaaaggcttgctcaagtacaccatagtatctatacaacttcaggatgctttctacagcttgatcagagacaactcgttatgagctggatcagtgatgtagcacacagacttgcctgggaaaagagtacttttcatattgccactagcttaatagaccaatatatgttttgcctagagagagatccagtttccagaagaaagcttgatagaagctctctcgcagcaacgtttgcagcagcagtggttacagctgcctccttaggtgagtgcttgggcgagtgtcatgatcgaaagcattgtcctggattacctcctttacatagatttgttcagagcagcggaattattcggtcaagtagggatattgttgagatgcagattcaactattggttcaaacatccagatatggagggccctctctactaaataagactccagctcatatgaccctgcattacttatcaagacttaaacacctgatggattccctccacaactctttatcagaggttcttcctgactcttcttggccttttggatcccagaacaaagagaattttcctcagaatataaccagcaataatagtaatggaaagattgatggaagttgcagtaatgtgaacatgataactgggaatcctgatgaagttctctgttgtaagaagggagcctgttgggccaataagattggactaagcacaacggtagggcaagcagtccttggaatccgtgaaaagataaactacgcctacttatttgagaagattatgtttgctcacgaacttgccttatactcgggactcaacttattggtcccaggtagcaggattgcagcctgtgttcttataaatattctaataagttacgacccgatcctccaatttccttcgcatcagaacatcctttataacagtttgtgcctacttgattatgatacaggaatcagaccctttatgccttatcttgatcctcttgttcgcagagtaatctccatgtcaatggaaagcatccaggcactggagaacagcggcgccggcgcgcaaacatgcaggagcaaaggcgggcattcccttaggggtgcctcttga

SEQ ID NO: 2904 - DNA, 849 bp, Cryptosporidium hominis
atgaagaatacaaggcttaagaaagttcaagtcataagaaatcaaaaagaaaatgaatcttcaactacagaaagtaaacataaacttttaagtgagagagatgagacctattatagtgcaatgaagctcgtggaagagaatatgtggaccaagtggggattactcaaggtagaacctgaaacccaagaaatacaaattactatgtttaaaattctcaatgaactaggattgatgtaccaagttaagtttgtgagtatttatctaatgtttttgatgagaaacttttgggatcaagtactcctaaatacagataaaagctttgcaaacaaaagtcatgcatataaaaacaatctactcatggtttcatgtatatttatctcgtccaattatgaagagctggaccctccaagctactctagaattgttcaaatagtatatgatagtggatttaagatgaaatctggagaaaagattattaggaaacaagtacacattttagaaagacttgcatgggaacttacagggtttcaagtcgaactaccatctgctaattcatttctaatgcaaatcatccaaaactccactttacctaaatcaaagaaattcagagtttctaagctttctactataattattcacaactctctcaatactcaagctgttattaagtacaaacaatcacttattgccacgtcatccattgtcttagctattacaatagaatacgaaaagcagccagaaaagaaacaagtacacatagacgaagtacttaaatactcgggatacagtaataaacaagtacaggtggttagaaagattctggagaatctggtctcgtccagaaaatag

SEQ ID NO: 2905 - DNA, 936 bp, Cryptosporidium hominis
atggtttttgagattcaaattcacgatggtgaaggagaaaatgaagaagaagaagaagaagaactgagctattttgtttcagatacacaaagagattgggcggagtctcatgaaagaagaattgctaagctatttcaacagctagaagaaaaacaagctcagttagaagaaaaaatctctgagagtcaaggaatctcaaaagtaagtcacgatctttgtaaaaaagttaatcaaattttcaagaaaattgagcaacttaaccaaaatattaacgatgttttaagaagctggagaatagaacttgcaggaaatcctcttgaatacagagaacaaaagaatattcttgaaaattacttagctcgacaaaaagttgctctggatacaataggatatctaagtcgcaaggttgaagatttaaaaaacagacaaactacaatagaatctaattcatattctaaccattttgacagattcacaggatatgaaactgacaatcgtaataacaactatggatacaaactccctcatgaagattcttcatacgaagttcaaattgaagatgataactttagacaacaacagtcccgctacaaacctccaacactatacactcaccaaactttcgacatggtagacagacaaattgctcaagaaactgctattggattaggccatatacaatctcaaatgtatgaagcaaaccaaatattcaaaaatctagcatccatggttaatgaacaaggagaaactatacaaaacctcgaaactaccattgacaatacagtatatactgccaaacaagccgttggagaacttagaaaagcctacaactctagtagctacaaattctctctcatagctaactatggtcttcctggctttcttctccttattcttgcccttattctcaccttatattttttgcatgtaatttaa

SEQ ID NO: 2906 - DNA, 807 bp, Cryptosporidium hominis
atgactccaaatccaggattaatgaaagaggtatcaatgttaacaacaacaactccttcttcaagaagatttaatgaatatgataaagagaatgctactcattctacatctccttttcattttgacgacaaatcaccatattctagcattttaaagtatgattcaattacaaattctcaagatttagatgtagaattagatttccattcaaattcacaattaaaaacaaaaataaatggtttatattcaggaagttattcttcttgcaaggaaaatgatttatcatcactttgtcattcaaatcttaatgtggttgttaccactaacaacagagttaaaccaccaactaaattggataatgcattttccataatagtactaccaatacctacttgtcctttggcatcaccttcagaaagattaagatgtgtatttgaatccctacaggaatatagaaaaacttctcttccaatcatatttatcagatatatccaatatactttatgcctatctccatatgctcttctttgtttatggcatcctcattcaaaatcttgttcaatgtattatagttcagttcctggcccaaaaaactgttcttttatgaataagaaaattagagatatgacttttgctcttccacttactgatcatattggtcttggagtatcggtattttcctttgatgataaagtctctatttcatgtacatttgatgaagaaataatactcgacccttatctccttttaagatttataaagctttcatttgaggagctcaaggctgggattctagcaaaggtctag

SEQ ID NO: 2907 - DNA, 3720 bp, Cryptosporidium hominis
atgcagaacgagagatcgaaggtaattaataataatgcaaagacattgataacggtctcaaaattttatacatatttaaataatttgttgataatatctcctaaaagaagattgggtatttggaggaaagtgtttggagaaaaaggtgaatcgaaaaaatgttttgtttcagtttctggtgattcagttatggaaccagaatgctttggagtggcaaaaagagaactttcaattttagaagaaaaaggggtttctcagagggggtacaattcaagtttgaacgatataatggatttaaaacctttttctgatttgaaaggccgtgatattcatagtttgagctactggtatattccaaattcagttaaacatcagtattacgtgaattataatttaaaccgattatcagactggcaagtgaatacattatcatatattttaaattatatggtgtttcaagaagatctttcaattgaacaacagaattatatgctcactacaaattccttccaggatttatctccgtacttgatcatttctccaaatgtgaacgagaatcaaacaatttgtgaaattgttgcattaagtagcttattatattctggagggaatatactagcaatttttccaaacccacaaaagtgtgatgcttattaccagagatgcaaatgcttgtttggtagtaattcattaaatctaaggattgaactttttgggcaaagctcaagaactatcaatgcaagttggtttccaaatatagacttgaccatatgcacattggaaaaggctaattcgctcataaatcgtcttatttcagacaatatgcttaatgagtgtattaaaactgttattgttgacgatataaactttattgaagacccagagaggggtcatctactagagaatattctcacaaaaatttcttacgtaaatttggtgagtgattattatataaagaataataattacaagggaaaaagtggaccattaacctgtttatatgtttcaaatgggggaatttctaatttggatatatataagaatgcactcaaagttggtagaatctttgaaaatcacaagtatgagaaagaatgtgagcctgatgtttacattaaaagaggtaacagtttatatttctgggataagttaaagtacaataatcaatcattaaatgaaaacgaaaaatttgaaatcattgaaatttttaagaatgataagaacaataacatatttcaacaaactgctattagtgatttgaagtacttttcagatttaatcttggaatctttaatgaataataaaaaggctctaattttctgtccgacaattgaatggtgcagaaaatcactcaaaataatttcaatggagatttctgaaattcttttaaacaaggaaaacaatgtcacttctacacaaaaaaatctaataaacgataaatttggatcttttttatcccaaattagccaagataaaccttatagaattgaaatgattgaaaatctgaaaagagtgacaaaagatggatttcaattagaaaatgatttcttattacttgatggaatcttgaattatggaattgcaattcacaactcaaaactatcttttaaagaaagaaaattaattgaagatgctttcaaaaataatcatttaaaagttcttttctgtacttctttgcatatgatggattcagaaatcaaagctgaccgaataattattagatctattgggctcggaaaaattaacaatttaacaaaaaacaaaactggaaacagggaatggatttcaaaaaatactcttaagcagtttttcaatagaatttcccattgcaacactgacattaccgccaaacctgaaatgcatgcatcctctaatacatgcactttgaatttggcgggaaccacaggttttaaaagaggaatttttatttttacaggtaatgatttggaattcaagtatttgaataatatgttgaatgaaagcgattttcagagcttagagttcaaatcctatttgtcagaattaaatttgtttagactaatattagagttaatccagacagatttggtgaaggaccttcggggtttagaattattgatttctaagctcacttttagaggaaatttagaagctttaaaatctcattcagttttggatacattttcgaaagatcgccaaaaactttcacataattcccaagagcaaggattaaataaggatatacttttatccctttcatttatggtaatgaatcaattggtttcatttgacctaggaaaagataattataatattaacgaaatctcactttctgataaatatgtgtatcagtttcaagataagtttgaacatctcaaatcaccaataatatcttcaaaatatgcattaattggcttaaaaactaaagacaaactaaataaatctattttaaacattattttaagacaaaatgattttcttacaaagttaggatctggaaaaaagtacttaatatcattctttaatagtattgggggatcttttattagcgattgtcagatttttggaacttgcttggcaaactcaataataaaattacagttacatccttgtattatattggaagtatatagtgatttgattaaatctaaattaattggtatagatctttcaaataaccttcaaatatttatacttggattattggcttataatggatcacattttaaggtaaattggaataattatcttcaaatctttagtgaattgacaccaggagaaatggaaattgctgattttaatggaattaactttaaggtaattagtgaaatttctcgaacagtaacttcaaatccaaacttgatccctgagctaagtaagctttctcctatcagtattcaactttcttatttttactcagagactctcaatttcaagggtatgattgaaaaatacagacttatctccatttacagattctattatgcttgctttcttaaggatctatgtaatccaatgatgacttttgagctcattgtggcaaaatattccttagagtctaccactattaggctcattattaactctttcaatcaatctattaatgttgtctccaacttatgcaagtctattggctggcttgaattagcagaaatcattcttaatatcaatgatcatttaaaatctagtgtttccattcgaaatgtcaagtatttgtataaaatcactcaggagcaaaatcaataccaaaacacctactctaacactagtcattctattattggaagtaaagcattacaaaatgatcactatatagaccaacaagacatatccaggatcatgaattacgttaattcaataatctccttaagccataatattactcctaatatagcaatttccctctatttttctggtctaaactgtattgagaatatttccacagcatctacagaaacattattaagagctatccaaaatgcaagcaaattagatgattattttggaattttctctaataaacctcctgaatctaatttaaatttaattgttatttgccaagaaattattcaacaagcaaagaaagctctctctaaatcagataatccccaagatcttgattctctctctaattctgataattatactgaaaaccacgaaattgatattgatcttaatgacttggatctagagtttgaccaagatttaggagagatactcacaacaaaatctaaagctttataa

SEQ ID NO: 2908 - DNA, 1095 bp, Cryptosporidium hominis
atggtaaacagttcaaatatggaaagaacaaattatataaatatacagaatgaggaggaacagataatttttgtgaagctgttgattagtgataaagctgcaaataggatattaagtaactcaggttcaatattgaaaaagattaaacaggtaaatcacgtttttatcctggtttctggtgctaataaatattttccaggtacaaattatagagtagcaactttagaaggaaatgagaagaatgtgaatgaaacaatggaagttttagattttcttttgaagaacaataaagatgatggacaagaaggtttaaagaattatgaatataatattcgtcttgccgtcccaagaagtgtgataggaagtataatagggataaaaggagagtttattagccacgtaaggacagcaactaatgctcatattaatatttctccaatttttgtaacatctgagaaagcatgtaatgaaagaattataacaatttcagggagtaatagtaatcaggtaattcatgcattcataattttaacaaaaaaggttaatagttcaccagaaggaagatcatgtaaaagtgttatttatagaagagcagactttttcagaagaaagaatcataaaactgaacatgaaaaagtagatccactattgagttcccaattagaggagatgaagaatgttttgaatgaaaatccaataaactcagcttatgaagtagaatcaagaagtttggaaattaaagaaaagccaaagcttaattttaagacaacttcaaaggggcgttggagtgaacaagttgatttattggcacgtgaggaagataaaagcttggaaaagcttggaagtgagttaaaacaagttaagattatacagaaaggactgatcgaaggagctcaaataaatattagtcaaaaaactgagttggctaatgatgataataaaatgcaagaaaacttagcagagaagttatatgaggcaccatcaaagactgttcaagaaagaattccaacaaatttgtttataatatctttcttagcattaattacgggtgcattcttcttacaatatatttcaagtgaagttatacgtgtataa

SEQ ID NO: 2909 - DNA, 63 bp, Cryptosporidium hominis
atcctgattaaaactgttaagattaggaattctctgattttcgtagttgttaatgatccaaaa

SEQ ID NO: 2910 - DNA, 474 bp, Cryptosporidium hominis
atgctatttagaagatttgatttaaaaacaattacaaagagcaaaaactatgcaagtgaagtaagttatgaagattataattatgatgataaatggatagttgtccagaaatactacaatgggaaattacttaacaatttaagcttaagtgaaaaaggatttatatattttataacttgcttagtttgtcagatctgtctagtattatcagatctactttcaaaaacggactcctttagagatctccctaaaagaccgagttcattttcttctaacatatctgaaagccaggatcaaagtgataatcagagaaatgttatattagagtttgttaataattggaaatccaactgtcttgaggagaaagtttcgcaatactttacagtttacaaatctctaaagaattatatttcaggaaataagaacatttttagtacagagaattctcatattctttactacattaatatttaa

SEQ ID NO: 2911 - DNA, 660 bp, Cryptosporidium hominis
atgattaaaagaatctcttttaataaaactttccaagtaacaggcaaaaatcatggaaacatggctttagtaaaaactattccacttgaaaaacaagatctctcaatgtttttttcagatattaatgtatttactcaggattttaaatttaataatagaatcaatattgatttgaattcagagtcagaacttgatattcatgatcatgatcatgatgcagaattgccacgtgtaccagtaccgataaaaaattttcaagaaacagaaaatataaaaaaaattacacacatagcaataatggagtatttaaagagaaaccaattagattttaataaagtttatgagatttactttaaaagtttagatcaagcttttgaacatatcattggacttgaatttaatataaatgaatatatagatttagcttttgagattggaggacttcttgcagataaaagctgtcaaagaaatgaatataatataggaatatcgattcaagaagagtttgagtctctaaaagaattaattcaagacaaagttaaaaaaaagaaatccatcttaacaagtcagtgtgatcttgtatcatcagaagaaagaggtatcggaaatttaagattgagagtaaactatcatactgcttataaaaagcagttgaaataa

SEQ ID NO: 2912 - DNA, 1968 bp, Cryptosporidium hominis
  misc_feature (1859)..(1859): n is a, c, g, or t
atgtctttgaatgagaaatcaactaaagaactgttgaatgagttagtaaaaatccaggtcaaaaatcatttacaaaacattaataatgagaaaaatcatgaaaatttgataaagaggatagaagataaagtatggacgacaattctctacaataaaactaaaaaaaagtcaatggaagattctgactacatcaactttgtagattctactttatcaaatattgtagtacaaagtcgtattagaccagaatctatggataatatgaataagattattgatcagagatctaagcttgtagagactcaaatgttttgttttttaccactattcattttatctcacaatattattaaacagtattaccaaagttcttctggatcttatattttacatatgatgtttattctaattggatctttagattattataatttggatttttggaagaatcaatgcttagtcaaagtttatcactctgacttcacttggagattgaactctataatgcaaagaaacttgagtgattctataacaaaagataccaaagagaatattgaattaatctttgatttcaaaacatatctttcaacattttcttcattaatatttaaaagtatcgcctttaataagagtaatatggacttttggatggatcttatttcagactttgctctaggaattgttacctttaagaatctagcttctaatttgtatctaaatgaagaaagtttgttcaataatgagttaacacaattaactgaagatatagaagaaattgagatttccagagaaactaacaaaattgctgaaattgcttttggaaacgataatttccattttactgataataatattacaaaaggtaccgaatctaaaaattcgattataccaaaaaagacaatttctgttaaacaaaactcaataaatattaggaaaaatagaaactctctacttgcatcatttatgggtaattcagatgatgagctagatgaactagaggagctggaattctaccaggaatacaattttagtaaggaagaggaaggagaaaaggaagaggaggaagaagatatagagaaagaagaagaagtggaagagttgaagatttttgataatcaacagagtcaaattcaaaatcaggtttcaacaaagagtcaacgatcaagttcaattgtaaatatggaaaggaataagaatgaaaagtttgtagattccaaatccctgaatttgtcttcatttaactattttgatggactatccaagtcaattaaggagaagaaagaggaagttgaagatgagaattacagaatttgcaacctctcaaaagtcaagcttccaaaattactgagaagagtctctggaagaaggcaaatacaatataataacaagtacttgggattttcatgggatcagcaatatctgagcctaaataagaccaataaaatctttaatgaatccatattaagtgtccttactacagaaaggattaaaaattgcactattgttagtccaaataatgaaatcagtagtacagatggctatttttgggtcaaattagattcattaatgaagttatttcaaggattgaattcagaagaattttctctctatccaaaacaccatagagtcagagaatacaagaaaacagaacttttggaatgctataccatatttatagatgaatacaatatttcccttgaactagtggaagaatttggagaactttctccttggatgaacaattattatcaaggggataaatttatatatacaagaactggtacaaatataaagaaaaatgacattttaggtcctcagaatgactttatgaatactaaaagttgtcgagacaaacaaantatttctgtctcaagatcttgtctcaatgatttgtttatttggaacaaaagtacactatttaagaagcttagcagaattgttgattatgcttggagatatgatgaataa

SEQ ID NO: 2913 - DNA, 894 bp, Cryptosporidium hominis
atgaatgacgagcaaggagttgcaaaggtttgtaactacttggaattcacgccagaaaataaatggataccatcatttatcgatgaagatttgcctatttgtaggattttcaatctaggaaacattgttggaattcgaaatacattatcagaatatctgtttaattctccaagagcatgtttatgtagtggagaaaaaaagagtgagaattttaaaattctaagtccttctgtatcaggagatgatattggtggatggaaatttgaaatatttaaagataatatggagattccaaagatatatcctttcaatagatttattgttgatgtcagagttttagttaatcccggttggaacttagagtttgtgctttcttcaagttcattacaaataagcaaagcagcattttcaatagtttctctaaagaaggattatctatgtcagggatttccagaggatgagtctctcaagattttacagcctacagggttgtcttcaaaaggaagtcagatcatacaaacttactcatggaatccaagtaaatcaaatggttatttaaaagatggccattttgattataaatttcccgttaatcatcaaacaactacacactattatctttgttactaccatcactacaactctaattctggtcaccttcttggaaatgtctattttcgactaaatcccgaggatgccactcaaatattttccttaattttactgattataatattcacaccattaattttgttttcgattcacattattattagctcaaaattcaaaactagcattgaaaagttgcagggatatattttatttgaagacagaaataaggtaagctcagtatttttccaagcttttctttatgaatctaattcttccctttag

SEQ ID NO: 2914 - DNA, 285 bp, Cryptosporidium hominis
atgggaatcactccaacttttggattcctatatggaaataatacagaactttcatcaccagttataccaaatactttccctactaataacacaacatctaaccaaattacccttaaaacccatgaattcatccaaacatgtaattacttattaagaaaattcaattggcgccaaattatggctatccattattttttttttctggagctaaaaataaagcgcatgtattataaattattgatcagactaaatttagaagtaaataaaactagagccgacttttaa

SEQ ID NO: 2915 - DNA, 630 bp, Cryptosporidium hominis
atgggatttggaattacatataataaaaaatcatgtggaggaagctcttctggagtacaggctatgtcattgagaggaggagtcgacttatttgactctattccagagactacatcgcagcaaatgcagttttcgaacattccaaattctcatcataatgcagatgttgctattaagaactttgtaattggacataatcttaatcatggacactatcttagccatcaacatcagcatggttctcatagacatggaaaccaatctaaagttacttcaaacggcacatccaatactaatactgctattaatattacaaatactgcttcttctacaaatagcagtactaagtcaaagcctaacaccaatttttcaatattgatggggatgaattctagcatgagcaacagaattgattcagctcccaatgtagttcataatacaagaaatttagatcatcaaatgaaccaagaacatatcaatggacacaaacgaggaatacatatgggaactagtcattcctcattaattagtgattcttgttataaaggaggtccaaacaatgaagatcagattaagtttactcctccaacattattggatttctggacgaaaccaattctcaatatttaa

SEQ ID NO: 2916 - DNA, 4068 bp, Cryptosporidium hominis
atggaatctctctatgggaaaaataaagttgtttttggtaaatataagaaattgaaaatcaattatcctcttggatcaaaaaaaaagcttgttgctttacaaaattgtaagacaggagttactgcattaattaactattctcctatgagaattaaaacggaattttcaatatatttatcttttggatcgaatatcgatccaattaataaccaaggtttaacttatttaatgggttttatattcttaaatatggcttctgaagtagacaattatttatttaactccggagaatatattgaaaaacaaaaagataatagcttaacgagtgtaactgtttcaaacttatatacaaaactaacagtaactgtttcagatgacaaagctattgaagcattaaaaagattcataaattctgttggatattctgaaaatgttgataacatgacttctactagtaacgatgatgatgaagagttttatatcaagaataaaccacttacaacaaagaatttactgaattctttatgcagactgtactatatttacaagtcttgtttaagagatgaggaatatagaatcagttttataaagactagtttgagagctattgatccaaaaaagggccaagaagaagagagtagtaattttggatcttcggataaaattgaagaagatctagtttcagactacttttctaattgtggaatattctctacatactggcaaaagcatctaaactttttttcaacaagctcttgttcatttcaaagcaatataatagaggctaacctttctagtagtctaaaagattggctacatgaacttaagcagctaattaaggaacactatgagaagtactggttacctgaaaatatgaacctttatattgattcggctttagattacagattatttgaaaagttactagcaagtgagatggctactttcagttcagaatgtgataataagggaaaactatttattgaaaacaatttgtttatgcaagaaattgaaataaagaaaaaatatggaagaaagttaggagaaagtaagaatcaaggatttgatgaaaatgtagatttaaatgatagaaaatcaaataaaacaataaaaatattcaatgtagttcctctttcttataagaagagcgtacttgatattgattataagataaagttaaagaacatttctcaattagtttcaatttcgttgactagagtaatggatgtggtgacaactttatttttggattctaaaatggtgaaaagattaagagatgaacttggaataatacgggatttaaagcttacatggaagctacactactcttctttaaaactgaggctaatttttaggtttattttaaaaagtatggaggtttcaaatgcaaggaagataatggaggacttttattcttacagtattttcctttttaagcaatttgagagaaccaatgggagaaaaaaatccaatccagagtttaaagtaagcaaagaactatttgatattgtggatgagatacaaagactaaatgagattaattggcatcttcaatatttgtatgaagatcttccaactcagttaactactccaataaataattgtggtacccctatacaagtttcccagcctaataaccttgaatctaattggatcaagaatgaaataagaatttacaatccattgttattcaagaactatcctcagttaattctaagttcgatccacagatctctcacaaggctaccaaaagaatgtgatataatgaagcggaaaaagtgtaattgttatagaacagactattcaggaaagatcagcaaagcaaattctatattagatactggaagcatagtttttgttctaatggaatttattataaagaaaatagtggagttaaaggccaatgtaatttttactgatccttatttcagatataggacagattttgttttaaaggttagagcttataattatcacgaatatgtgaatttacaatttagttcctactaccagaaaaacaatctattaaaggaagattttacagattttgccaattcagaaaattggactttacctgagagaatagttaactttgaaacttcaatgttgattccagactacgaatactataagaattctacagctataaacaagcagttatcttatccaagaatctcctataagaacgagttaagcttaactaccaggcttgagaattttaagttttattctccaatagtttttgtgagatccattatcagaacaaagttatctccatgtaaaatatttagagactgtttttttgaagtggatagtatttcaaagagacatacagggttaataatgcttaaaatattatcagatattttcaatatttcaattgagaaatttttggagagtgagcctataccaggatacatgaatatacttgaaaagctttcccataatagcagtacaaagtacagtaattggagaatttcggattcgctaacaaagccttttcattttggatctataatgattggaaacaatgaaatagagttgaactttgttggacctagctgctctttaattgaatatatgagaaaaatattcaaggaaatgaattcaagattcaagcctttaaagattgtcaagttttatcagatattacgtaatttcatgaagaatgagattaaaaaaaggaagaataggacttcaatggactttattcgatactaccaggggatattacaatacgaggactattttgaagatgaatcttttattactacaggtatttcaatcacttatgataactacttatcatttcacaactatattatcgataccttatttaataaagattctgataggccacgtcaaaaaggatttatggagacagtagttctaggtattacaagcgatgaattcaacaaaagatacactgagacaattttggattggatatatttcgaaaagccagattcttataaggagatttgcatgcttcaggagccatattttgcattttcagctgtagatgagccacttataattagacaaacctttactgatgggattttaacaaccagtagtgcttcaatcaggttccagttaccatgtaataagaacagttctacaggatttaattcaagcctttcagataacgatattttctttaaagatgaaaaagaatacaaatgggagacaaatgatggtttacagccaaggtgtatcttcaatactgtagcttccagagttttggagagaatactcaggaagtacttttcttcaatagttagaaagctggtgctggagatatcccaaagtcactctaataatacgaattttcctccaaatttgaactcgaattttgctgtaagaggagaagtggaggtttcattctacaggctgaatagtattccccaatttactctttacattttatcatctcattttgatagctttacacttttgtcaatactcaattcatccattaagaggttcaagactgatgtaattgacagagaggaagtactttctgaggaagaattcagctcagttaaaagttattttattagatattattgcataaaagagaagattcaaattagaaatctcagagcttctctcttggaaatgtcaaagtggagatataactacaattggaagcatgaatcatgtaatttggttcgaactttaaagaagaaacatattgttcaattctattatgattatttcttaatggattccccctatagaaggtcatacattctattactccaagcaccacctttcaacagattaatatcctattctaaacaaaaaggtacattaattgaccctgtattcacagttttccagaattatattgtttctttacttggaaaatgtgacaaagctgattactatagacaaaccaatacaactaaagatacagactggaacataagtatgctttcctatccacgtatactacaaagtgacattggtatcttggattataaatataagaatattaaaaagtatcagccaagatgctcaaagtttatgctcgaagcaattaacacagagaaacaaaactag

SEQ ID NO: 2917 - DNA, 1485 bp, Cryptosporidium hominis
  misc_feature (1475)..(1475): n is a, c, g, or t
atgattaaacaagagttgaattttggaaatgatagaatcattcattcggctcagaatgaaaatacatacaaaactgttaagacagcagagataagtccattgagatctggtcttatgattaatgaggaatctgaagagaaatttggttttggagccattaataatcgtggaagtgcatcacttggtttaaataatggattttctgagaattattactctggatttcctactcaacaacctcaagtatattttcaaacaaagaatattcctatgttcagtgaagcaatgagttctggccagcacgtttctattggaggctataatatgttatcatctcattctgttggtccagttttccaacagagtgaaaacactaactacatgactaatacaagctcaggaatgcagattaaaaggctcaatattccctctaacagcgttaagtcagtttctactattccatccaatggagtgagcgacatacctattataggtggaacctcaggatatgaatataaagatggaagtgtactaaatggtgtttatcaacagccttttcagactcaaaacttggctaagaatatcacaggaaattcgtcaaatctgcatatttctggaaacaaaagcactaaaattcacgagaatctcaacttaaatacaaattcttcttccattaccattcaccccaacaatactaataattccaatgtctatccctctgaaaaacctcttccaagtgccagagcaaaagacgattatttacagtatgaacaatactcttccgtgaacacaaagagtttcatttcccaacagaataacgcactccagaccaattttcagtccaataatccatcaaacgtaccattcttttcaaccaatacttctaatccaaaccaaatgaactctttgatgaatcctcattacctaaattcagttcctctattagctcaaattagaattgaatgtattcaagatttaccaaataatttccatcatcattccatgggaatctatagctctatcacaaatatggattactccattgttgctagctttaacaatattgatgataagaatgaaacttacagaattggtccttttccaagtagtagtatgagcaactctaaacttaattgtattgttcaggatgaaatttcaattcctttttcatggtctcaaccaattttaaaacttaaaatccttgaggaaaatgatttcaaagctgatattattggcgtatgctccatttctattgatatgagttctataggaattccttcacaggcttgcttgattgatccacaaaccaatcaagtaagaggaactttaagatttgttgtaaaacttgtcccaaatcaacaaaatccaaattatagatttgaccagatacacggcccaaattcaatactaaatagaagatatagccatgataattcaattttcaatatattcaaggggttctgctgtgcagactnaaatctttga

SEQ ID NO: 2918 - DNA, 333 bp, Cryptosporidium hominis
atggcaggcgataagagaaagcgtgtacaggagactgaggtagactctgaaggaaatgaggaggaaactagcctaaagaagaattctgttgaagttgatgtagaagaagacgactttgatggattgccatcagaagaggaagaattagatgatattgatgatgaagaggatgatgatgaagaggaagatgatgatgatgatgatgatgatgatgatgaggaaggtgacgaacaggaaccaactcaaggtggagatgaggatgcagaggatgatgacgatgaagaggaagatgatgaagaggaagaagaagaggatgatgatgatgaagaataa

SEQ ID NO: 2919 - DNA, 345 bp, Cryptosporidium hominis
atgagtcaggaaaaatggtttgtttgcaaagtgaaggattttatgtcaaaaaggaatacaaaaattaacaatttggcgaacatatattctggtaatcagaatgatttggaagaattctttgaaatgccagaaaaaacaggaccctacgctgtatttatgtgttacaagctctattcattatttgatcctgaagataagggatatatttctctaaaatccatcgaacaatgggcaaagatgcaatataattctttttgtcaagataacaattcaagtatagatgcaaagacttttgatatgtataaaggaaaaactcagagaatttgtaactctatagaaacctat

SEQ ID NO: 2920 - DNA, 948 bp, Cryptosporidium hominis
atgccaaagggcttggatgtatatctggactctttaaaattggacagagagatatctactttgttagaatgcaagactctttctgaaaatgaagtaaaacaattatgtgaattagcaaaagatattctagaagaagaacaaaatgtacagcaaattggacttccgctaactgttgtgggtgatatacatggacaattctttgatcttaaggaaatttttaggattggtggggttcctccagaaaccaattttttatttcttggtgattatgtcgacagaggttattattccgttgaatctgtgactctcattgtagccctgaaggttagatatagaaatagagtcttccttatcagaggtaatcatgaaagtcgtcaaattacacaggtttacggattttatgacgagtgtctacggaaatatggaactccaaatgtatggaggtattttactgatctttttgattatcttccactctcagcattaattgacaataagattttttgcccacatgcaggtttatcgccgagtctccctagcttagactctattaaaagcttggataggattcaggaagttcctcatgaagggccaatgtgtgatcttttatggtcagaccctgatgaacgttatggctggggagtatctcacagaggtgcaggatatacttttggggaagatgtgagtgaaatgtttaatcatacaaataatttgcaattaatctgtagagcccaccagctaattctggatggatatcaatggtctcataataagaatgttgtgaccgttttctcagctcctaattactgctacaggtgcgagaatcaggcggctatcttaagaattgatgatttgggaaattttacatttctccaatttgaccatgcgcctgagaaggtacttccgagacaggaaaaccagcttccagttccggactattttgtttaa

SEQ ID NO: 2921 - DNA, 2526 bp, Cryptosporidium hominis
atggttcggttttttattgaggaattggaagttttctttccatatgacaatgtctaccctgaacaacttgagtatatgaagtacttgaagcagattctagatgctcacagccatggagttcttgaaatgcctacaggtactggtaaaacggtaaccttattatcttttatcacgtcttatcagttggttcatcccaatatgggtaagttaatttattgcactcgtactgtggctgaaatggaaaaggcactacaggagcttaaaacagttgttgattattgtaagaaggaaatagaaaatgataagattaagttagagctagaaataaagagtgaaaacaattcctcttttgcgtcggtctctgagtctcgtttgagtgctgcttccatattgggaattgggatgacagccagaagaaacatgtgcatcaatcctagagtatcggtacatgctgacagagacaagattgattctatgtgtagatcaatgacagctccttgggtaagagcaaaacatcagatggaagcaagagaaagaaatgccttgagtgagggggacacaaattcttcaaaaatgacagaaatcgccgatattgaggaaatgttggagtctggatgcacaactttatgtccatactatgaagcttatgaaagggtatggagcagtgatcttgttcctacagggatttatactattgatgaatttaaagactttagtaagaactgggaacatccaattttgggaaagaaaatccaattctgtccatactttgcttctaaaaggctcattcaaactgctaaagttgtcgtacttaattaccaatatattctggatccaaaggttgctcaggcctctcttttaggaggtggaacagtatctcaaggattcagccatggagcaaatccaaatggacttagtcttgggtctaaatttgcagcttctcttcttccggagcaagaaggaaccaaagagcctagtgttgttgtatttgatgaagcacacaatatagataacgtttgtattgaagctttatctgtcaatatgaatagacaaatcctaagcggcgctgcacgtaacttaagaactttgaaatcagaaatcgaaagtctctcttcattagatgaacagaggctacaagatgaatatacaagattaatacagggtcttagaaactctggacaagttcaggatgaagcagtattagaggatcttgaaaggtttcctgtacttccagaggaaatggaaaagattaaaaaaggtttaattcctggatcaattagaagagctgaacactttattacaattatgaagaaacttattctgtatttgcaggagtatattcgagtatattcaactagaattgaaggacctctgacatttgtcaaacatattgaagcttcctgctatattcagtctggactactaaagttctgtgatgaaagacttagatctctgttgaatactttaagaatagtagacagtgatcaatattcttctcttgaattagtttgtacattctttacaattttaggaagttattcaaaaggatttattgtgattgtggatccttatcctgaggtttctggactttatgacccagtaatacaattaagctgtttagattcatctattgccatgaggccaattttaaagcgttaccagagtattgttctaacatcaggaactctttctcctttggacctttatccaaaactattaggatttattcctgttgttagccaaagtctaacaatgactttagataggacatgcatttgtccattgattgttacaagaggatcagatcagacacctctttcgtcaaaatttgagtccagagctgacgtttcaattcaacagaattatggtaaacttattttagaaattacaaaaaaagtcccagatggggtagtttgcttcttttcttcatacttgtatatggagcaaatgctttctcaatggtatgaatctggtttattggcacaaattatggagcataagctagtatttgtagaaactaaggatattgtatctactactttagctttacatcattatagaaaagcatgcgatattggaagaggagctatattcttttctattgctcgtggaaaagttgctgagggaatcgattttgatagacattatgggaggtgtgtcgtaatggttggaattccataccagtatacattatcaaagattctccagtcaagacttagctttctaaaggagaattacggaattcaggaaaacgaattccttacatttgatgcaatgaggcaagcatctcagtgtgttgggcgtgttattaggtcaaaggcagattatggacttatgatttttgccgatttaaggtataataaaaaagacaagagggaaaagattcctccatggattttaaaacatctaaagcctgaatattcaactttatctacggatatggctgtttcaatttcttcaaattttttaaaacaaatgtcacaaccttatgctgttagtaactcaattattaagttgggttcttag

SEQ ID NO: 2922 - DNA, 1296 bp, Cryptosporidium hominis
atgagaaacgagataagtaaagaaagtagtgagcctcaccatgaggattcaatgagccttcctcctgtactcccaattaaaaagggagaagccttatctttttacgtagctcatagttgtggtagagctagatatggagtattaaatcttcctcatggaagagtggatactccaatatttatgccagttgctactcatggatcgattaaggggctttcttcccttcaggttgaagagttgaatgtacctattttattgggaaatgcataccatttaggtagcaggccaggagatgaaattattgataaatttggaggcttacataactttatgaggtggaataggaacattttgactgatagtggaggattccagatggtttctcttttgaaatttgctaatattacagaagaaggagtcgaatttaggcacccatatacgaatgcaaatttactatttacaccggaaaaatcaattcaagtccagaatgcaataggagctgatataattatgcagcttgacgatgtaattactgccaaatctacagattatcaaagatttgatgaagcagttgatagaacgacacgatggttggatcgttgtataaaagctcataaaaaacctgacaaacaaaatttgtttgcaattgtccaaggaggaatttttaaagatcttagggaaagatctctgaaaagtcttaaggatagaaatactccaggatacgcaattggaggtctttctggaggcgaaagcaaagacagtttctggcaaataattgagctatgtaccagatctagtgttggacttcctgaaaataagccaagatacgttatgggagttggatatcctattgatattttagtttgtgtagctctaggagctgatatgtttgattgtgtatatccctgtagaactgcaaggtttggaacagctatggttcacaatggactactcaaactaaaattaagtaaatacaaggatgacgcaagaccaatcgattccagatgtaagtgctactgctgtaagcattactccagagctgcactatacagaattgtccttaaagattcgcttgcatgtcaacttatgacgatccataatatatctttcatgatggagttttgcaatgatatgagaaacgcaatcaaaaaccaaacttttggagaatactgcaagtcatttgtgagaaattactattcgtctactgaattagatcacttaagtgatttagaaaaaaaagaaggtatcccaaaatgggttgttgatgcttttaaatatattgatattcatttataa

SEQ ID NO: 2923 - DNA, 405 bp, Cryptosporidium hominis
atgagtgaatcaaatgtatcaaataatacagagaataaagggaaaaacaatggagatgacgttggggtatatgttcactccgagtcagatttgactagcttggcgagagaaaatataaactttgcaactaaagatgatgaaaataagccagagagaatgataaagggttctcagagtagctttccaacaataaagtcaacaatagaaaagattaaaatgccagctaagctactccaaaagtgtgtggacgtaatattccatggaagatggaaaatgataactttgaactactttgaaagatttttcatggtttattcgaggtttgtattcaggcactcaattgcagtaattatcgcagtgacattaatttgcctttttttgggtataggtaagtttattttataa

SEQ ID NO: 2924 - DNA, 2064 bp, Cryptosporidium hominis
atgaaaagctttcatgagggcttaatgaatttaacttttacacttgatgaaactgaggcaaaggagctattagaagcatataatgagcttagaaatagtacatcttcaaagcaaagagccacagaagagaatcacttaaaccaaaccacttcagaagagggaggtcacttaagaagcattctagaaagtccaatagtcaaaatgaatagtattgaagaatatgaattaataaaaaggaagctgatccctggtcagaagtttggctttggaacaaaaaggaactttaataagaataaatttgggcaaaataatcatagccagaacagtactcgcaatgattccaatgttcagtctaaaaagaaagagaatgaaaaacattatttagatacagaaatgtttacaggaaatgattacattgcaccacaaattgttgaagaaaaggattcatcagggaaaattgtgaaaaagtataaatttaatttcagtcatgtttgtgcaagagttcaaggtggctcatgtagacgtccatctggaattttatggatgtacaaagatacaaaagattttgggaaacctatcccagctccttatgtaattaacacactaacctatcaatcttttagaactgatatgtggctttcaccgataggaatggaacatgaaaagaagactgatcatgtaaaagcatctagggcagcaattcttgaataccaactttcagatcaagataaaatgaagaggttttcattcagatgggaagaacaattcatgaaatactgtgaaaaagtgcagagaaggttacaaaaaggtgattatggggatgatttaagagatgggtccaatttcttagcattttctaatgaattagatattcattcgcaagtacatacaactaataacaacattaagaaaaagaatgacactgaacatatccaaaatgatgatttggtttttgatgaattggatgatatttatattgcagaaaccgaaagggttcatataaaaaataatacagggcatgaacaattatcatatacaattccaaatattaagaggataaataaaggagcaaccaaatacttatttaaaggagatactgctaatgctccactatcaatattttataatgcaagaagagctcttagtgatgaactcacagaacagacttatatacatactccaaaagattttgcaatcattggctctcttgttgttatattactcatttatggttggactgttggatatggaagcaatatatatacttcaagagcaactagtggagtttgtggtgctattgcagccttattagcatttattggaggagctggattatgttatttagcaggcttggaacatacatcaactgcatcagctgctccatttctagtacttggagttggtatggacgattcttttgttgtaattaactcatttaatatgacttatccactaaagaatgctgaagataggattgtttcggctgtcagagactgtggtctatctatttctcttacaactttgactaacttattatcatttgcaattgggacatctgcaggatatttagcaatcaagaatttctgtattttaacttttgttggattattatttggctatataacttgtctaacgatattattgggagtgctttgcatagatgcacgacttgaagagaaaaaaatgatgaaaatttttggaagagagttctttgcaaatcgtaaacatccagatccactagttcctgaaatggaaataccagttgagaagttctccacggttgctctaattggatttttagtttctcaatataaacattttaatgattcaaaggtgaatactcaagaattaattttgatagaaaatgaatcttctattggaaagaatattgatcctaatgaaattcaggtatcaaaaattacaaataattttgaggatgcatcaataaacagcccaatagacgaggaagagattattgttaaagctagccaaattaatgttttatataagagtaaggcttctggaagtgaagagcaaaccacaaaatactacttacatgaataa

SEQ ID NO: 2925 - DNA, 234 bp, Cryptosporidium hominis
atgccaagtatatcttcagttattatcgttattattattctatgtatggtggatgtatgtattattggaatgatggcacaatggggacttcagttaaacatgcttacaatggttaatttgattatgtctattggtatttctgttgattattctactcatatttgccattgttttgctcattgttctggcaaagatagaaatacaagagttattgagactttgggtaagttttaa

SEQ ID NO: 2926 - DNA, 213 bp, Cryptosporidium hominis
atgggaattccaattttccacggtgcaatgtcaactcaatttgcagtaactgtattggcattttcagattcatatgtacttcagacattctacaaaatgatgactttggttgtttgtattggaatttgttatggagctatcattcttccagttattcttacagtttttggtccaatggatgttattaaatacactaaagctgaacataaataa

SEQ ID NO: 2927 - DNA, 483 bp, Cryptosporidium hominis
atgatttctagtaaagaattcaaaaattcattcaaatatagatcaaaaactcaaaaagatcttcatgtattagatgagaatatggataccggtacagaatcagaaagtgaagaaaatgaaaaagaagatttgagatcaaagttgaagttatggatcaaaaattggtatattatagatttaattctcaaagttgttaaaacacaaggagaagaaagacaaaaagatcaatttaataaattaatcttttcaaaaattatgagtttctatagtagtcaagaaaatatacatgatggatatggaatagttttcaagatcccattaatacagaatttcttattagagaagatttcaagattagaaaagactgatactataactattttaaatgaaatacaaattattcttgaagatacaatacgtacaatcaaacttttaaatagtgattcaaatatccttgaatatattcatattctagaagattga

SEQ ID NO: 2928 - DNA, 1221 bp, Cryptosporidium hominis
atgaaaagtaataataataataatagagaaaaagaggaatctttgaatagttttatttcaaatatatttggagtagatgtattattatcccatggttgtgtgaatccaaaatggtttgatttagatattaaagatcttaagaaattatcaaacttaaaatcgaataattcatttacaaatttgaagatctggaaattagaatcaagtatttcaactttaatatcagtatttgtattaaaattgaatgcaaaaagattaaaagaatttatattattaataaaaagattgattcatagaaatggtgagagttttctttcaaaagtaagttcaatgacaaagaaatctgatgattcaaagactgcaagtaattctgataagaaagcaataaaagatctatatgaagagatttcttcttcagaaagttcaacattaattaaagatatttattcttgcagaatttggattttaattttattagcagtatttgaatcaacaggagaatatggtatatattgtcttatagatgatgtggcattggatgtgaaatcaatttgtgatttaactcaaatgaatgctttaacatgcgttcagaatattacaatatctcaatatagaaatattcatagtccaagtaaaagatcaccaaatcatcaacagattgctaatttgagtcatttagataatgagcttggttggtactggtaccatttaggtatatataatttaatattaataaagataatttatttaaatttatcagtacaaaatgaagaatcaaaagacgtaccaaattcaatagaagattatttagtaaatccaatagttacaaatttggatatgtttgctttatttgagccaggctcaactagaaatttaacaggttgtggaaaacaatgggatcttattttgagtgatatttggattcattcaataagatgttttagaagtaatgatttaatattggctggaattattagattattggtgaataaaataagaaatggtaatgatcaggttagaatgttttcagcagaagttttacttaagctttggaaggatgaaatatgttcgattacaattttgtctcatttatcagatattcttcctataattaaggaacttctaagtgaccattctgaggagatgattaatattactaaatcaataatcaaaaagattgaagaaagaacaggagaagatatttccaaacaactttgctag

SEQ ID NO: 2929 - DNA, 780 bp, Cryptosporidium hominis
atgaaagcttcgagatatcatcaaattctcaatcaatggattgggaagacaaaaggttttattattgatgaaaatagagatgctaacacaatccaggtagctggagaaagtaaattgaataagaataaggacagtgatatagaatggggaagtaaatggagatttggagagaatgaaaatgatgacaagagggggggaaaagaattggttggagtagtttcaagtattccatcactgacagatatcattcggccatttggagatcttccaaatgatgtctatatggatattatgagcaaatataagtgcttcttacacgagctcaaactcaaattgattgaaatttttcgtataaattcagaaaaattcaagattcaatataagttagatattgtggatgagagattagctttagttgaagagcttggacaggaagtatataagctatcagctgctgatcttgctagaatacatactcaaaaagataaggaagagtgtttaatggttgatagattggttcctgtggttgaaaaagctaaatcacttattattgtagaggaagagaaatttctattagaattaaattccaagcttagaacaaatctggatcaacttacaaaagagttccatgaacttcaaacacaaatttcccaggttgataaacaacttaaagatgctgataagacttctaatagctttattactgatgctattgaaacattcagaaaatggtcggaaaatgcaaaggaagttattaaagcagtggaaagggcaaattaa

SEQ ID NO: 2930 - DNA, 1761 bp, Cryptosporidium hominis
atgtctagagcggtggaatatgacgacgaaatagtgtgtttgggaaaaggaggagtatataggcttagaggaatgacgaagaatgaggtaaattctgaagaatcaacagttaataatccaattccatttttggaaggtgttgaaatttatgcccaagaaccccaaggaagaggatactgttttgtaccaaaggattcaaagaattctgtgattttaataacaaaaggagaaggtgaagttaataaggaacttaagatagagaatgatttcccaattagaaagttgcaatattcaccattaggaagttatttattggttttaacagtatttgaacaaggaaagaatgaaaataacctacaagtttacaaactgaaggaaaatgtaaaattactgttttcttttccttttaaaacaaacagtgcaaaagttcttagtacttggcctccatatagatggagtaataatgagatctttgtatttaaagtccaagataccagtgtatcaatatttaaaagcgatactgagagcctggaaaatcctataggaactttaaatttctcaaaaagtatacaactttcagtttctaacgagattgatggaggaagtaatttaggagaagaaggatctaaattgagtagcttgaactttacagtagtaactccccaatctgctcaaaatatggatgtatatgtataccatgcagagatggatagcaaaaaagagatccagcttagctcaattggacaagtttgtgtaaaagaagctcaaacatgtcaagtttcttggaataactcaggggatagtattttagtgtttgctcaaattgaaggtgaaactttgggaaaatcttattttggatcttcaagtttgcatctacttcgaattcaaaattctaagactgttgtggcaaatagtgcttggaaaggaaataaaggaggaaataatgatcttgaaaatggaaataaaaatggaagcgatggttttaaaccctcagagaagctgagtctaagacatcaagtggttgttccgccagaagaaggtcctgtgaatgatgttgcttggtctccaaaatccaatgaatttctcttatgtaagggaattattcctccagagctgactttgaatagtgggattgatggctctcctaaagttagctttgggaaatccagaaggaatacaattagatggaacccttcaggaaaatggtttgcatatggagggtttggaaaccttgcaggagatctagatatttgggatcttgataaacagaagcttattggtcaaactaatgcttcttgttgtattactcttgaatggtcagtttgtggaaggtttctactggcttctactacctctcccagacttagagtagataatgcgattcggatctttagatataatggtgatttgcttaaaagagtcaactttgacacgctttactcagcttattggtctccaaagactgctgattataggcgctcagtgaaatatagatcagtttctcctggaagggaatttaactcaaaacctcagccagaaaaacaaatctacagaccaaaatgggcaagtagtggattcgctgaaaggatgagagctgctagagattccaataatgtccccactgttgttaatgtacaacaaaagcccaagaatgagtatgttattcctgggctcccaacacttgaggcatctgctgcagctgtagcatcttccagacagagtaatcaccgccaaaaacagaaacagaaacctaaaaaatag

SEQ ID NO: 2931 - DNA, 2250 bp, Cryptosporidium hominis
atgagtcttggtaacaatggtagtgagggaataaataatggaggatatgaagatataagatttggtaatcaatccggtacccataatatggtatttcaagatctaagcggtaaacatacaggatatcttgaaattcaacaaaataatcataattccgctcaaataatgatggatgatcatgaaataggaggaggttcttctcaaagaatggatcaattgggaggtataacgcaaagtaatagtaatacaggaagcttagctggaagtcagtcctcaatagggagtcaaagctaccaaagccatagtttgaattcctcatctacttctcttccaaattcaaattcaaattcaaatttgaacatgataatgatgaattctaattctgttcaaggtcataatcatggccagaatcggaattcaagttcccaaattcttcgaagttctattcattctcaaaattcccattattacaatagtccaaacttgaatagttctgtttcccaaccaggtccatctcaatttcaacatcagaacaatcatatgcaacaaattcctcaaaatgtgtaccagttacaaatgcaaaactcagttaagtctcaacaatcatctcgatctcacagtgtgcctccatctttatccccatctccttcatcgtctccaactctccaggcctctcagttgaatgattacctttcaaaaggatcatactcacaaagctcgcaggcccttcaacattctccgtctccttcgccccagtattctcaatctccccattactcccagccttctcgcaattctcatccatatcagcttacacagccgtctcagatgtcccaacaaactcagttacagtcctctcaaccacataagcagatccaattttctcaatcttctcaagtgtttcagctcactcagccatcccaaccgtctcagcaatctcagccttctcagccttcccagccttctcaacttactcagccttctcagcttactcaattttcccaacttactcagccttctcagcttacacaaccttctcaaattactcagccttctcagctcactcagccttctcagctcgctcaagcatcccaactctcacaatcatctcagcttgctcaggcatctcagtcgtctcaacaaagttacttagctccttcaaatcctttaaggaactacaatattcctatagaaaaggtggtatgggactatttgcatttcttgtatagacaaaacacaggagttttgggatatttggctccttatatagacgaatcatttaatatcggtaaatttcattgtttggtaacggaattctgcaaaagacaaagggtatcgaaggatgcattgatcataaactcaaagaattggtttaaagaatgcctagaccaaagagaggctactcagaacgtggaattgactatagagtgtgaaataaagaagtatgttgaatctaagatcaaacgctatgagggtttgggcttcaaactagagtctgataagatctccaagttttattgtaatttggtaccatacatgatcaagaatctctggagaagattggagaatgcaagttatcaaagagttgactggtcatctagacagttcttaggaagtgaagtagaccccaaattttgcaattatgatatggttagcagaattatgagacttaatagcagcaatcctgatgaatctaataaggataatagtgagacggtatctggaaataaggcaatcaggtctcaggataacgatcaggaattatcatccagggaaaaacacgaaggttctgactatatgatggattcaaactccgattctggtaacaaaaggagccatcaaagtattatgaatggtaaagcaaatattgataatcatcatgaccattgcataaatgaaattgataattctcagagttatggccaaaactacaaccaaaatcaaaatcacgatgatattcaaatgaataaaggaaggattccagatgaacacgatgaacagacaaaagagatggtaattgtttccaggactcagaaatggctcttaagaaacgttaaacttgaagactttaagtacttaattagagttgatcagcttagagaagagaatatattaagaaattctgttccatccaagcatagatccaagtctaaatcaagatcatctaattctaatatctcagtaagactacctaggaaaactcagaatgctattttagattacattaacttgtgtaattttaaaatttaa

SEQ ID NO: 2932 - DNA, 1509 bp, Cryptosporidium hominis
atgattgataactatcaagaatttttgacagattcggaaagaagccatgaattgagcttctcaacagtacttgatgagataattatttcagaattaaatgaggatccaaacataaacttagataactggacatcagttccaaaaatgaagattgatctttttagttatttggaaataatggataaattaggtgagattttgttttataagtattcttttaatatattagtttttctattcatacaaattatacaaagaaactcacgaaatattttggattttgataataaatttgataccatcttaataaaatcaaatatatttatatataattcatggagcttttatttattagtttacacaattggagttatttattcaatttttctatataacaaagaaaagtatttatgtaaatttctattctttcaaaatgatatatttaaccataatcaatttagtggaatatataatacttggtgcagtataataggtatcataagtagatttcatgaaattgttgacattatatttttcagttacttatcatcccagtatttaaaactttctcaatcagttttgttctttttggttcgtttaagcttcttggtcatccaagttagatcttttctagctgctggaaatataacttctagttttaattggataactaataacactcaaagtcatggacaaacttcatcttttggttctcaaaatcttcattcttcttcttcatcttcttcctcttcctattattcgacaatcaaaacagaactttctcaaaatcaagataattttagataccaagaagtgaatcaacaaatttcccctttgtcctcatcatcattccactcaaccaaatcccaagaacaagatattggtagagaccaaagtatggatgttcacagtaaaaaaagaagtataaaaaaagattattgccatttgtctagtcaagttccttcagatcttccctcctcttcctcatcatcatcttcatcattacccgtttccttaacatcttttctttcagctcttccaagtgtacaagacaattttttattttgcaagttttcccaaactttctttacccaaggactgatttcctactttcattttaatgctagtgactcatttagagcagctttaacgaaatataactcacaactcaagcagaatcaaaccaaagtaaagccattcaagattcttcaacttgcagatttagcattttatctagacttgttttcccttgaaaacattttatatagtctttacattttaaataaacacaaagagacacatgaatttaatatatctacctattttttgtggaaagtactttcaaatgacttgattatcaatatctacaagcttttctttttaatatttgtctcaagattatctaagatctatataatactaaccttaactatttcctcactcagtatttcaagcctattcttttatttgcatgtaaataaacaagtaattaatgatgtaataagatga

SEQ ID NO: 2933 - DNA, 1182 bp, Cryptosporidium hominis
atgaatgtaccagtaaagaatgggcaagttacagacaaaactagaataattgcaagtcttccaaccataaaatatgctttagagtgtggggcaaagagtgtagttttggcttctcatttgggtaggccagatggacaaagaaagatggaatactcattaactgtaatagttccaattttggaggaattattgggtaaatcagtaatctttgcaaaggattgtgtaggtaaggagacagaggaattatgcaagaatccagcagaaggaagcgttattttgctggagaatttgagattccacttagcagaagaaggcaaaggagtaaatgaaaacggtgaaaaagtaaaggcaactcctgaagagattgaagcttttagaaagtccttaagctcattaggcgatatttatgtgaatgatgcttttggaacagcacatagagcacatagttcaatggttggtgtagatttaacaccaaaagttgctggcttgttgttgaaaaaagaattggaatattttagtaaagctttagaatctcccactagaccattcttagcaatcatgggaggagccaaagttgctgataagattcagttgattaagaatttgcttttaaaggttgacagaatgattattggaggtggaatggctttcactttcaaaaaagtgatggataatatggaaattggtaaatctttatttgatgaagaaggagccaaaattgttaaagaaattatggatacagccaaggagagaaatgttcagattttattacctagtgattttgtcattgcagataacttttctactgaagcaaatgctaggattattaaggattctgaaggtattccagatggttggatgggtcttgacattgggccagaatcatccaattcttttaaagaattgattctttcttcaaaaactattgttgctaatggccctccaggtgtatttgagatggagaaattctcaaaaggatctcgctccatggttgaagcacttgttgcagcaacagagtcaggttcaatcacaattgtgggtggaggtgatactgcatcattagttgaaaaatgtggatcagctaataaagtatctcatgtttctacaggcggaggtgcttctttagagctacttgaggggaaattgttaccaggagttacctcattgtcatctaaatcgtag

SEQ ID NO: 2934 - DNA, 1434 bp, Cryptosporidium hominis
atggatataaatgacaggtaccttaatactcgtacaatttgtgcttgtttggaaaatggagattttaatgaggctaaggaattattaaagaaatatattacgcgtatatctgatcaatcaaagtcaaaagaaagcgaagttgtaccctccaatgaaacagaaattaaaaatttgcaaatgatttggtatgaaaaaagggttgtgaggagcctggaattatttgattcaagtatagatggctatgtgatgacttttgatcattatttaagattattggactcaatggaaattatgaagactgatcaatacgattatcatttatattgtttaagaaaaatgacactatgtaggtatcttgatttcattaatatgcaggataaactcttttgcaatacaaattatcgaaaaataagtgtcatattttggagaaaaatttggattaatatttacaagatagttcatggtaaattagaattagctcaaatcaattataaaaaagataaacaaaagaacaaaaataaaggtggtgatgaaaacgaaagtttaaaagagactttagaatttgttaaagaccctgaacaaaattggagcaaatctcatgaaattatacaaaattatagaaaggattgcatatttaatacacaaagttatattccaatatatattcattactactgttcacagaagattcttggaaaattatctatggagacttgcattttagtttgtagtaaatcaatttacagagtatatacattagaaaattcatatattagagaaaaccaaataggagttttccctattttactaactcatttttacacaaaaatatttaacaatatgaaaaatggtattggtaatatatcaaaagactatagaaataatatactggatgctattattaaacaactccaaatatttactggtattgagaatttaaatattgataatatcaatacccattttcaaaattatatttcatatatgaattttaataatatcaatgatatcgaaagcctttgtaatttggtcaagatttcaataattactggaacattcaataatattgaatcttatcttgataattttgataatatagataatttgaacaagttctctggaatatttaatcagcaaattattaatttggtaaaattacttataattagatcaattatatccaacaattctgatactgaatctcttaacttgaattcttcaaatttctcaattgaaaactactctttttccaaatctaaattactgaacaaaattatcaattcctatgatataaattccagaaaatttgtcacaacttataatcaacaaaatcatgaacacaagtttatacttcaagttaaatacttgaaagatcaaatttcaaaagaaatcattgaaatctctaatctacctattctcgctttatccatctaa

SEQ ID NO: 2935 - DNA, 330 bp, Cryptosporidium hominis
atgagtaaggaaattccaagtcttgccactcttagtacaagagaccagcaacagtttaagaatattgttcaactatatgatcaaagaatatataagcgatcactaaagcttactgagacaatgttgaaaaagtatccaaaacaaggagatttgttgtctatgaaagcttttatattaggtgcaatgcatcctgagagtaaggacgagaaacataaagaagcatatgaatgtgcaaaagaagcaataaaacagaatatgaagaacccaatgagttggcattgtcttggaacactatataatcgaattcctgcagcccgggggatccactag

SEQ ID NO: 2936 - DNA, 1737 bp, Cryptosporidium hominis
atgtttgaaaggatttttgacagatattcgaaaggtatatataaagttattgatacttgtgcaagtttattatattggtctttaagagtaacaaggtatttctttccactgactattgctttagtattgttaagttttacgatcttcagtttaacatggatactttatcttggattttattggtattggatacctccaaaatctatttcattcccaataaattttgatttccaaaataggtacttttctcaattaataccagataactacttgtatagtgaccaatcctttaataagttctcaaattcagctccaggcttataccaaaggaattaccaagacaatgtatataataactttataaacagtaatgaattatccaggcagctaatgtatgaacaatctgaagcctctgccattttgaactttaacaatattacttggaggtacaagaatgttggtaataaaagatattcagcctccaataagagcttatttaaccaaacgcactttcttgaaaatactgacatttccactgaaaaaaatggtgatattagtactggaactctgagttattttttatacttgaaggattattggtcttttaaagcttataattttgttacatttaactggtaccaaagaaaaaagtactataaagggattgacgagggaattaatcgaatcattcacaaacatgttgactctagatttggaaataggatgaattcggaaatccttggaaacgaaattgatattattgttgaacttttttacttcccaagtcaatataatattaatatttctccttttcaaatttctctagatttaatccaatgcttagaaccacatatcaatcttaacctcgaaagtgatattcataataataactcttcaaaaatcctggctagtttcaagaaaacatccactattgagtatttaccacaagttgtcttaagatttaaagaatacatttctatcattccgtctctgcttggcctacaaatcaactccttaggacttggacttgaaagtaaaatcagtgtcaaacttgttgagaactttcctcttcaaaggaaacatcccttcgattttaattcacttgaaacacatatcaagttatgtggagcaaaaattaaaatgaagcctgctctccacatctcaaaaagccacctcattttccaaacgaagctacctttttggaaagaaatgattagaaaccacccaatcttaatgggaaatatgatttctttcattgtcacactcttcttactttcgttacttttctttatcgtcttcttatctggaatctatttcttatggaaaaagtatcctgcaaacaactataatgactaccatatatcaaatagcttccttcctactggcactgttacatatactaattgtaccccaacttcttcctaccaaattaatagcaatggatttaaccaaggtaataaccaagatttctcttcaacaaagaatatccctctttccaattgtgaacaacttttaattgactactctatgaccaattcttccatcaatatcaatggacttttacctcttgaaactaagcaaatttctcatcccagaaatcaatatattacacactctcagtcatttggcgaccgtaattctgatgaaaatatcaaatctgaggaaaatggagattctcttgaaaaatccatccaatctcccaaatctaattcttcctccaatcattctgaaacttaa

SEQ ID NO: 2937 - DNA, 861 bp, Cryptosporidium hominis
atgacgttctcagtagagttaggcgatgatgggattggtggtgataactcgacaaagaaagtatatatagattacaatgatggaggagacgaaaatagagaaggggacagaaagattgacgagtctaaatccccttcaagagaaagaggtgtatctgatgatgagcaacgtaacaatgaaggaaggaatgaagataatagagaaccagttgaagagagggatagatcacgttcccgtgaaaagtcggaagttgatgtatctgagggatgcagcttacttgttcgtaatctgcgctttgagacatctcccggtcgtgtaagacaccatttcgagagatatggtccagtgagggatgtctatcttcctcttgattactatactagaaggcctagaggattcggatttgtggaatatatggacccaagagatgcacaggatgcagttaatagattagatggaagtttattggacggaagcactattagagttgttgtagctcacgatcgtagaaagagtccggaaactatgagaagaattcaaagagattctggaagaggccccagaatgggaggtcctccatcccgttatgatcatcgaccatctggaggttatccgccagagcatggttacaggggaggaagatatagagacgattattatggtgggaggagacaaggtggctatcgagatgatgataggaactacaggcctaagagacgctattcaagcagaagtcccagttatcattcaccaagaggaagaagtgttagtaggtctccatacagaggcggaagcataagtagagagcacagtcattcgattagtcgtgacccatatcagggcaagagataccgaaaatag

SEQ ID NO: 2938 - DNA, 1422 bp, Cryptosporidium hominis
atggctaagggattgagatttttgaatttgattaagccagctctgtgcgtcattcctgaggtatcgtctccagaccgcagagtgccctttaaggagagagtcctatggactttaatatctctatttgtcttcttggtatgctgtcaaattccactttacggagttttgagcagcaaaagctcggatccattctactgggtcagagtaattttggcttcaaacagaggaacactcatggaattgggtatttcaccaattgtcacttccagtatggttatgcagttattagcaggaagcaaaatcatcgatgttgatcaaagtttaaaggaagatagagctcttttccaaggagcacagaaactttttggcttacttatcacattgggagaggctgttgcatatgttattagtggtatgtatggtgatattagaacaattggtgcctggaatgcaattttgatcatcattcaactcttctttgctggtgttgtagttattcttcttgatgagcttatgcaaaagggctatggtcttggatcaggtatttcactctttattgctaccaatatctgtgagactattgtctggaaagcatttagtccaacaactgttaatactggtagaggaactgaattcgaaggtgcagttattgctctcttccatcttctattcacaaagcctgataagatttcagcattaagagaagccttctacagatcccacgctacaaatatgacaaacttacttgcaactgtattggttttccttattgttatctacttccagggattcagagtggatcttgctgttaagtaccagaaggtacgtggccaacagggttcgttcccaattaagctcttctacacatcaaacatcccaattatccttcaaactgcgcttgtatctaatctatacttcttctcccagctactttaccgcagattcaagtcaaatatgcttgtgaatattctcgggcaatggcaagaacttgatgttggtggtcaatctattccagttggaggtattgcatactatatttcacctcctaactctttggtggatgtagtttctgatccaattcacaccttcttctacatctcctttgtcttaatatcatgtgctctcttctccaaaacttggattgaagtatctggatcttctgcaaaggatgttgcgaaacagctcagagatcaacaaatgattatgaagggatacagagatagctcacttgttcaagttttaaatcgttacatccccactgctgctgcctttggtggtatgtgtattggagctctaactataattgcagatttccttggggctatcggtagtggaactggtattttactggctgttacgatcattttccagtattacgagatgtttgctaaagaaagagaaagtgggaacattgtgttttaa

SEQ ID NO: 2939 - DNA, 1428 bp, Cryptosporidium hominis
atgaaggagttattaaaaaatagtttattaaacaatcaagaaaatattgatgatgagtatttgatagcattggataattcagtgattagtctggagactcttacttctgcattagtaggaacaaaatgttatgttaattgtaaagtagtgaatgaaaatgaaggaggagatgattctgaaggtatttcaaattcactgggggattgtaatgaattagttctcagtgaaattaatgaaaatagcagtttaataagactttgcaggagcgtaaatagactaacaaagcatagaaataagatcgaaaagtatgatgttgagatgaataatgaattagataaaattaagagcgataagacaagagaattagaaaacaagcttaaagagatggaaattaagcttagaagcaaggaagcattgtgttatgctcatgaaaagcagattgaatatttaaagtgtgacttaaaagaattgagtaaaactaataacgaaataataccccagatcaatattcaagaattgaatattggacaagatcaggaatttgagcaatatataaaaacagataatgaacaaagtttgtgtcaatctccaagggatgagctcggtatatattttgggagtgatgaaaaaatagaatgtatatatgtaaatgaaaatattaaaaaagaaaatgaaaacaaaattactcctcttaaattagagccaattactaactttaatcaagtaattaattgccaaaacaacagaaaatacgataattcaagcctgcaagagacttttcgtgaagaagatttaggaatcttggaattgaaagatcaaattcaaatcttaaacttggaccttcagtatctcaaagaagagaattctagattaaagctacaacttgaaaatacaacaaatgattattctgtattaccagaaaaaaacatactagatgaaagtgaggttttatatgatatattggtaaataacagtttttcagaaaagtatactgaaactgatatagagatatttaataataagcaggttgttttcaagaatattgaaaagattatcaatatttcaattataaattcattcccaaaacttaaaaaaactgagcttaagaaagttgagatttctaatattaacaaaataaataccctaccaatccgacaaaatcctaagccatgtctggttatgtgggagcctattattgactgtccttcggatttatcttctggtttaaatacaaaccataatataataccattgcctatgtcatcatatggacaattcagaaaatccagaagagatgggaaaaaaaacccggctacaataatagaggaaaatactaggactagaaaaactgttcctataaatagaaattcattttactgtgatttagagaagattatcaaaaagaacacaagaaaacaagaatcttaa

SEQ ID NO: 2940 - DNA, 1137 bp, Cryptosporidium hominis
atgaatggagtggataaaagtttggaatttctgcaaactttaaggtatggcctattgagagagaacttatttttggaattgagaggtataaaggaatttgaggatcaattaggaaaaagaaagggtcaaactggtgtatggattgaatatatatcaaagataaggagagatattgaaattaatagagatggattgagtcatgaggttgcttatatgatggataagacagagttaaataatgaattagatgaatggaaaaatagggatgctcaagaaaaacagggtattgatgataataatcttgaattaatgtataagcaggattactgtttgttaatattaaggagagcattatcttcaactaatagaagagtatcatcaatatgggtcgtgtatcttagttttatggaagattatgagaattttatggaaatcaagttaagtaaaagattaataggattagatttaactgaggaatatgaaaatagtctcaaatcatgcaatgatttagatctttggctaagatataatgcttatttacgtaaatctcgtctagaatttaccaattcacgtttagttttagacagaagtttgaagagtttgcctattgaacaacatcacaagatatgggaaaggtatttggaatatttgatggaaatgaatattccggaattatcaataagtatttcaaggcggtttatattattttcatatgttgagggaattaggatgtatattcaagctttgattgatggaggtagatatgaagaatgtttagataagcttatagatatagttttaaaaaaggaaggaaatttaagaattcaacaaacttttgaaggcttgaaaaagggagtattagttggaggagttaactataagattggagaaatggatgacttgataggtttgattttggttataattaccgagtatgtattaaaaattgactataataagattctaacttatacaatgaatttaatgcttgagaaattgagaacatgtgatagtcgtgtttatcaggatattaataatgagaatattcaagatgatgaagatcaacagaaagtgaaacccatatttaggcttacttttggagaggtggtttgtaaagtttctgagatttttaagtaa

SEQ ID NO: 2941 - DNA, 3020 bp, Cryptosporidium hominis
atgaatgatgaacataaattatgtatcagatctgcatacaacataccagaaaatgcaaatcttacaatctcatatattttagatctttatcagccgacttttaaaagaaaatccatcgttaatagtccaaaagtttttgcttgcatgtgctctagatgtctggatgattcagaaaataacttatttttagaaggaattagatgtccattctgtattattggatttttagtaccttctccaatttttaaaaaatcagaagttgttgagtcaaattcctcccaatcaaacttgagaattatttccaaaagtattttaccaaagaaatctaaccttttttcaagagatagacctgttaaagatagttttttatcttcatcaatgactaaaaatgaagacaaaatgacatctgatattaaaactctctgtgaaagagccagaattaattgcaaatccggtgaaatacaaattaaatggaaatgtagtaactgtggtgaattctccaatgaaattaataattgttgtaatgaattggtttcaaaaatggaaaatcattataaattagcaatcaattcttttaatgatggaaaagatattgaagctagaaaactttttgaaaaattcattaataatttttcccttattacccataataatcattatttaatatataactctagatcccatcttgttggtttatataatttctcaaattccaatgattctaaaatgtcttataaatactgtaagccaatcattgtttcatcaaataaagtatttccaagttgttatcatgaaaaagttcatttatttcttaatctggctgatattatttacaagaaagaaatgattcaaaaagtctcacaaagaggtgtttttaataattccaaagatcttattatggaatgttcttggctatctttatataatagtatggtatgttatggaccaaaaagtccaatttattattattgtttatcaagaatgcgcctttattcatccattttgggagttatgacaccaccaagtaatatgagaattcgtattgcttctattgatttattttctaatcttaatcgtgaaattcttggtaatagtactatttcaaaaagtgctgattatctttcaactttatctgaatatagtgctcttttatttattgcttcaattaaaggtcatttaatgggtattgctcaattattagttggtcaggttaaagatatattattaaataaagtaacttatttaccaactggattaaatcttcttggaatggctgcaagtagtttaagagatgatgtgtgtgcattattattagaagaaggttctgatttattttttaaaaatgaatatggtattacaccaatacatgctttatgtacatatccaaaattagaagaagaaagtcttaatatacaaaatgataaaaaatctgcaataatagccagagatatgatacgtagagcaattgctttggatatggaaaaaattccaaaaacttacaaaaaagaaaattctggggataatggtgagcatttgggggcgaatgcatgcattcgaaaaaaacatgcatttgccagtaaatcaggagaaaaaatgccagagcggggttctaatagatataaattattatatggtaaaacaataaaatggttaggatctaatacaccattacatattgcagcctttaaaggtagaaaatttttatgttcagaattaatacatggaggtacagatccaaatgttgagaatattgaattagcaataccattacatttagcttcattagaaggtcatatagagactgtggaaatattattaaaatatggaagtgaaataaataaagaaaattatcaaggaaatactccattattattaggaatatatggtttaaaatttgaaacagtacgtttattgttagaaaaaggtgcaaatttaagtcatagatcagatacacttaaaatgaatgcattgcatatgttagccttgggattatgttgtaatacaacattgagttttcaattaccaaaaaaattgaatgatttaccattaatatcacataatggatataataataaagatttaaagacttatatatattcaatgggtacttcaaatacaggatttggaaataattcttcaacaaagatattatctattccaatacatactccaatagcagagtttttatatatttcaccaagagaaatgttaacaagattgaagaattgctttgatataatatcatttttaaatattgtatatgatttaagtccaatgttaacacaaagagatgcaaatggatttacaccttttgaattattaaattctacatggaatgatttcttaaaattaagaaatgaagctttattaaatcaaggattatggtattcttctttatcagaagaagataagatatcgactgaggaattatggtctcatataatgcaaagagttgagagattattagagaaacttacaatagaggagaagatttatgacataaatcatgatgatcctgatttagaattaccattaccaaaaaaagaatatagaggtattccagaattggaattatcagataaatctgaagataaacatgaatatttgtttagaaaaggatatttggagccaatagtaatgaagaaaggttattgtggaagttattcaataggttcagattctacaatatatactcaaggaaatatgtataatttccaaataaaagaactaaaagaattaattatgaagaaaagaaaagatcatatggagattatgcttaaaaaagataaatcagcaggtaaagttggatttaatgatcttaagatgacatttaaaggcaattcaattttgggaagtggaaagtcttcaagtttattaaatccaaaacaatctgaaggtaaatcatcagttaaaaacagtggtaaagtatccaaatcaccagcaaaattaggtttaccattatcttctacactatcatctatgaattcaaattcaataacttcaagttcaaaatctctacc

SEQ ID NO: 2942 - DNA, 762 bp, Cryptosporidium hominis
atgagcaggaaagagcatgaagacaatgatcggggacttgaaaaactcttggaacatttaactcttcaaaatgatgcgttttcatcttccaataaacttcttatgaattattataaaaccttgaaaatccaaacttgtaacttaatgagtctaattaaagcacttatatgcattactagtccaaatagtttatcccaagaagatgaaaattgtgccttaatagtaaatacatgcaaactaaaatgggtggaatctctttacaatttcttaaatattactgaacatgacttagaaacaatagtaatttcaccaataatagaatcttattcactctctgaagctaagtttgagcttaaaatgagcctgataaaatctgaattgaatcttcaaaaagattccttatataaaaatttttattctaatattattggatccctaaatcttattcatgattcaaaaggaatacgtgagtttgtttttgaagctttgaacctttttcaagacaaaaaattggaaaattctatggcaaatgaagaacctttattcaatatttttcttgttaaactctttaataatcataattcagaagaagctattttaattacaagtaaccaaaatgaaggatcctcacaaattttttgtgaaagactcaactttgttgatccttccaagtatttttgttttgacaaatgtattctatttaacaaattcaatcttagattccttgtttataatagtgcaggcggtcttttgttggtctga

SEQ ID NO: 2943 - DNA, 1053 bp, Cryptosporidium hominis
atgacagaagagatcgtttacagctataaaaggtcaaaaaatccttcggagttgattcatatttcaaatcttggtagaaagtgttatttcggattagaggaagatcttctgaaagagtttcaagtatttggagaagttaaagaatttcatttgggtgaaaattcgaattcttttgtattatttgcaaatttacccgcctcaatacgattttacgagcattgcatgcaactgcatgcagaagaaataccggtgttgattggtggtagaagaataaaggcaagctactcacagagagttgaaataaaaaatgttattgaacaaagcagtgaagattatgatgaaaataaaagatttttagcggataaaggattggttttaatcgaagattttatcaataagttagaggctattgaattattaaactggattgacaataatggtcagtgggagactaaattaaatcgaaaagtgcagcattatggttattcttttgattataataataaaacaataagttctgtatgggagagagatattccacctatattaaatcgtcttatagaaagaatgttatcattaaagataataacagaagttcctgaccagattacaataaatgagtatgaagtaggaaagggtattggcccacatatagattctcatcatacaatcggtgaaaatatatcagtaatatctttaggaagtggtattttgtttgaatttaacgaattatcaaaacgcaaaaatcttgatttttcttctaaagaaggtagtggatcgagaaaatataatcgtattagtaaaagaacagtatatataccagaaaacagtttatatataatgaaaaatgagataaggtatgcttgggagcatggaataaagtcaagaaagtatgataaaatacaaggaaaatttcaacaaagaaaaagaagagtttcaataacaataagaaagtatatagaaagtcattataattatccatgtgaatgcgattacaaagatttctgcgatagcagagatccttctattagaattttgcctgaaagaatataa

SEQ ID NO: 2944 - DNA, 1896 bp, Cryptosporidium hominis
atgaatcaatcaggattaggatcaggattgggatcaggattaggatctattggagatatagcatcaggatcgataataaaccaaagttttattaattcttcaagtacaggaggatcaggatatggtagttctgagaatttaaacttttcttctaatagtagttcatcatcatcatcaagttcatcagtatcaataggagatgagagtgatattctatatttgaagagtcttccaggcttaagtgatcaattattaccaagtgaagtagaacgtgtatttcagtatttaacaacaccttatcttagaatacctcttcttttacaattcttttcagatgaaaataggataaattccctttcatcagtttcagtacagcatataatttggatgtctattttagagccttggcaatggtctcctccttcttctttaaatagtttaaatagaaaaggatctaattcagattcttcaaattcattaatgttaataccagtggaagataataaagagatttcaacatcttcaggtcttttgtttaatgagattttaagatctccttcaacactttttaaagaattggaagaattaatgttgatggctttagataaagatactggatcattttcaggagcaaattcaaagattatattgtttgtacttagaatttctataataatttcaaattatacaaaacatttgattagatattatgagaattatacaagaatgggattaggaaaagtattgaagatgaatatgaataagaatgataataagggtaagatggttaaagattctatgatgattggaccaatgataaatggagtttttagaggatttgagattctttttaatgatgagaaattaattaacacattaagacaatcatatacaagattaaggtatttaatagagaatctttatttaagaatgattgtggattggatgaaaaaagctttaaaggagcttaatatttcttccttatgtgtcttgtatgctcatattgcaagtatttatggtcaagttttcagtattgatgatttagatattcattctatcacgcttttactttcttctttggtttttcttactactcattactctgtagaggatggttcctccaatagtaatggtagaacttttaaaaagtcttcttcttcttctacttcctcatcttcatcatcatcatcatcaattcaccaatctgagaaaagattctcaagcttatatataagaaatccttggggttatactttgaataatatattaggagtaccggatttggatatatttacaatccaagcaagaacaagaagtattataattaaatggctttcaaataatgtaaatgaagcaaatttggtattagataccgtagttaatgcagtagcaatgaaaggtattggtgaaatagatattaataatttggatcttaatgatgatcatatagacgatggtttaacaagaggcccatcaacaagggaatggattcaacttccaagtataagtggtggaggaaggtttgttccattgagtgagattcctgcagatttgtatgattggttaagttgtgatgatatagattctgttaagagtaaaattaattcaaaagttggatctagaaatacaaattctagtggtaattcttcctatagatctttaaactggtggcgtttgaaaagaaagttttcaagagctatacaatccagagttcaaaggggaggaggaggaggaattggaattagtagtggattacgttcagatgatggacaaaaagagacttcaggttcttttatagacggattaggaggaggaggaggaggaggtgttagtggatcttattcttcctcctctcctcaaagcaggtacttaaggtcaaggattagagtacaatga

SEQ ID NO: 2945 - DNA, 435 bp, Cryptosporidium hominis
atggtaaaacaattcacaaacgtacctatacctcaaggatgggatcaaattaaggatgaattggagaaatataatgaaatgatgagagaagcagaaaattcttctactaaaggtaagaaaaagaatgaatatttatggccaatatacagaattaatcatttaagaagtagatttatatataccaaatattatttggataaagaaatctccagagatttatatgaatactgtttggatcacgggtatgctgataaagatttgattgcaaagtggaaaaaacaaggatatgaatatctttgttgtattaattgtatttccacttctaatactaattatggaacaacttgtatttgtagagtacctagagatcaattacaagacgatggtgaagatattgaatgtattaattgtggttgtaatggttgttctacttga

SEQ ID NO: 2946 - DNA, 606 bp, Cryptosporidium hominis
atgagggtcactaattttagaactaaatggagtggacttacttgggataaacttaaatatggagaatcttttgaatcaattcaaaaagaatttcttcaaattgttgaacattatagaaaagaaagcacatcaggcttagtttttgttggacatgatatatctaatgattttcaagtacttaaatggactcctccagagtctgaaattagagatacttgtacttattttcctttaagaaaactattaattaaatctcttttagaaaaaggagaaattactcatcatcaaaaagaaggatttctaagacaaaaaccttctcttagatctctatcaaaacatgttcttaatttaaatattcaacaagggtcgcattgtccttgggaagatgcaaaatccactatgatgctttatttaatggtcagagatagatgggaagcacttgtttataatagaaacagtattactaattctcctactactatagctcttaataatgaacaaaatgaagatctgggagaagctgttaaaacacttaataagaagaaaaagaataagaagaaaaaagatattaaaaaaggaaaacatgtaactatcaatggtaaataa

SEQ ID NO: 2947 - DNA, 552 bp, Cryptosporidium hominis
atgagaaaattgaaatttcatgagcagaagttgctcaagaaggtgaatttatattcttggaagaaggaagataatgaaagagaaacaaaaattttgcgaaggtattatatacaagatcgagaagattatacaaaatacaataaattatgtggattaataaccaaattagtttctgggattagaaaacttcctccagaagatgagtttaggaaaactacaagcgagatgcttcttaaaaaactttatcatatgggagtaattcctacttataaaagtttagaagcaattaatgaactttcagcctcagctttctgtagaagaagattggcagtagttttagtacaactcaaattttgtccaaatttgaaagattctgtaaaatttattgaacaaggtcatattagaattggtccaaacactatcacaaatcctgcttatcatatatctagagaaatggaagatcatattacttggactcaaggctctaagatcaagtcaatcatgcaaaagttcaataatgaatatgatgattttgattttcttggaaattag

SEQ ID NO: 2948 - DNA, 585 bp, Cryptosporidium hominis
atgaaaatttcagagtttgatattttagaaacacaaacattgtcagaattaagtaattcatttatatgtcatgattcaaaacaagaggaagaattgcttggatttcatcctactggtgattgttttgaaattaatggtgatttatatttaaatggaactgatgatattaagtcaaattttattaatactttaagtggttttactatgaaatctaatcctcaaatttttgatatgaagaatacacaaatttctcatttaaatattccaatcaattctcattcaacatatattcattctggtgattgtgagcatagagttacatttactaatattagattatttaattcaaaatatgattcaccatataaagattcttatcctatacaaatttattctcatagtagaactttaactttttgtgaaatatgtggaattaaccaagttactaaagttattttcaattcattaaatctcccaagaaatccaagtcaactttgtgattcttgtacttttatttttctttacgataaaaatacaaagcaaagcatagaaaagtgtattattcgaagtattaataataaatga

SEQ ID NO: 2949 - DNA, 351 bp, Cryptosporidium hominis
atggaaaaatttagacaatttgctgatgaatctactggtattaatccatatatacctatttggggtcaaactaaaacatcaattttaagaaaaatactaggatttcctattttgatcacaagatctatcattctttctatttgtttaattatgtttacaatattttcaatggtaatagaattaatgtacttgaaaaatataagaataatcttcttttcaatatttttgaatggtctttcaagagtaatacttttatgttttggttgtatttggatatctgagaatttagataaaaatacaaaatcatcatcatcaaatgatgaagagaaatcaaaaactactcaagcctaa

SEQ ID NO: 2950 - DNA, 612 bp, Cryptosporidium hominis
  misc_feature (607)..(607): n is a, c, g, or t
atgctttcaataatgatagatactcatgagacaatgtttgaattaaaacaaaagacaaattctagattgcaggttattggatggtatagtacatgttctggtattaattcagtaagttgtgcagtgaataactggtttaagacagatattggtagttcaaaatttcaacaaactccattattatctgagcctattcatattgttgtggatccttcattttcaaatggaaagttatctattaatggatatattcaaattcaatcaacatggacaaattctatagtttcaatttttagaccaattccattagatattgttgcaagcccatgtgaaagacttcatatttcaaggattttaagaccattacttgagaaacatcatttaaatgctgtaggaattcctccaaagagtcttcctagaacaattcttggtccagaggatgaaatatgtacagttttacctttaaataattcaaattataatttacaatctggtgatgtttctcaattattaacaaaacttattcttctagttcagagatgtcagaattatgtaaggaaagtactttctggtgaagtttctatggatccaatgataggaagacagnattga

SEQ ID NO: 2951 - DNA, 1191 bp, Cryptosporidium hominis
atggtatctagtaggtcagcaagcccaaatagaagaggttctactggctcttcttctatatcgtctataaataccagaattgtcccctttatctcaaattattactcacttcttggtgattcaccaaattctcttatagatttacatgttagtaatcctgatccacatttgaaatggcaaattccaagctttattattggtgggaatccaagacttcaaggatctacaattattgataatggaataattagcattaaaagttttggaaaagatacattacataatttattctctagtctacctacaattacatgtaagattccagtcgaaattatggatgttaatgaaacaactgaaaatattgttactgtatctatacatggatatgtaatctcaggaattgagaggttattatttttccaagttttacaattgtttcatcaaattgatcttaacaacaaagataattttttaatctttaataatatcttttacgtattcccagtaccatttgatatgaaaagtattcgtagcttacagaccttctcaaatcagcattctatatctcattcattttctttggctcataccccaaaaagtacaggttcagaagactatgataataatactaatgaaacaggacacgaaactacgggaaatcattcccatagtataagctatcaacaacaacatcaacattccacccatcaacaaaatcatcatgttaaaacttttcctacttatcaagatagtaagaagactactaaaattaaaccccaaatcaaaattcatggactatctgcaaattcaggtttatctgataaagacatcttatctgcagtttcattccaactcaaaaatagtaatgaaggatttgccattgcaatcaatagaaataatgatgaagcaatcatccaagttgactcagttcaatcacaagagcttctttcacaaagaggaatctatatacaaggacttaaatataaagtatcaaatgttgtcaagaaatccaattctggaattaaaggtaatagaaactcaaataaaaataacaatcaagctgaagttagtggtccctcctcatcttcagccccaaagaaaatgaacagtcataaaaaagaatcaattccagataaagatggttggataactgttactagtaaaggcaaaagtaaatcaaaaactttctaa

SEQ ID NO: 2952 - DNA, 2010 bp, Cryptosporidium hominis
atggacaacaaaagatattcagcttttagttttgatactccaattaaaagaggtaaagattctctttcgagtattgacactttgaggtcagtagtgacgactagaaataataatgaaggaatagataataaaggtagatggagtgttgattcttttgggtctatcgattatcatagggctgagaggtcttcttttggtactcatttagttcaaaagcctgataatattttgattcatcattcaaaagagagaaagttgattatgctatccaattctgttcaatcaattccaaagtcaatatatacttctttgattaatcccaatgataagctaataggaatggaaaagaattctggggaagatgactttcagataaaagagtatatgattgatttaatgccaattaaaaaggatcaacatgataatgatactttgatattacaagagaaatttgatgaagatattattcaaaaaaacaacaaagatcaatccatacttccaaatattccattttccctatgtatctcttatcttagacaagaaaggagtcaaatatgtaacaaattacattcagtttggaagggatataaaacaaggtcaatattaagaggaagtttacaaggaataacattattgaagacaagtaatagtgatggattttgtagttttggtaagatctatttgggttacaacatacacaaaattctcttatctattatagacttgtatgacctaatattagatgaggaatcaaaagtatttcaaggttctagtactaataataatagtactagttggttagatgcaatgtacgagcaggtttatgatttcaaaactaagtatattttagaggttaacaattctttaaagggaaatcatggaaagaaatgggtttcagatattcttaatgctagagagacaagtaaaaaagatatttcaaggaagctaatagaaaggaaaggtttacttcctaagagatttgagacaaaatataacgaaaagattcataaaaatggattgttttacaagtctaataaaattatggataggaatgatgatcttgctgatcaaaatttctcacaaaaaagaggagttggtggaaaaaggttgttagaaaaggattgtgatcaggataatggaaataaaattttagagtctagtagtgatgaaatattcgatagtatttatattccttatagattggtgaaatccaattctttggaagaaatttctacttatttgggtgtaaaaactgacaaaatattggaaatgattcaaaataagtcagattcaaaagatatgattaataacaaaaataatattattgcaagagctattggatttgatttaactccaggaataagaagaaagacgggcgaattagttagagaacaaagtccatttttagataaaataactccaaatacattaagagaaggaggaagtaatcccaatatttactttactccaaacagtttaattcatggatcttgtaaagaaggaaatgattgtggagagtattatactccaattcaggagtttggggattcgataattgatcaaaatgagtatggaagtgatgaatataatacagagaatcagggagtaacttatagaattattaatcaaattaagccaaagccatatttaaaaagaaaaagtaagagtatagtaccatcaaaaggaactgatatagaattggataaggtaacatcaaaggttaaagagctttataaaggtaagaatttggttgaaaagaaagttttaagaaaggtaccagtttcaggggtatatgaattatcgggttctagaattccaagtatatcctctactttgaatattgtttcagattctccttcttcaaggaattcttcatcaaaagtttcaagaattccaaagtacactggtacaatcagtcgtaataatgtattaaaaaactcccagaatagtaagggaatggataatagtagtactccacaaataattagatcaagatatagtgatttttaa

SEQ ID NO: 2953 - DNA, 1230 bp, Cryptosporidium hominis
atgtataatggagtggggcttagaactgcaagaggttcaggaactagtggtcatgtacagaagaatctatcagcttatattcctaaacaatgggaaagaaaaaacagtaaagatggtataaattcaaaatcaggaccaagaattcctcgaacaacgagacatgatccagaacttatagaacatgagaaattgagaaagatggaattggaaattttacagtttactgaagaacaagagtcaaaaggtcttaaaggggctgacttggaagaagctgtagatagaaaacgtaaagaattagctttattactgaaaaataattctaattctattagaaattataaggataaccatggtagctttgattcccgcaaagaaataggatttgttagttctcaatttggtgacaatgtcgataagttggattctaaccaattatctagactcaaagaagaagaacttaaagtattcagaagtgctttgggactagataaaccaacaagagggagatataaacaaagatataataacaagagaagcaggaatggaatcacatttagaaacaagatgactaatgaagactgggaaaatgaacaggagagagagagaaatgagagaagagaaggagtttcctcaaaaaaaggtgatatatttacacaggaagttaataataaggatggtttaggtcaaaggaactttgaaaacttgaggaaagattttgggaattataacaaaaacaaccaagataacattgatgaatttgaggacgttaataaggctcaaataagacataaattaggtctcaaatctcaaatgaattcaaaatcttattttgaatcctctccaaagtcacgctctcattcccattcccattcctgttcccgttcacattctaattccagtccacactcctactctaattcttgttcctattccaattccccatctggctcccaatccaaatctaattcacattccaggtccagatcaaattcttactctgagttccaaaattcatattttaacaattataaacaaaaaagttcaaaaaaaaaggtaaaaagagaagcttattctagctcagtaagaaatcttgctgaactagacagtcttgaaagaaagaaaaaacatagatatagaaagccaagaagatctcgctcaccttctacagtatccagatataggtcttttagtagaagtttatcaccacaaccattggcgctggcgggctag

SEQ ID NO: 2954 - DNA, 1734 bp, Cryptosporidium hominis
atggataacgcttttaacacaaatttatatggcgtttccactgagccaatcccatcaatgatatcattgggtggcttgaatggaaacttaacaaggaataatggagagagaataatagaaagcttagtttctggtggggtcgatggaaacaatacgttgggaagtaggtttgatggccaggatgactctgtaacagctgacgttgatacggaaggaagcgaggagtctcataatcaatactggaagacaaagctttgtttgatgttttcaaaaggagcttgtaagaatggagataattgtaggtttgcccatggaagtgaagatttaaggactcctgtaaacttaaaaaagactaaattatgcccattttggttaagttctgcttgcagtattggagagaattgtccttttgctcacggtactactgaacttagagttactaatgacttttataagacttcagtatgtagatactggaagatgggtgttaaatgcgatgctggagttttgtgtagacatgcacatggagaggcagagcttagaaaaaagacaaacaaacatttacttagacgaaaagatgatcaacttccgccttcaatacgagaagatgatctaattctgccaataaggagcaacaaatttaatgaaaatagccgatttctatttcaagtccctcctccccctcctttagtatactcaagctcaggacaaccagtctcttcactagggaaaatgagacaatcacactcacattcaaatcttcattcaaattctagaacaggattgggatttaatactcaatcaatacaagcaaaaactttaccgccaattttaagatatattgaccaagaaggtgagggagatcacagaatgaagcggaattacagctgtgatgatatttttagaaaaggtgaatgcttttcaaattctcaatctcattctaacttacaaaaccattcacatccccaacctcttccaccccagtttaattctttccatgataatcaaaatagcgatattacaaatattccgtgtattaggggttcttcatctcttaataacttaagaagttgggactctaactctaagagtgatcaattgaatacgtctcaagacaacatttttggccttgttggtcttgataaggatcctggattatcttctgccagtattattaaaaataggttccgagatgacgactctgaaaagcagcttctggacttaagatcaaatgaaacagacttatcttcattttgttctttgaaacgaatggaggatagctcaaattctttggtttctaacatctcagatttgagttttggcgatgattttcttggaggagtattaaatagcaagcttcaaaaccatcaggttttaaaacattctcctgggcatatgctcaatagcttatttaactgtaatactgataatcatagtggttcggccacgggacataattgcccaccatcaagtattgtttcagaaaaaaagagggatgagataaactgtttagactattttaagaatgtcgcagatgtggttccatctgaaggatttctttcaaaagttggtcattttactaatagctcagaagttactcattccccaattttggttaaaatcaaatttctagattctgcagaaatttcctctctttcaactggagaagtccctgccattctgatcccttccgaggatatgaagtctgcaaaagtacattttttgtcaatttaa

SEQ ID NO: 2955 - DNA, 3978 bp, Cryptosporidium hominis
atgaatgaaatcttggagaataaaactacaaatggcaacccagttcctaactctgatgaggagagatctttgggaatagatcaagagtcttattcagaaatttcttccccacaaaaacctaaaatagagggaaaagaagaaacaggatatgaccaagacctagacaaggaacaagatcagaacctggaacaagatcaggaacaggaacaggaacaggaacaggaacaggaacaagatcaagatcgtgaacaagaacaagatcaggaaggagcagctagcgaaagaagcgagggaaaaacctacagtcaaaagacagatggggatgcctcttctgttataacacaaactagtcaaaatgcggtatcggaaattcgtataccgagagggagaggaagacctccaagaaatgcgaatagagcagatattggtccatctggactagttagtataacttcaatctgggcagacgatgataaacctaaagggaagagaggtcgcccaagactccgtcctttggagccagaagagaaagttgagccagaagcagctcctaataagcctctaaaagtgaaacgtccaaaggggccaaaggatattatgtatgaaatcatccatagactatacaaaagagacaaacaacagatctttgcggagcctgttaatgctgagtttgttccagattactaccaagtgatcaaaaaccctatggacttctctactatgaggaagaaagtatcccaagatgagtacaaggattttgattcatttgttgatgatattaagctgatcattactaattgctatacatataataaaataggcactatggtatatagaatgggcttgattctggaagaaacttgggataagagtctagaagggagtagggctagatatgaacaatccataaagaacgttgaggaatacgaagagaagaagaaagctggtgagattattagtgactctgagcctgagtcccaaccaatctggaataacactcctacatctcctccaactatggaatccccaaatccatctaatcaaaggtcaatggtaacaagaagaatggaagctaggctttcaaactcacattcaccctggatatctaaaggaagtggaggacctggtgctataggtggttcttctggagctggaacagggatttctggggaaagagattcaagcacaggaccagattttatgagcagaagagccttaggagggcacccatttggaggcgccatggcttataggggaggagagtttggaaggcatccgccatacccaggaggagtccctggccaagttcaccaaaatactaaaccaaaaggtcccactctcgcggacatttgtaaaggaggtgtgacatcaatcaaggaaaatctcgagaagctcaagattgatagatttgaaccattcagttctctaattaaacaactagcaactcagccatgcatcagaactcctactgtagatgactggtatgtctttgataaacaactttctgagatccaataccgtaattctgttaagagatttataggggatgatagtattcaagctctgaagaaaattatggatatagaaactgcactcttggaaattgatcctcatccagctatttccaagctccctttaagtgacactagacttcttggaatagatactgatgactttgccccattcaaccagaacctatcagtagacggaagctttcttttaggagttggtgataaccacattaaagttgcactaacacttcaagatgaggttccttcccttgaccttactcccctaaaagagctcgtaaccaagtacactcaacatcctctctccacacaatcaaatggcgcgagcgccaatatcgcacagggttccttccctaactcttctggagtctcagtgaatggcctttctgcaggtgctggtgctggattagggggtggagttggatcaggaactacccacattggtttttctaaaccctctcttggaggaggaaccaatcagggaggccttcacgcgtcactccctcacttacaaaccagcgagactaagcctgaacttcctccttcccaaaggccagctatggcgggtactgaaatcaaaggccaagatcttaagtctatgcattacaatggatttggtgttcatcgaggagaagtattgccaggcactacagaaacctctggtgtgagtaacgtccctctttcccaagtaggtcagacccacgctcatgggagaattgcttacaagcatggatatcccccatccttaggatctggccctggatcagggacaggaactatgcccatatctatgcctgttagtggaactcccggaaagccgagtgtccctggaacttctggagtaggaaactcaagcaacttttatgaagtttgtcctccagctaaggtccaaaagtttgagcaatctcattatcctactcatagtggtgcatcccatgcgttcccttcttctcactcagttataccgccacattcagtgcatacagtgcatccgactcagccttcggctatccctaagcaaggagtccaagcagcagctcctcccagtggtggtaataaacctggtgtccctttgaactataatcaggttcatgggcggggtatacagcatggaggtcaaatgcatgcgcaaggccatggtccgggagctggacttgggcatttaaatgggcatcgtatacagagtaccaatttagtagcaaatcccacaaactctaacaatgtttctcctgttagtgttggaaataacacaaatcagaatatgagagcctccgcctcgagtcctaccgctaccacctctactagcaatactcacttgaatgttaatttgaatatggcttctaatgctgctgcaactactactaatgcttctgtttctgctaactctatctcaacagctcaaacagctcccatcaactctactgcaaatatagcatccgccaatactgctaataatacagccaatactcctttgggtaattttgttccaagctccgttgttccaggttcagctgtaacaactgcctctattagtggaggtagtcaaatgaatcatattggcaatgtaccgacttcagctgcatctgctcctacaaattcttcttccatctcaccaactgccaatgtttcaaatattcaatacttgaacaataatgatgttcgtagaatctctgataagttaaactactctcaaaatatgatgggaagccaagtccatcaccagggacatcttgtaaacagaactcatgttagtaaccctggtagtcattaccttcaaatgaacgcaagttcaggaaaccatattggtgctggagctggaggagctgcgatggtaacaaatactaatcaacgtatagatcatgcaatgagtggtaatattgggcagcaaaaggtcataactagtggttacatccaaaataatgagtacatgccacggggagcagacccaaatgtaggtggtggtactaatagtagtaccagcaataacaataataatagtggcaataatggcaatatgtatgggttgtaccagtataatgctaagaaaccagaaatacccattgatattagggaggagcgggcacgtctggaccagaatatgtatatggtagaaggtatgggagtaaatggaatgaatatgaggtctcgtcaacaaatgctacaaatgcaatcgcatcagaactcagttaagccaccccactaccaccatcagtatccccctcaatcgcagatccctattcacaagtcccatgtaaataatggaaacgtttccaatgcgaacggaagtaataacttttatcaaaaatataacaataacactacaaacagcaatagtaatattcaatatcataacagaaatatctctccaatgggacaagcatcttccaatatccctaatattgccaatcccataaacaatttgactagtggaagttcacaatatccgtaa

SEQ ID NO: 2956 - DNA, 727 bp, Cryptosporidium hominis
atgaccagagcaccctttcagtcaacttctccaagaaacttagaatttcttccaaatatcaatagactatcaaatgagccaatagatatagcgaatgtttcaaagcaaaagctccaaaagcaattgagtgacttgaggagaaaatcagtgaatgtagagaatattccatcaagaagtcaacaggaagatcctctgagttttaatgagttaaataatggatattcaggagttttgataaatacaagtgggagcttaggagtaaattctcatggatttggacaaaaatatggaagtgcaatctcaaatttacaagcagagctggtatctctgaagaaagaatattcacaattggagaagcaatataaacaagagttgttaagaaggtcagacttagaggaactaaaaagaacaatcaaagatcagaaactacatattagagaattgcagaatgaattatcagatgaaaaaagaagaagcaaaactcgtgagatgagtattaaaaataagaataattcagaatctgtaacaaatgagcaatggaaggatatgttagcaagatcggaacaagaaaagagacagaaacagacacaactaactgaaaaggaggcagaatgttctaagcttataaagcagattaaaagtttgaataatcagttggaagagctaagagaattagaatctatttcaaaaaataagatttctaaatttgagtcagaaatgagtaaca

SEQ ID NO: 2957 - DNA, 804 bp, Cryptosporidium hominis
atggaattacttaaaaaagaaaaaactgacttagaaaatctcctaagagagaaagaagaagaatttaacttggttattatggaaaaggaaaaggagaaaaacgatgaatctaaaaccaaaattaagtatttagaagagaaatttgctatgataattaaagacaaggaagaagaatttgaaacaagaattaagcaaatgatgaaagaaattgaatccatacaaattaaaaaagatgaagaaatggagtatcgcttaaaagagagaaatgaggaagtagaaattattattagagaaaaggatgagaagattcaaaacattttaaaggaaaagtatgaagaaattgaattaattattaaagaaaaggatcaagtaattgaaactatttcaaaggaaaaagaagagaaaattgaatccataattaaagaaaagaataaagagattgaaatcatttcaaaggaaaaagaagagaaaatcgaatccataattaaagaaaagaatgaagaaattgaaattatttcaaaggaaattgatgcaattaataaagaaaagaaagaaacaaaagttcttgaacaattggaagaattgcagaaaattattactgaaaaggaagaaattatggaattacttaaaaaagaaaaaactgacttagaaaatctcctaagagaaaaagaagaggaatataactttgaaagattgggaaaagatgatcatatcacaaagttggtcaaagaaaaacagaatttagaatcagaaatgaaagtcagggatgaatattttaaagatattttgagagagagagaatga

SEQ ID NO: 2958 - DNA, 501 bp, Cryptosporidium hominis
atgattaaattgagtgggaaactctgtaatatagaaaactataaaaagctatgtggggaaattctgtcttattctgggaatttaaagagatctagaaagttaatccaagttgaacaagaacattcctgctcagatttgtcatttgacccagaaaactatcattcaactaacttagaaaaaccttgttcagaaaaagaacttgttgagaatattcgaactgttgcagaagttttaatatgggaagaccaaaatgatgaacaaggatactttgaaatcacctgtaaatttgaaatcttccctactcttgtagagcttgttattcatattgatgtcaattattctattaaaaaacaatccctacaaacactttcaattattttacagaatatcaaaaatattaatactttatattatattctaagtaataatataatctccaaactcttgaataatacattcaaatctggaaatcttcaaaatgtcagaaaagaactcatataa

SEQ ID NO: 2959 - DNA, 816 bp, Cryptosporidium hominis
atggataaattgatgaagctcaaggtgtgttgtagaggaagtgtggtgcagaccggtcgtgctgcttcattatatccaaaggtggctggtattcgtcttccaaaaagaatcaagtatgtgaggtctggaaatggtttatctgctcaccccattcaattcaataaggtacttttatttagaaaaaatagattatcaaaaaagtctattggtcatttcttcactcctcaaccaaaagaaaagcctatcacaatctctcaagcctatgatattgttaaagaatctcaagacgtttctagagttttcctttctgaatccactgcaatatataacagaatgtatgatctcggcacatatcattgtattatgtatatgagcttattccaatcttttgctcaaaagaaaacggtcttgagattcccaatctcaatatctatgtattctcttttactatttgcctctgattcactccaattgaatcccctttcattaatcaatcaaatgaaaaaaatctctcttaatccaaaccatcctaaatccaaaaaagatcaaccaaatgatcaaaatcatattgatcctgaagattcacttaatcacattcttattgatgattggatattattacaatgccctggacaaattcaaagtattctatggtacttcagatatgttgttagagattttattcagtttctatcccaaaaattacttgaatctaaatctgttactcctttatcctcaaatcattcagaagttaatactttcttcactgttaaagaaactaatgaaattcttgagttattacatttccttatttaa

SEQ ID NO: 2960 - DNA, 3222 bp, Cryptosporidium hominis
atgaagggaaaaccaaaaggaaggactgagcccagattgtttgcaaaggacattaagcaatgggttaatacgaatattttggatcataagtatgaaaaggagacgatatatggagggaaattcgggaaaaacaaagacaatttggcttttaaagataagttatgtgggatatgtatgagcaatcttgtggtcttcgggcttgacttttctcttaaatgttttcatgctatttgttggtgttgtactcttagattaaggtatttgttaaagagtaaggagtgtccattctgtaagaatactatagaaactttattctttacttccaatccaagatattttgagtatttaatagatgattcccttgaaggagttgctgatagatctttggattctgataagcaggagggagtgaatataattgaagctaatttgggtcatccaaaattggagcaagtcccaaagtctctaattgatgaaaagattggtgtcatatatgaatcttttgcttgtagatgggtatttgagcgtatattggagtatagatgttggtttccaaactgtaggcctaaattccctaccaaagactctgaagatctccatagcaatttaaagtcatacaagaatactaaagccttgggtgaacatctttttcaagatcatcatgtaaagtgttgctatgtatgtattgagaagaggaaaactatgttattacctgaacattatttgtatggagtgaaagatctttctcgtcatttaaaaaaaggagaaatgttcctcaagcctccaatactaccccatatttcttgtccaatctgtaaggtttggtgtctagataaagaggatttttctgatcatgttaggaatgaacacttttcttgtcagatttgtgaagaaaaagagctttctagggaatcaggacttttctctgaaagttctagaaacgaagaaactgatctaaacgagaataatcaaggagtggatgaattagatgatgaagaagaatcaactaatagagttggagctcaagagagtaactcattaactcgtgaaaataggcttcccaaaatcacatatgtttatagagattaccaggcattaaaggaacactggagacagaaacactatccatgtgatcacgaaaattgtatgtttattgtatttgagaatgagtcagaattgatattccacaaagctactcatcactctgcagtaaatagaagaggaaatgtcacagttccaattgtgaatagttatagacagcaaagtcaaagaagagtaaatcagtcgaattcatctcaaacaacaaatcagcgtgtaggcaatccaatagatatatcaactccatctttatgtgctatggatgagcttagtaatactattctaactaggattaaacgagaaaaatccttactttggagacttgttttgattcacgatctcaacaaatgtattcaagttgtaggagatgaaatcacggtcaaacttggacttgaagagaaatgtagagatttcagctcttggagcttacaagtaataaatgatcttttttctagaaatgaaacaatgattggaattattcagaaacttgggtcaacttatattaaaagagagatttctgctaaaagtttcattattgaaattgtagctcttctgtggggaagctctcataaccattctaataatacaaatattcttcaaggcgtaaagaaacaattcaaaagtattgcaacctctccaagctcttttaagatcttcttctcaccaagtcctgagccaataactatctttgaagatactcttaaagagagatctggaacatataagagaattccagctcaacttgtggatagaatccttgcagaagaagcaaattggtctttattatactcagatgtaatttcaatgatattaattgcattaattttaggactccctaatatagagaatagaagggaattaattaaagctttaacaagccttaaagatgacatccaagagaaaaacattacaattatttccaatacaagttttccaagattctcttttgggaatttacagagctcaatagagatagaaaggctaaaaattcatcctcaagaaaatacagagaatcaaatacaggaaaatatcaataagaagcaaataagacaaaagttcatttcatttgagaagctaattaaaccagatgaaatgcttatttctcaaaaagttacctttttggaatccctaaactcgtttctcacagcttgtttttcaaaaatctctctttctcaattttcagaatttttgccagaggcatcagataaagaaaagatctttgataaatttaaaatcttgattggatcacaaacctcaactgaaatcaatgctctatcttctctataccaacatactagcagcttagtttcttcagcaaacactatagaacgaattctaggacttagagctccattttataggctagctatgaatactacaacatttccagaagattcccaaactccaagtacaattactgagtctttggcgcataggcaatggcttaatatctgtactaaagcattcaacaagatttgtgtctatgatgttgagatcattcttatatactgtaaagcttgcattaaaactttaaatgatccgaacttccttcttttggagaagcagaaagaagagttatacgagaaaaacaaggaagaaaattcatctgaatctgctccaaaaactgtgaatgctcactctggagttatatcccattcaaaatctttggcaccttctctaacatctttgaattcacttaaaattaacacttctggaaattgggcttctaaaacttatttgagttcaaacagttctgttccaaaaactgtgatagcttcgtcctcaccaattcaatctggtacctcgttttcctctactactgcatcctcttcctctgcaacatcctcttcctaccagcccacaaccaataaatcgaattcaatcggaaagacaataaactatgctcaagctttaaaatcaaaagaatctacagccaaaccagctaatgaaaatgaatcaaagcctaaaaaaatgtttgagtttcctgaacttattagtaaaggtgaaaacaaaggaaaagctcgcatgaaaccagaaaacccgcctaaatgggtctgtatactttgcacacacgttaattcaggaactagaaatagatgccaaatctgtagcactcggaaatag

SEQ ID NO: 2961 - DNA, 684 bp, Cryptosporidium hominis
atgaatgttcagaggattagtaacaaggcttcggtttttctgaaccacaaacactttcatccaggtaactcaaagaatagagaaaaggtatggttagccgaagagaagcttaaagaggaggagagaaaacaggaggagcttcttaagaagaggaaaaaggaatgggagattgaggaactcagaagagatcttaggcaatccaataagaaggtaaaggaccaatcaaaggttcaatcagaggctgaggaagttattgataagagtaaacagctacatgatatgttagttgataaagcaaaagctaacaaaagttgggtcaagtcagaattatatgaagaggatgtttttttaggaaatcattcttctgtatggggatcatattacgacccaaatgtgaaaaaatggggattcaagtgttgtaaaaacttgaaaagaagttcagtttgctcaacttacaataaatctaagtctcaaatatcaaactcttcttataacacttcaatttctgagctattcaactcagatacaaaatatcaatcaaaatcggatatctctgaacataatattaatgataacgctgggctcctcttgttgaatcaaggaaaaccattttcaaaacaacaaaaaggggtttctgaattccttaatatactcaagcaatcccgacctaaatcatcaaactaa

SEQ ID NO: 2962 - DNA, 2604 bp, Cryptosporidium hominis
atggatgattttttgaattataaaaacttagaaaatgattcagtgggaaaagagtttctagctaatcctagccattcaagttttgatttggcaactatttctacaatgacttcattacagggattagaaacatctctatttcatgatcaattctccccgattttaggaatcagctcaaataccttggattctcttggtaagactaaatccaaaagaattattactgaagatggtacaattaattcttccaagcaacaaaataacctaaatcagaaccgtgattctggtacaaaattaaagaatactaatactattaatacttcaagcatatctgagaaaaaggatacctccattaagcccaattatccatttgaaaatggagttcaaactttatatcaaattgagtctaaatctacaaaaaatcttaaaaaccctcttccacttaaaattactaaaattagagttaatgacttagaaatgaaagttataccttctcttaagatttctacagataatcatcatagagaattacccactggatttaaaaactctgatcacctcgtcgatttttttcttggaaaagtcttgagatcttcaaattctctcttttatattgaaaaaaaacttcaacaagctttatatggagctgtattcctagcattcgaacttgaagagtctaagagaagtgaaaatgttgaaagaaaagagatttctcattgtattggatctggtacttctgtattccttcaagattatgatataccttctttcatatttgaccctcataaaagtaaagttgctattaagatctctagtatgagccttagaagacgaaaaccatcattaaaagaaaatatggaggctgaaattatttattctgatactatgactggacacaaaaatgtcttagagtattctgaaatctggcaggattcatttaagaatatatatattaaaatggaatatgctgaatatgaagatctatttgaggtaatgagaagaagaagacctttaactgaaaatgaagcaagatggctttttagtcagatatttaatgctgtaattaatcttcacaataaaaatatggcattaagagatctctctcttgaaaatatacttatgtttaatcaagaacctcatttttttgatctttctcaagatcataattttattgggatcattaaacctggagattcaatgattatcccaaagattactgatcctggacaagcttgtaaaatttttccaaaagataaagatgaagtttccaatatttggaaagtttatcaaagacatcccagagatagtggctttcagcttcaaaaagttgattttctatttggtaaatcatttagacctcctgaagcttatgagacaggatccttatatgatcccacaaaagtagatgttttttgtttaggatggatgcttttatttacattaactaagtatcaaccttttgagacttgtagattaattactgataatcttagtcaaagtcctgttaagaatgaaggatttattaattcactctttggtaaaattatacctgggaataatacagactataagatcaccaaaatgaatggaaaatcatatatacacaaagatcaaaattggtctctaatagtaaatggaagaattttagaactatttaggaagattaaagcaacaaatctatcatcagaagctcaagatctaattgaaaatatgttattacctgattataaagagagattttcaatgcaaaacgtgatagctcatccttggcttaagatatccagtaataaagctagtaaatactttacacctataatggcttccacactatctccaattaaatctcacaagaagatgaacaaacaaattaagcaaagtagtaatattgtaaatccatcaaaattctttgataaagtggataataataatgatataacaataaagaacaacattaaaacaacctttgatgagagtaattctgtagattctggaaactcacaggcaaaaattttaatctccaaaattaataatgattatttatgttctatggtaaagagaacaaatgataaattaaatatgacaagagtaaatatatcacgaaaaaaagattctgaaatagaatctttaattagaaatctgaactcgaactccatttcagattcaagacagatcaatccaaatttcccagataatgacatattaagccaactttcagtaagtcctcttctgagcaaagtaactaaaaataaggacggatccttagtgacgaaaaatcttcctctatcttcttcttcctcttcttcctcttcctcttcctcttcctcttcctcttcctcttcctcttcctcttcctcttcctcttcctcttcctcttcctcttcctcttcctcttcctcttcctcttcctcttcctcttcctcttcctcttcctcccccaaaaatgcgatccaagcaaaaataacatcaaattcaacttctagatcttctcaaaatgtcaaggtaagaaagaagaactttgaatcgaacttcattttcgatctttggtcattcttaaacggaggtggtgggaatgggaatacccatgatcatataataattaattag

SEQ ID NO: 2963 - DNA, 3033 bp, Cryptosporidium hominis
atgacggaattggaagactcacataatgagataagctctcatgaatgggaaagcaatctggctaaaataatttgtggaagcttgctgagtttgaatgggttgattgaggatatttcagatgaagatttacagaagaggttgaataatcaaagtatgttttgtatttttgaatgtttttttgagccattgttatattacaagaacaaacataatttgcccccaaatttaccaaaattaaatgatgaatctatcgaaggtaaatttattctggagaatcctttatattctgagagtgaaaatagagatttgagtgaattatttcgatttggaaaaacacctaaagtgagtatccaggaattatttggatttgtactaagtgttttacatcttggggggttcaatgtttcaagctttgtattatcagtcattaatatggcaaaatttgtggagaaaattaaaatacctatatgtcaacataattggagaccaatttttataacatctttaatactatcagataagttatgggacgatagttgtgcgaagagtggagatttagcaagaacaataggctttatctctccaaagtctttaaaatatttggagctgattttctgtgaggagttggattggaaaataacctttaagcttgatacaattaagagttttatttcaaagattgtcgattcaaaattagatccagaattgattcaaagagttataagctcagaaacttaccaatcatattgttacgaaggaattcatgacccaaatactcaagcaaaacaagatacttgtgcagaagagaaattggagaataagaacatgatgaatagtgtatattcttctgacctgataaatataaataaacagaaaattggtcaaaagtttagccaaaacaataattatcccaaaaaatcagaatctccattattttttaacaatcaaaatccaagaatgccaccttcgatgttagaacaaccacaactacaaagaagagtgtcacttcaccctaatcatctttcatttaatgctcaatccgcaagttccgctttttttaacaatctgaatatgaacactaatgctactgctacagcttcaatatcaaacgcaataagaaaccagataggtgctcctataaacttaaatggaactcatcaacatcaaattagtcatttgagctcgaatatgaaaagaccttcagttccaacaataactcttacaggaggatcatcagcgttaaacaacagatcattttacagtcctgctagaaaccaaattaatattaatcacaatcataacaattttgctcacggatccagtctaagcttgaatcacattgcaaaccttacaagtcctaaatcagatttcacgaataaaactcagaaatatcctatactatcaactatgggccaaactcctagttcaaaagcttcaacatcaggaagaagctatactagtgaaaatctcccatccattggaagctatgccagatccactactcctgatgttaatgccagtactgttagcaactttaatcatttcaatgtttcgttatcaaatggacgtggaagggatacaagctgtttatctaaattaaaacaacctaatccttctcaaattaatactaatatgaattcaaatcttaatatttttgagaaaaacctaaataaccactctcgtcaaagtaactccataaaaagatccagctccgaacactctagattaaatcctgctaacttccaagcaaatcagaataatttgcagcagctctcgcgtcctccccatactcctcaactcataagaggaggaagagaaggagaaagtgcaggcttcttttctatggctagaaataaggtatcttctgcattctcgtctattacaagaactttcggcttatcttctccacaatctaatcaaattaatgaaaacggcgatcaaagatctaatatttcctcagctaacttaaatcaaattaatcctactaacaacttgaataacattgagcctaattctgcattatttgaccagtctccaacatcgcctgctcaacctcaaaaaattgaccccaactcaaaccaccatttcaaacagcaaaacaagctccaagaatactcccaccaaaataattctgccaaaagaaacttttctatgcccccaaagagtaatcctgtattttctcagctatccgaaaataaacaaaaatctcccctactaagttcaattggtgtctccaatccccccttcacctcagcaactaaacctaattctgggattgaaaagaagcctcctctaacccatggggaatataatttgaggtcattatctacagatagagcttataatgtcaaccatccatctcttcgtcaaaatttgccatctaatgcatacccccaaactgttaaaaatggaatctcaagctctaatcatttacctgaaaaaaaaccaactcttccctcttcaatgccatggacccctaattcctcatcttttcatgttcctcagaactctttccataattcgtctcatgtttctgaccgtttgaccgccaacatgcatgctacacttgggcgccactctgtgggtagaggtgccagtcaggttcgaaatattccagtacaaaacagtaacccttcgattagtagtggcttttttgggaaaacagtagggacaggagctggattaactagaaatacgtctttggtgggtaaaagtgtgaattcacaaaaaaattcaactggagaaagcttattaagtagtttttttggtggaaaatccagaatgcaaagcccctgtccgtcatctaattcaacaaatactggtttgaaaccaactttaagtcagttaaataattcaaatggttctacttccttatcatccattttttctatggatagttttattaatcctattggtaatcttttgaaaggaaaaaaaccatctctagtttcttcttcaatgtcaataaaggctccaggaactcaaattggctcattacctatttcaagagttggtttatcatttagaagatag

SEQ ID NO: 2964 - DNA, 618 bp, Cryptosporidium hominis
atgaaattctacttaattattgtatctattttttttgtgtttctaaaccacttcttaggtttctcagctgatgttcagatcgctggaaattcattcttgaaaatcagggtaaaaagtggtaatcaggatttgaacggtaattctgaaagcaatggcaagaaaggttcagaaggcaattcaggggctttaggagctgcttcaacgtcgtcaacaccaccaccaccaccaccaccgccatctcctccccctcctccaacactttgcaaaaaatgcaatttaactcccaaacaagagattgtaataaccgcctctattacgaaactgagaagattccttcaaaggttggaagatttggagaaagaattatcttcagaaataaaaattttgtattctaaactcaagaaaatccttctgaaattactagaatgtcttgaaaattgtttgcttgatatttcaagctgtattaaatgcttggaatcagtagaagaagaattagagaagttaatcaaggaagcagaaaaagatgttgacgaagatttcttggaagcaattcaggagattcttaagtttgtacaaaacattaagcaatacaagcactgcaatctccctcaaatctaa

SEQ ID NO: 2965 - DNA, 1800 bp, Cryptosporidium hominis
atgaatagctacaaacacattttttgccatatacttcctttattattatttataattttggcaatacctttcaattcaaatgtgcccagtcatggcaaatccattcaatataaacattcttttgctaaaatccgagatgattacacaagattagacatagagagaggatctgacttggtcagaaagtctagagaggctttacaagtgtcaatatttacctactttatggcacaaaagaaacttgctgaaatgcggattttaggcgcccatcctaattcaaatgaatataggattgctgaggactattatagatatgctctgaatagcatgaaaatggctaaagatgactgggagaataaccttaaatctgctccaatctttacatatagaaaagatcatatcaccaactataaaactcgaggagctaataattacgatttaaattctttattcttattaacaggaagagattattccggagaaagaggaattgacttccaaattgatacatatgaagattcagaacctgtttatttaccaattccaactcagaagaagctgaataaagaaattatcaataatttaaatttaggtttcaaatttagtgatcttccattcaagctaacaaaatctattaatgatagagaaaataataaaaagcaaaatcgacttggaaataaaggccgtcaaatcaagaattcatacaagaatattccagcattggaaaatttaagttataataataaacttagtagtgaattttttagttttgaaaagttaattggtaataataaagatgatgacagcttacgtagtgttgataagtatattgatgatatttcacctacaaatcaatttagtactcctgatttcataaaatctaaagaatttttagacatcaaatcagcgaataatcaaaatttaatgagtaaaagcttaaaatcttatgaaatgccaattaaacaaaataaagatgagaaccttaagcgtcggagatcaagaggagttcttgatagagaaccagagattccaacagatgtgtccattcagattgaaaggaaattgggaggacctttgaaatttattgacttatctttgaaggatctcaacaaggatatagatcttaaaattatatttatgcaatatattaaatcaactcttagatgtattcagttatatgaatccaaatctgtatttgaggaactatttcactgctctaaaaatcaattggatttaagctttaaacttttacaaaaattggctgacctaaaaataaattataattatcacaaaaatgattctacttatataaagaaaaagtttaatattaattatgttgattggccagaaagcactgacaaaactgaagaaaatgaggaattctttaatcacttagttagttgtggaatttttcattcaaataccaccaatactacaaacacttcaaatacaaccaataataacattatagataaccgaattaaatatttcaatgataggccagatcctgaaatttattccgaagatatttctacatttgattacaaacctggttacttggacaggtttatggatagatatggatttactgaagatgaatacattgcaaacaaaagactaacaagagcagtaaatcaccttgcagctttagaagctgaatttattaaccgtacagagaataatgagagagttgaacataataaaatctatgattacaagatgcttactgattttattcctattgagattttaaattggagagctcgaagaccactatttaatgaaacagaaaaaaattga

SEQ ID NO: 2966 - DNA, 1374 bp, Cryptosporidium hominis
atgcatttaaaagagtttctattgagcttggatgatgtgagagcattggttgaaagaaagcttgaaagaaatagagagtttaagccaaaaatcagctttattaagcacttagcttcttattctgtaacaataccatcattaacaaaaataagcaatgaggctctaaagatagcaaagaaagacgggaatgagaaagcaatatatatggacactattatagtaccagcacttcctagatcattaaagacagaggataatttgagtagtttgcagtgtagattttcttactcccaaaagccatgctcaatttctccaacaacccattatgacttattgagcaatatttttggctacgaaaagtctcaggaggttaatatttttgcagatagattttgtttaagaagactaatagacttctcacttggttctttaagctcagaaaatgcagatattatggtttcaaccaagttgagaattgatgataatggggagctagaaagaatttctccgataaaaatgcttccaattaatataactgagggatttccaagtgtcggatttcagtttgagacttatttaacacgaagtgaaatagggttaggattaaatccagatgcaaccttaaagatggcagattcttgttttgttgtagatgaaatatcatttggagatttgagattaataagaaggtgtgagattgacgcagtaagtaaacgtcatgtatatggagattctaaagaaagaagtaaacaagaggaatataaaaatagtttgtgccataagagttgggagcaaaagatttatgatacggattcagagtttatggaaaggagaatgagccctccttgtagggtatttttatctgataattttaaatcttcaaaactgtcccctgaaaatagggttgaaattaaatctatttcatgtagaaatactcacaatttttcttgggtttcagtatattttcagatgctcattggctccactccacttttgatcagggggtgtcataatagaggattttttacacaaaggtctataacatcttttaatttagaccaggttaaagagttttcagaaaaggagttaactgcacgtaaaatacctaatttagatttctcagaatcaaattgggatacaattacatcagctattgcattttcagaggcgatacttacgtatatttccaatgatttattggaattgattggttcatatttatttaaggaaaatggctctggtgactattttgttaactttaccattaaaaagaaagaaaacaatataatttttcaaatattaaatccaaacgaaaatttaccaaatattgctggcccaattaattattggaatgattatctctctaacaaataa

SEQ ID NO: 2967 - DNA, 987 bp, Cryptosporidium hominis
atgaatattgaagataagtcaggaaataaacttaagaagaaaataaatattttatttgaaagattattttcaaatgatgggatttctcatatatatttgttactagtaatcattctgttggtaaatttgggaattggattatttttctgtggccgtaatttgaacaaacaaagtgagttaatttcaagttctatatttgatattaacattaattttccgaagggggataaggatacaaataataataactcagtttatgtgccaagagatgaaattttgaaccaaaataaacctcaagattccaaaagtacaactactacaactacaaccaaaaaggtttctactgttataactgctagtacaacaactacaacaactaaggttgatacgaaaaattacaatgttcaaagcccaacagataattctattccaacttgtctgtattcaagcaaatttcctataaaatatgatttaaatggtctattattttggaatgtttcttctgatacgtatatatattggggatatcagaacaaaacaagaactatatatattttgggaaacaataaacaaataaatagttcagtacaactaactgatgatatatcaagtaaatcagatcttgatcaacccaaattaatagagtttaaggagtcaaatattgttgatacaaaagtaaagacggggcagatggcaactagtaaggttattgcaattggtgaaagaattctgcctccatactggtatatgaattgggtagaacaaacctcaacaagatctaaagaaagattcaagccactttttcagccttgtcttggaagtttatatacttatagcaacaaaaatttgcaaggattctttcaggatcaaggtgtggtttatatgtgcggtttcaagagctatacagtagaaaaagatttgatagagttaaaaaatactccctttatcaaattaaaaacaaatattcaaggtaagtttacgaaataa

SEQ ID NO: 2968 - DNA, 191 bp, Cryptosporidium hominis
atgatcattaaatgtcaagaaaaacaaggaaattataaatatgtggtaacatactcttcaaatattagtagatctataaaagaagaagattgtgaagaaaatcatgattcttggctaatgtataaatctgggggatctttgttcacagttagtaaggaaggctcaggagactggcagatgcgtacagaaac

SEQ ID NO: 2969 - DNA, 3126 bp, Cryptosporidium hominis
atgacagtagctacctcaagcaggaggaattcgaggagatctagcttatcttcagaatctagcttgactaaccatacatcctcaacaaagccaaaaaactcttatattcaaaagaattcctcagtatcagggggtaatggcacatctcacaattgttatagccataaagggaggtctggaagtggttttggttccagttcttcgtatgaaaatagagcctatcttgtatcgggaggaggttcttgtattgggaataatactagtatgggtaatgctaatggaagtttattagcaccaaatgttcaattggataatttaccctcagagagagtggggaatggttccccaaattgggcattaagtgcagatgtttgcagcttaaaagattttaaggaactcatagaatgtaaaaatgagcatgcagagtctgttttaagaaagtattctggtattaaaagtgtgaatggtgggagaggaattagacaagttctagcttcaattgtacgtggatcgcgtacatcaaagaatcgaagttcatcagtagattcaggatcgtgtggggtggtatcctcttctacttcaacaacaacatcttctgcagcattggtttcaaatttgaatcgcaaaaatacaactggaggagatataaataatgcgagaataaagattgaagatagcattgatggaaatggtactattattaatgataataatggtagcagcactagcagtagagaatgtaatatattaacaggacaacccattcaaaaagcaattcttactcagagagatattatggaattaagaggaaaaatagataaagtattatcaacagaggatagttttgtaagatcagcattacaatcttttcaacaatttgattttgatggagatggaaacttaacaattgaagaattattggatctattaacaacattaggagaacatttggcattacctccaataaatagaaaagttgttgcaaatgaaataagtatacgtttgaattcaaaattaacagttgatagtagtgcatcagagagcaaaatgttgataagtttcccattctttctcaagtattacttaagtgtattaacaacaattagacaaaaacatttcagttctgtgaaaattaatggagaattacaacagaataaagcaatacgtaagcatttagtacatgaagatgatattaatgatttatatacatttcatgatcagttaggaacaggaacttatggagaagtatttcttgtaactgaaaattatacaagacaaagaagagtgtgtaaaattgtggataaagtcaaatgccgtaggaaattggatgaaattgatcacgaagttgaaattttaaagcaattagatcatcctggccttgtacatatttacgaagtttacgaggatagactaaatttatattttatattggaattttgtgctggagggaatttatttcactctctacaagatgcaattcaatcaggatttcgattttctgaatttcatgtttcacgaataattcaacaaatactcttggcaatacgttatttgcacttgaagagggtagtacacaagaatttgaagcctcagaatatactcttaactaactctttcgggagtggaaatacctcagttaagctcgttgattttggacttgctgagattttttcatcagatgaaataaatcttccagaactaactacttcaaatgtttctccttcacacttccattcaccatcaaaatccttacctctctcatcttcctcatcatcctcctatataacccaagatcatatcaaaacccataatcaagctcaacctcaagcacagattcaaggacatacacataatacctccttatcttctattcccaaccaaaatcgtgcatctgaagaggggtatttgtttgctagtgtggacgaagtcaccggcattcataagtccaactcaagccataattcaagtccaagttcaaactctagtttagctcaaaatcttcaccaagaagaatccttagcttcatatccaaagtacttggatttcacagctccagagttactcaagggagaaactttctcctatagtcttgacgtgtggtctgttggagttatcatgtattctgtcattactggacgccacccatttagtggtaggtcacgagctgaaactaggcacaatatctgctacggaattcccgccatttctgaaattacatgcgtctcaaatgcatgcaagtcattattaggaaagttacttgagaaaaatccaagagaaagaataacagtggatgaagctttaagtcatgattggttttctatttcgcattccagttactgcgaagttgatatagggatgcctcttttagcccacttgaaagtttatacaagacagtcagacttgagacatatattaattcatatgttatcccatcaattagcactagatacaactcaaattaatatggcaaccagtgtttttaaatctcttgatactgataatgatggagtattatcaatttcagagttaggatctggtttacaaaaattgggtatttcatccagagaatcgtctatgatcattaaagctatggatattgatggtaatggaattatatcatatagtgaatttatcacagcttgtcatatttggagacgaaatgaaattagacagttaaaatctttctttatgaaaattgatcgaaataatcagggaaaaattactagagaagaatttaaacagttacttaaggcacaaaaatctaaattgctctcaaatatcaccaaaagcttttcttctactaatgatgtcaattacagaacaattcttccttcatctaatcaaggtgtatatactgagtgggattctgttctagatgaaattgatactaatagagatggtcttatcgactggaaagaattctgtacttttattgttgattactttaatacttctagggaatctttgagggcatgttacaacaattcatctatatctaatatttcttctactttttctattgatcctccagccgttgcagggctctcaagaagaagagattctggtatttgccccattcaagaagctaaccagcaccctccccctcatccaagccaactagattaa

SEQ ID NO: 2970 - DNA, 12501 bp, Cryptosporidium hominis
atgcatgcagaatttgtggcaatagaggaaaaaaaaatgtggacgccttttaatgctctaagaagcaggaaggtgggatttttggtagtttttttattgaatataatattttttgatgtgaatataggtttatttaaaaatgaaggaattggtggagttggcttcgttgtagaagcttcagaatcttcatcttctcacagtatgggtcaattggatgcagagagaaggaaaaaacatccggatactggtaaattgcctagatatccggttcctggaatgaggtatgatgagttatctgaatctgatggaagttcaaataaagttactcatggaaagaagaaaaagaaatcaacaaaatcaaagaaaagggttgaagaaagatcgaagtctaacgagggggaagaagagaaggcctcaaagaggaaaaggagcaggtcaggtagtggtagtaagccaagaaaatcttcaagtgattccacttcttcagacagtaaagaggaaagttctatgcctagtggaagatccaaaaagtcaactcagacagatcaagctattggtattggaaatgattctttgaatcacaagagtacctatacagatgaaaaatttacaaagaaagaaaagagaaaaattgacaggttaaagttatcaatgagtgagtatagatcatatttgccaggaacagattcaatttggcaagacccaagtaatagaaagacttacaaacacttgaatcctcaatatggtgattatttcccaaaaatagcaaccaaaccatacagaaagagtaacgagtgttctgctctctttgattcagccaagaaagcttttgaaaataaagaaatcaagattcaccctgcggattttgtaggtctttctttaacttttgcagtgaaattaagagaagtacttggacaatatgtaacaatacaggagacttgcttaatgttaaggatgcttttgcatttatactcaggaatgaggaccagaacgcaatttttgaatattattgcagctgtactacagaatgatattttgttgggaagaatttcagatgattctggaattattaatgaagttatgtatatcttagatttcttccttcagcttccaaagcacagagctgatactaaatcgaaacaaatgtctgcaattgagatttcagattacttccatttggaggcttttcctaaggataattcatatgaatccaggattctacctttttacagaagaattgcagagaaattgatgcacgagattgaaaaaaggttaggaattgtaatagctagggatgaagtcatgtcaatggtatatataatgcttaactttattgaagaggaaagaagccaggaacagtgtacggaggttattgctgctgtcattggtgcaacctatacaaatcctttgactgcggatcagttgagggagatagcaaatatggccagagatatattgggttgcaaagcttcttctggtaaaacaatggatagaacacagattatggatatctttggtccagaaagaactgttatagaaatgcgtcagactgccttagttggaggtcccatgtctgatacagttcgtatttggaaagagatagggactttggattatttaggtcgtgtaatctctgtcagatttaatgattgtaatggaatcagggcttgggaaatgaataggatttgttcaatgttggaggttatgaacaaaaagctcatcaaaactggttcatcaagtgatatcattactcttgaagagctttgtggagctcttaaatacaaaaaaagacaccctggaacaaagtggcctttggctattaatactacattacagaaacgccaaaatagtcttccagtgaagattgataagctattttctcattttttagctcatgagaaaggaagactagcatctttggaaggctctaccaagacgagaatggaaaagttctatatgattccagaattccctaagccaagctttttggattctattattccaagttctccagctcaaggaattcccccagctgatcatttaaaacctgatttcttttatgcatttaattcaatgccaggttggattcaaaataggtttatttttgcttcagcctttatggaagaatttcttgttaaacatggtaattttgttcatatctccccagtaagactttataatgcattgggaggtagattggatgagaattcggatctttctttagttattcaaggattaggattaactcaagaacagtacaaagctttaccaaaagcattttgtggctatgagaagaagttgtttaatgaacataactcaagcttcggcccagttagtattgataattattttgaagctctttacgagtatcctttagcaagttatgtagaggggaggtacttaattgaggctgcagttaatgtattagatatcatgaatcaatatttagaaggtgcaaatgaaggtgtaatgaccgagatatttcctcaattggtaactcaagaaaggcttcaaagagtttatctcttccaaggattcatcaacagtagaatcaaggcttattcaaacgataacatcagtttcatcactactgaggaagcgaataggattttacaaggatgtgtggacagtaacaaagtttcatatgttaatgaaatgagaattaatttaaatcctgaatactttactgattctttgatagaaattctagctcaagaatggtcgaattatgaaggttttatattacctcaagttctggatttggactctgataggcagggagcattaagaagcatttattcaatggaaatgacctttgcagcattaactttggatggttgggagcttttgattgatccaacaatatatctaagaaatcttgccaatagagagagtttatttttgaattacttagcaaattctgtaaaggaaacaactgctagggaaaacaggtatagactaatctataattggatgcagcagtatttcatctataagcttagaaagattccaaagtttaattatgaggaagttagaaccttggttgaagctcttccaaatgaagcagatttgtctgaagatatgattaagcaaatcattcaagataatcaaaacctaaatctatcagatagtttagttgaagatttcacttttgccttaaaggcttatttaacctttgagaaatattttctctacacaagaaatccagatttggaaggtgggtttgctactgaaatagacttagtgaatggaaagatctttataccaagttgtgtttggacctttgttaaagacagggatgattattcaagttcagatataggggatcaaagcgtgatttactttgctgatttgaccttggcatacttaacaagactattccagactcagccacaaagccaagatttattcatcaaagtattagagtgggctaacaagcagaatttgaacgatgattccatcttcttcgattatttgctcagtatcgaagatttcaaagtctacattcaacataatacaaggcttagccacaattctcatatctttttggtaccttgggtagaccatctccctacaaattaccaatttaggaggctcagatctctcccttcgggtacatccccaggttttccatccgaaggtccaggacaggatcaagatggtgatcaggctcagcgatcacaaagagctgctcagatcttatccgagattgagagacttagcttggagcatagcgctctcttagatgagcttaacgcacaagttaacaaggaagacacggctttattagtagttgagaagattaggaacgatattcacaatttgcttttggaacttggtacgctttcctcaacattgctcagttcagcaatgatgattttgagcaagagaatgatcgccccgtcaataaacatttctgatgcacagaatatgtctaacttaggcgtacatattggagaaaatggagagattatctttgatgaagagcttgctgagaagggtctttctggtatttttatcccagctttggtgcttgggaatatcaacccagaaactggcatcttagaaccacctcctcctgaattcgacccagagttaatctgctctactcagaatattaacagaatgcaggctttcagaatctggctttcctcagtcttaccaagaatgcctttccattgtagtgatcccttacttgctagggatcttctaagcgtgaggaatcttttaccagcctttgtcaattttggcttctcaaaagacagtaatatacttgcaaattctttggtaagattcacgtcttcacatcctttccctatgactttgagttccttgaacattattgtaaagtactttatagtggatgaggagaacgtgttcctggctttggatcgtcctgctactagcttagaagaagcatatcaggatttgcggatgattgcaggattctataagaagaaaacaactctgcctttattagaaattcccacaatcttttcctttactcccaacttggaacttttggggagtaccaataccaattcaaatgattttggaaatcactctcaatcaaacgctagagtcaacttcttggattatttggagaggatcacagctgagtactttgcctcttcacctagaagaatgccaaccattgcaattccaagattaactaacttggcaatgaacttctcgaatgatcttgaaaagttagttttcttgattacatcaatatttggtcccatgaacccttacatttctgctccttctattggagcttctgcaaactctctcgcagaattctacatgatgaatttaccattctcagatactatggattctctttatattgaaaataaattcaaaaacactcatcttgagcttggttctcctattaataagatttcacttccttctgttcaatctgatgatcagttattggatttcaagcatactttcctttcagctcatttcttctccagtgatgaagcttactttaattcattcttggctatgagtgatcttattaatttggctctcagttatactacctccaagactggtatctctgcagatttgaatagtgaaactttcaaacaaatttcattttctttcataagtggacaaaatcttcttgagattgctagaacaagcattgatctttctggtcaaaatttggaacatttagtagagaatatcttctattcaatttttgccaaatccttgagcttcttaatatctcagtttacaccttatgttgagagttcagataacagaattgtggctgaagagattcttcagagtgctatttcagatatttacactaaagggttttatccagaaaatgtaagatatgagttagtaaacaggatcactctctttattgattttgactccgataagtatcagtttatgtttgctgatttggaagattctttaaattctactcaactgaatttcccaaagaagctctccactcatccacaaaaactcaatcaaaggttcttaactcaaacatcggaagtagctcttgtttctggacaaagtcatgttaccagaactcctatttgcaattatgctctggttttctcttacttcattacaaaagtccttgaaaagcctcagaacaaggataagattggaggaattgatcctcttgacttttctaatgtgagaatatggtcaggtttttgcggacttaagaactttgaatatttatcttacagatcagtccttatttcagttattaagaatctttcaatgaagatattgggtcccttggatgctaatgaaatcaatcaacttgttattttgattgatttctttgatcaaaatgtcaggaaaatcgttctcaagtacaatccagacttgcctcaaaactgctcaaatgaaaccttattctcaaatttagatgcttgtttgggagctatgagtagatatatgggagagaatgacatcattttggatgatttacaattaagtaactccagtgttttgcaattcacagatgagttatcaagtaatcacttttctttattatctagtcaagaagagtcaatggcaagagtaatgtttagatcagtattagagagtgtcttcttttcaaactcttttagtgagctggaagatgtccctggtattaatagacaaatatctttcgatttcttctcaagagctcctttaaacagtgaattaaagccagaaagtattgtattagagagttttgatgatctttacagaaagctacccttcaatttcaagccaataaagctcaaatctggtagtaagaatcaatcttcgattgccatttcttacttagatgttgaaggaattcaacaaggtgagagatacgaactcaaggattcttttttaaatgataagaagatcatttgcgtgaatagagccgtgtttttcctgcattggtggcttattacttggccaaagataccattctacgccaacgacttcgtattagcagaattactttcgaatattcagattctagctcaagcatttcaaacttcatgtatgatgacttccccagatgtcattttcagctccatatcaaaacaaatttctggaatttctggggtctccttaaagaaaagacatatttatctaatgattgattcatttttaaattttgaaaacaaagctttaaagttctcaggagctaaggatttggaatcagcatattcaaatgatactggtatgctcaattctatattttcaatcgatcttaaagtccctgagattccaatacctaaaggaaatttggtgacttctgtcagaccagaaaataagaacctctctcaatacttattcagaatcatctcagagtattttgcagcaaatcctcgtaattatccaacaattattattccaaacacatcatttatagcaaaacattttgatttaaataagaactccctagcctacgtcttgtacatttggagtgagtttgaagatggtaattcaattcgaatctttttccaagctccaacaattggtgctagttatgaagatttggcggacttcattattgagaattttgagttgaacttcctcaactttagttcttccaatagttatttacaattctttactgatccaatcttctcaactttcttcaagtttggaagtccacttttcagagtaaaaaatattccactaagattcagttgttcaagaatggaagacagttgcaatccattcataccaaaactcggtctttcagaagctgaagaggaacttcttgaggaaaatatcaaactaattgtctctagaagcttcgttattgcttctcaaaagatgtcattatctccaacttctgaaattattacatcattctccacttcagatgtatcagaagctataatacttggtatcaatgttttggatgctgtcagagttcatggatttggtactattaaactcaaagagaatctcgtaattatcaacaaattctctcttttgttttccaagatcttctcaaggttcatctcacgcctcttggagtcattccacattcctaactttaataaacctgcattggatctcagatttacccagctaaagacactttcagcaagaacttataatgtattttctcaatttacctctgatctcatttctctaacactatttagtaatgaagatctcaacagtcttttgaaagtaatcagccttgatgatctaattcctcctgaaaaatatcaagccttttatgcagtttctacttcagattcttccagaggaatgatgacagtttatacaaaaagtactggaattccattacatattcaaatcaccaggttcaattacgtctattgctttatccattacttattacacattctttctaggattggaatgagccatttctttatctccttcaagcatcataacctccttaactttgaaaatgtggttcgagctacagctatatccattcatgaaggaataccagaatcagtttttacattgatttctcataaagacaagttttcacttggaaagttcactattgatgatattagacgaatatacatacaatataagagccatacaaacaatttcttcagtggtggttctatacaattggcatttgcctcctctgagaatttgactcctttcattcaatcattgtttgctgctactaactatgaccaaaacaatgattcagttcctttgatatttttgaatgaatttgaagacaaagagttcttacatttttctcctaagtcacagtcactttcttcctccatcacaactgaggaaattcttaacaatagtttccatctaaataatgccttccacagctttaaagaaacatcctttattactggaagctttgtaaagccttgggtacctttcgtgatgggattaagcactgaaaagcattcatctgtatattctgaagtttcaaatgatcatcttgttagatttgatcctggacatgttcaactcaggaagaaaattaagcaagtatataatttgaatcagaatcttgatctagacagtaattacaatcctttaatagatcttggccaagcaacttttgaatctggagtcatttctttacagaatgaccagaattctccagatgaaaatcaattcagaaataattacaatggtttaagattacatgtattaaatcgagcagtattattcagagaatggcttattcgaatttgggacatttcaccagctatcggtagagatccactctttgttgagtttttgaatgattttaagtccattattggaatctttgatggagcagagattggacaaggaacttctttacgtatagatttacaaactcaattaatacataaaacaggaagattccttcctaagttattatcccctataattgctgcatataatgaatttgaagaaaggatggtggaagagagtggtggttctgatatctccaagatcttggaatctgggattgctggtcttttccttcttagtttgccaattaatgatccattccaaagaaaaagatgccaaatcaaaaataaggcttggggtgaagggtctgattcatatagacgttcccaaattcatgattttgtgactcaaaagcttactgaatatctttcagcagctccaagatcagctttcactattgatattccagatgtgagtataatactggacaatttctcgattgaattaccacacaaaactaaatgtgctatagaattctgggcaagagatcgtcctgaccttatttcagctccttctttaggacttgatccagattccatcttttcattcctcagctctttcctaactactaaagaattagatcaagataacttggaggttccaatcgaaagatacatgctatcttatggtcttttaaatgaatatcctattcaggatgcagacagctactatggtgatttaatatttggctttagggagcatgataacctatatgaaactcttgttgcttccatgttaagcgattcggttactattgatgcagcagttaatttcttcaggatcattgcagctaatgttttggatacttacgacttcaatcatttcgttagcgaagatattgaagacgaacaagaatatgaaaatggtgactcttatatagattattctttaggcctggattatagaacattttctatgcgttttcttttgggagtttctgaatcattttcagctaggaaactctttgagccaatacaaattttaaagtcagctaaagatctcaacaagatttcttctgatttcctacgaaagatctcagttctcaagttatgtgtttacgttactaattctgatttcctattctatgagtattactcagctgagatgattttatctttccaaagatctggattaaaacttacagaaacagacatgtttagtctccttttgaatcatatcttaattaactctgccagagaattcatctcaaagccacaattaatcatagattgcttctcagactttaagtttaaacaaaggccaagctatttctcaacagtcccagagtttggacatgtatcccaaaatactggtttaattacttcatcattcaagaatcttggatttacaggcctacaagagtcttttgttcctcatgttaacttattggtctattaccttaaatctcttaactccatagtaaaccatccgggaaacagaataatcctttcaattccagcttctattaactttatgagtaccagtatactactaaaagcttccagttgtagtcaagtaactgatcaaggatttttatgcattgctcagataatattgaactctctcatggaaatgggatcagatgttgggaatctaacggtagatgctcttgcagaaatcctaaattcactatttaatatagttggagaagtttctcattcatcttatcccaagttagattcacaaattagagatattgatccaatcaagaatagaaaataccaaaaaagcatctattacaattataatcataatctcctttctctactatttggaaatatagaaagtcttgagagaattattaatagcaagtttgagagtggattcttggatattagaacactttctaaatcccttaaagattcctataatacagatcctctaattaatgctcagctttcaattgttcaaagcagttattacaggaagaaggatccatataaatctatagctgtattaaaaataattcctacattcaatgttgattcatcaaagaaaagagaacctttgacattaaataaattcctggctcaaatgaatcttttagaggttctggactttactattggtatatttcccactgttttgttgatatccaaattagatggtgatatggtagtaagtaatgatggaagttttccagatactaatattaaaattgcaaacagagctgcaacattccactcttttattcacataacaacttatcaatattcagacaatgtatcttcctttgctattcttccaaataatggtggaaggaataacagagcaggaatttccttggaggactgcattaacttcttttctgcttacagtggcatggatattttagaatcaacacccaagatttctaaatactttaagaacattgaattctacaaagcttatctattattagattctttctatgctatagagaaggagctctttggattcgatgctattaaagaaactgctgaggatggttactttaatgctgaaagggtgataagaataattgacaacttcattcctttaagattaaatctggagattcctaaatttgaaggagaggaagccaaacatctaggaagaataatcttttaccttggattaaggttcattaagaatgaaaaagtgagagctgaacttacattggggaaatgcatctcaattgcaagaagtttctggccatctgaatctgattataattataccacatcaaaacactcaaatactgggtattatgcattactttcaatcttcgagaatctctccagcattagaaaattcccaatacttgctcaggaatttctattaatgctaaattggtacatctacaatgccatgggttcggatcccatcataagggatttttcgaatccattacaaattttcagaaagagagtagaattccttaggaaagcattttcgaagccatttgtttgcagtgagaaagatcttccatggcttaagccaggtttagaatattcaggagtttctttccaacaattcaattttattatgtatattgcaacagcttggagaacttatttagagttacagattaataaagggccaataaatattgatagtgatgaatggtcagaaattctcaagagtgtaagacctggattaatttcaatgttggattctttatcacatggtgtttctctaagatcacttttttctatatcaatttttaactttttaacttataacttaattggtgaacagtacccagatatatacaaagatggcgaaatgttgaaacatattgaagcatttttggatcagatccaaagattcgcaagaatcagacaccctggtataataaacgtttctttcctttggccagcagttgattgtgaaccttcaacaacaaattctaaatcaacatcaagtgccggtagtggtaagatggtagtgcctggtctcacattccctctagctttgaatagtattggtagcagcgataatttgagcagaaggcaactctccaaatcaacaaccaaggaaatctttattgattcctttggagaatttttccaagaaaaggaaatcccttctggcttggaggactataatactgaggctggaacagttactactgatactgaaacaatcactactgacacatacagtgatactgacattgacactgatagtactgatatttactcaagagattctacggatactgataatagggtacaagaggaaattagaagaggatttaaattggaagatttaccatatgataacataagtagctaa

SEQ ID NO: 2971 - DNA, 567 bp, Cryptosporidium hominis
atgagattctatttattctttttcgctcttttagtctatttcgttgctaccaatgcagtaagaattagaggtggcgatcaaaacaaacttgaatctgaaaaccctgaagaaaccactactaccactacaaccacacctcagccagactctacttctgacgaagataccactaccagtactagtactactactactactactaccaccaccaccactactagcaccaccactactactaaagctccagaatctggcgaaaccaaagatactgaagagactaacgaaaacgctgaagaaactgctactgcatctccaaagcctaaatctccaacatataaggaaaaactcctctcattcttcagtggtaatggtggcggtatgttcggtttcggaaagagcagcaccactactactactactactactattgcccctgtttcctctgaggataagacagaagacgattctgaagacgaaaaagacccagattctgaagagcagaatgattcctcaaacgaaggtccttcaggttctgagaattctgaggagaccaagaaaactgaataa

SEQ ID NO: 2972 - DNA, 1761 bp, Cryptosporidium hominis
atgctgagatttttcttgaattttgtaattacattcttgtcattaagctttattattaatcaagcttattgcattagagttgaaccaagagtgactagccttttaaataattcaataaatgaaaacatcagtgagagtcaatcttgtgtgttacaaacattgaaagagttagtatcatctaatggaagaactccacccaaaattactaaaaaaagaattcaacaagctgtacttacttgcaggaagaaattagctacatgtgaatatccaaccatagcagaagaagcaatatttataactttgggccaatatggacatctatctcaaatagatacagttaaagctttaagttttataaatgaaattcaaaaaggaataacaagtactgtcggatcttatacacgtatgtataggttaagtcaaaataataatttctgtaagctatatgatgactttatcttatcggcttatccaaaagagtattacgtttcatttcttccagaagacggagaaagatgtcaggaattacttaatagattgaaacaaaattcattctattcgtattggggacaaggaggaattgtagcagaccaagctcaaccaattgttgatgataaagtttcaaatgatccaattagaaccaaggatatggttataaataatatttttgaaaatcctccaaacaaagaaactcaaatagaggaattttctaaacctgaaagtgaaaccaataataaaactgactataataatgaaaatgaatatgaaaatgttattcataccaaacaagaaattgataattttgaacaagaaattgataattttgaacaagaaattgtggaagattccggatgttgttcttgctgttcttgttcatctaaaaggaaaaaaaccaagaaaggagagaatagtcaacctccaaaattggttgacagttctatgactgaggaagagttagagttgattcgacttgaacaagaacttgagaaggagaattccggttgttgttcttgttctagttccaataaaaaaaagaaagaaaagaaacaagttaatgggaatgaaatgtcaaacgatattctcaaatatggaaatattaataatgaattgaaaatggacgaagataagaaaaatgaagaagacaattcttgttgtgcctcttgtagctcgaagaaggagaaaaaaagcaaaacaaaaaataaagaaaaggaagtacagaatgatgagacacaaagaatggatgaacaaactcccaaaacactcgttgacacttctatgactgaggaagagttagaattgattcgacttgaacaagaacttgaaaaggagaattctggttgctgttcttgttccagttccaataaaaaaaaaagtaaaaatgagaaaaaagataaaaaacagaaaaagggtaaagatgaaaagaacaaaaaggaagaaaagttagatcaacttctagaagagcaacaggagggtgaggaaccagttgaggaaaacaaaaaaagcaaaaaagataaaaaagccaaaaaagataaaaaggataaaaaaagcaaaaagagtaagaaagacgaaaatggagtcctagtcaattctttgcctgaagataaaatggaaggtaagaaatcaagttgttgttcaagctcttgtagcagtagcagtgagaaaggatctgataaagagttaaaggagttagctgagttagagaagaaacttcaagaggaagaagaaatgctcctccaaaaaaaaaacgggttaaaaacgtga

SEQ ID NO: 2973 - DNA, 894 bp, Cryptosporidium hominis
atgaagaatgattcaaaaccagtaatatgtaatttctcattagaaaagattattatacaaccttatggaaataatgaaattcttaagatacttggtgaattgaataaattcactttatataatacaagtggagcaaagtttatgaaaattacacaagtattatcagatttctgttctagtgaaaagttaaagaacaaatctgacatacaaagtctaattaaagatttggttataccatcattggatccattatccactttaaataatgctgtggatactctttctaagattaaatacaattcttcaattgaagttagacgttctaattggtttcttaaacatgtttgttcttttatttctcaaaaacttaatgagattaataagtcaaatatttcaaatgaagctcttcctacccttattcaaagcttaaactttataatccaattgaaaaataagatattcttgaattctgaattctcaaaatgtattaatattgattctaataataattctaatattgagttcaacaataattgcactgttggtgaatatatttcaatttcggaaatgatttcatcagagttattagatttatttatcaaggaaagaaatatatttaagaatttaacttcagtcaatcttgctcaagagctaatatcttacacaaatgatcacctccaaattcctcctccatctcaagatccaccttttggaggcttaggacatctttataaaaaagattataatgaaagttatacagggtcagaaaaccctaatacaaactcaactattttatataatagaaacaaaactattgcatttgatgtaaaatggccaattatagccaatatttcagatttaataagttctgaaaagaatcttacaaagttttag

SEQ ID NO: 2974 - DNA, 1215 bp, Cryptosporidium hominis
atggatggtcattgtaggcctaaagaaaattggattgaacctttagttaatagacttaaagaaaaaccaaaagctatagtttgtccaatgattgaagatatagatagatatacttggaaagatataggcacttttggattaaaaatgatgtttgattggaattttgaatttaattggtatgaagattttactgatgtaattccaatagcatcaggaggattatatgcaataacaagagaatggtgggaagaatctggtaaatatgatccaggaatgttagaatggggaggagagaatattgaacaatcaataagagtttggagatgtggaggagaaatagtagcagaaaagaaaagtagagtaggacatatatttaaaagagatccaaaacctaatccagagaataaattagttttacaagtacaaagaaatcaaaaaagagctgcaatggtttggttagataagaaaagatataaatactttgaaacaattcatgatgttgtgaaaagtttgaatgaaactcagagtggtgtagatttggaacaaagacataagattaaagaaagattaaaatgtaaaccattttcttggtatgttgataaatttagagcttcatttgatagaggtggtttgctattggataactttagacattttaaacatagaaagagtggactttgtttaacagcttctttaaatgaagtagttactggaacagaagataaggcaatagtatttaaagaatgtaatgaaaaagatgatactcagaagtggaacgtaatattaggaaggagattaatattgaatagaagagtaggattaggatgtctcacaaggggaccaagtaatgtagtggaaaattcaattttaagagtagttccttgtaaatttaaggaaactttagaaggttataatgactcacaatattggaacatagatgctaatgatgatttattatttgatcatggttatgaagatttatctccaatggaatcttcaaagcttagaaactcactaagattgtttaacagaattaatagtattccatttagccatgatgggaatgatagaatttctgtgaatggagaatatgcttttgatccatcaaatagatgtgtcacaaatttgaatgataaagctgtaatgaagagttgtccacatgaagaaaatgaggactatatatttgacccaataaagatggggaagtttatgtag

SEQ ID NO: 2975 - DNA, 378 bp, Cryptosporidium hominis
atgcaaattaaacaaagagaattgtctaatagagtaattttagctaatcttaatttaatatctaaaattctattgtctcacggcttttatcactcctatattcatttcctttccttttcccctcctgcttttgtcttcctctcgttctctcgtcttctcgttctcttgtactcctctcctcccactcctctcctcccactcctctcgttctctcgtcctcttctcctagtccctttctctcttcctcttctcctagtccctttctctcttcctctcattctcttgtcctctattttcccactcctctcctcccagtcctctcctctcttactcccagtcctaccaaaccactcctcttctcccatctcccctacataa

SEQ ID NO: 2976 - DNA, 1563 bp, Cryptosporidium hominis
atgtttaggattttactaatattatacattttgttagttattcttcaaaaactttctttttctattctttctcattcttttaatgaaaattatactaataaagaaaaaggtaatgaaatacctaaatcaaatcatcctcgaaatattgtagaaagtcatgaagatttttcttctttggaaaatattttagaaatgagtcgactttcaagaaaaaatttttatattaaaggaaatactataggaacaggaagatattcaaatgttttttttgcatggaaaattgatttaagtccagaaacaaaaaataagattggagaagaaacacttgttattgatcctaattttcttaatttaacagatcatcaaattagttctcttagaggttttcctgttgctttaaaagaattaaagaatgtacaagaatggaaaattattcgagaagtttctatacttaaattacttaatggttattctgatcatcatgttaatcaaacattatcattagaaaactcacaattatatgatcaaatacaagggaaaaattcgattgtaaaacttttagatattgttaaatatcataatccaataaaaaatttgaatcaaaaatctattagtcttaaaaaacatattggacttgttatggaatatattaataatgaacaattttattcacttcttccaaaacttacatatatagatcttcaaaattacatgagacaattattacaaggactttcttatgcaaattctttaggagtatttcatagagatattaaaccacaaaatattgtaattgatataaataaagaatctttaaaaattattgattggggattagcagaatattattcaaaagatgatcctgattttagtccaagagttgcttccaaatattataaagcaccagaacttcttttaggaataagaaattatgatttttctgtggattcttggtcagtaggttgtttattttcacaaatgcttttcagattaggtactttaaagaccaattattttactagagtatttacaaaatatccaaaaacatttgttggtatttttcttaagaattcattaagtcctgatgtactttttccaggttgggataataatgaccaaattgttaaaattgcttcattacttggaggagataatattatttctatatctaataaatataatggaacaatttctgatgatattactttttcttatcttaaaagaaccaaaaaaatctttaattcaacaagtccaatttttactgatccaagaacttttgatttcttaattactcaagaaaatcaagatttagttactgttcaagctcttgatttactttcaaaacttcttactttggattacaaatttagaatacatccaaaagatgctttaaaacatcctttctttactattcatccaagtaaacattcatggattgtttcaaaatcttcaagttattattcaaaatcatcttccatgatttcacctaaaactaaaaataattgtggaaataaagacttttgtccttttatgtcattttttccaataacttatgcaaattaa

SEQ ID NO: 2977 - DNA, 2451 bp, Cryptosporidium hominis
atgtctttgaaaagagagaataaagatttggggggtgaaagtaagaaagatgactatgaaacaataggagaagatgggaaaggggtagaaaaagctgagaagactttagaagaagaggagaaagtagtgggacaagttctagaagaagagggaaaaactgtagaagaaaacaggaaggttttagaagaaaacgggaagactatagaagaagagaggaaaactatagaaaaagccgcgaaaggacaagaaaaaagttatgtagaaaatgacaaatcttctttggaatctttcgaatttttagttcctgaaagaaaaaaagaaaagagccaagaagaaaagagaggaagaatgagagaactatttaaagtggggaatttgattgaagtggtctataatcaagaggaagaggggaataaaggtatttgcaatagtaatagtattagcagtaatgaacagagattggtagttttttcaatctcaaatatacttggaatgggagcttatgggattgtggtattagcagatatatgtagtccaagaaaaaagaaaagtagaaattccatcacagttgagataactgactcagatataaaggagatactggagaaactggagcctagagcatctatatctttagctaaaacaaaaacaaaagcaacaggatgggctgggagaggaggaggaggaggaggaaagaagttagctataaagattgtggatttagaagcaaatgacacagcagaattggaggacccactagctacagctagaaaggaaacaagtataatgtcagaattacaagattgcgaacaaattctgaaatattatgtgactttttcctcaaattcttttttatacatattaatggaatatgcagaaggggggtcactttatggtttgtatagtaaatatgggagttttccagaagagttgcttgcttcagttactcaggacgtattaaaggcattaataagaattcatggacaaaaagatggaaatcattccaattctcaaaactatattcttcataatgatataaagagtgctaatatcttactaactgaaaattgtgtagcaaaattggcagactttggagtttctaggaaaattaagtctgaaataaaaagtaatcgtcaggaagattctgaatcaatcactaaagttaacgatattatgtatcctttttctaatgatcaagaaatactaggaagtcctttttggatggctcctgagattattttggggactggaactggaattagaactaaagctggccctggaattggaactggagaaccaggagcttctgatatttggtctcttggaataaccgtattagaactagcttttgggaggatcccttggccaaattttgattctttagaggaattgttggaatatattttaagatctcctcctcctcaaaagactgtgagggaagaaattaaaggtttgttttcacaagaattctgggattttatcgactcttgtttgacaaaagatccaaatcaaagaaaaaatgcaaattttcttttaaaacatccctttattttacttaaagctaagagacctaattccttaggaacatttatacaaacgatctctggtgttcaacaaaattataacaattctaaatattatatacaaagtatatttaattatgttaatcattttttcagtcatgaagataaagccaaagttcctactaagtttcaatctttgtcaaatcaaaatctaatcaagaaaatcagtactagtgtttccattagtagatattttagtagaaaaagaagtactattactattcaaaatattccaattccttccaataagtcctccaagacctatcttaaagactcggaaaataaccaaaaagtcattaataaccattataatcaatcacaaaactccaaatcttccaattctctcttctcatctacattttataaatcagaacaagaacaagagcaaaaacaaaaacattacaacgatgagtcttccctcatgaataaaaaggtttctgtgggaaaaatgcacaaatgcttagagtcctcattaattgaattcaatcaacttgatctcaaagactcctcttctaatttttctccaaactcctccccttcctctaatgaactagccttaaattctaaatttaagttgtctatctcagaaaaacaagattccagaaaatctaataccaaaccttttggcgccaaaaaccaatctagagaaaaaattatcaactggtctaaaactaaaggtaaaaaaaataaactagtaaaagagaaagttcaaataaactataaaaaaacttctcaaaagaaaaattctcaaaataccataaataatcacacagaaactgctcttttatcttcaaatagaaaagagaaaaccaaattaaaaactcaaaaattctttttttcttcttgttgtagcaaaaatgcaatttaa

SEQ ID NO: 2978 - DNA, 3249 bp, Cryptosporidium hominis
atgaagttgatattcactattagcaccgcattggcatttgtgggagcatgccttgcagagaactttgatcaattctatatgccaacccaggttgttccggggttgcatccacaacattcagcaactttaactgaagcagttacgaatatgtatatgtcaggtccatggatgagtccattagaacataaaaagtgggtgaaaagtttaaaagaatatagacttcctattggttatattccaattgctagaagataccaaagacttaaagaaagtgctgttcttgaaagagctagacaatgggctgaaattgcagcttggagattccaatctgatccaaaatattctaacagtccattcaagtatactgttaaggattttgaaactatgttccaaaagttctctacttttggatggagtcaggaggcttgtgaacaggttcttttggatatgggaattcactctgaaaatactgagacctggtgctcaaatatagaaccatggggccatgatgaatgtgctgacttgacatggccagattttgttcttgttgatgatattgaaaacaggttcagaggaaagcttgaacaacaatcaatctgtagattggttcaacttgttagaccttcccagcttcctaatgtcaaatatcgaactgtttatgatgtttgtcaacaaaatatcttagctttgagagatccacttactgttgaaacagttactcaagaggatgctgaaaccatatgtaagatgatggactttactatgactccagaatgtaaaagagttcctccaagacatattcaaaaggctcaagaattgtctgttgcctttggtgaagctatatttccaagattacttgatttcagagttagtgatgcttgtaaggttgtatctgcaatgaaagatgaagaaagtcaaactcttgagttctgtagaaatgaaatgatttctttattatggaacagagctgctaatatgggagatactgtttctccatggggatgggatattatctctcaatttgttgaagcttgtcaagaggtatacaagaaacattccaagagacaaaaggaattagaagaaaaggctgttattttaactggtggcttcttcaatcctactcaaacatatactaccagatggtggaaggcttctcctattggtcaaaagttggctgttctcttaagcagtgagccagctttaagccaatctttacaagaaggaattatctcacctactcagcttatgtgggcttataacatctatgatgagtatagggctatgggattcaatgtttactctctaattgaagttgttaatatggttagagaatttaacattaatgaaccacaaattacttgtgagtctatccttaactcatatttgggaaagtttgagaataacgatgaaaatgctcccagagaacaattcactggagctgaggttagaaagatgtgttctgcaatggagaaacaatctgttgagatctgcagaagattcttagtttctccattgattggtattgctagagatgttagatcttacttcttaaaggaattaagaggaaatacattgatgcagcttgaagatgtttgtctattagttgcagcaataaatgttccaaagattagtccatcaaaaggatctgttcaaagaagatgttctcatgcaatgaatcgatttgtattgaaaaatgttaatttgacttttgctcaaagatatggtttaactgcaacacaacaagaagagatatgtattagaatggacttctggggatctgaatcatgtgataaattacctatgactagaagaccaattattcatcctttcactagaaagatttatgatctttcaaagaggtatggtattcttgaatatagatttgatgaaatctgtaaagcttttgaattgatgggagataatccacccagagagaaatgtgaatttgtaatgatttcagaattctttggaagatggttagatactagtaattcacttttccaattgtctcatcatgcctgttcttcattctttgagagaagaacttcaggtaaagagcttaatgagatcaagaaagctcttaatagtattaaagactttatggatggtaaaggcgaatatcaactcccatctgcagaaaagacttatcaacaatttatggatgataagattaaagcaaccaagacaaagactagaaaatatgatgttatgccaagcttaacagaaggaagtcaagtagaatcattgccaggagttcttaagacattggaatctattgaagcatcaaattctccaggaattgatgatgttagaggaaagtattattcagctttgacaaaagtacaattagagatgttgaatcgtattgtgtctcataagccaacaaaggatgagaagagaacaacagttgaagcatttgctagggttatttacaaattgaatcaatttactgtattggagagctgtactggtcaattagttgatgatcttggatattcaattgaatcagcaaaatcaatttgtgctttaatagatccattacaaagtgaaagttgtttatcagctcaaagaattgattttattactgctaaacaattacatcaaaaacttgcatcaaaaacaggattctcccaattcatcaatttgtctcatctttgtgatgtagttaactatgtaaatattctcaagtatgcaaacaaagtaaaacaaggaagaatgagaattgctactccatcttgtagaaatgcagtaaagacaatacttttcccaaaatacttatcagctcaaagtaaccagatgttatctcagatttgttcaatattggatattacttcagatcaaaacttcaatggaggagttcttaagactaatttggagagatactatgcattcaaattagctgactcatatggccatagacttgatcttttaccaaagaagagaactcatccaattacttggcaattaataatgggagtcgtgagaagaattaagccaacaggacaaggtaaggtaacaagatctcaatgtactagtgcaatgcaagcagtttttggtaaattcagacaattcagtccagtagaatcaacagaaggttgttgtcttgcttttggatgtcctgattttgttgttaatggggatttcctttctccaccagcttcaaatgaagcttctgctcagcaggatacatcagtttttgcaactacaggacgtgctttagagtctccaactcaagatctttcccaataa

SEQ ID NO: 2979 - DNA, 1209 bp, Cryptosporidium hominis
atgcagccaattggagcatttgggatggttccccaattaataaatccaccggtgatgatggtacctggaagaagctctgggaaaggtacgaatggaaattgttgtggtggaagtaattctaaaaggaaaggttcttgtggttcatgtggaagatgttttggatcactatttattattctatttgcttttatatgtacctcttgttgctatgcttatccaatttataactcctttactaacccagaatactttaagaaacaggagacaccaatttggacatgggaaacggcttttagtaaagcaaaagaaattggctactctatgtcattaaccaaatctccagaagatggaaatggaacttctgaaaatgcagcaagaagtagagaaatggatagagttcagttccttaaattgaattctacggatgataataacagaaatgctagtacatttattaacttggaaaatattttaagtcagaattcttccaaaatattcttccctccatacaataacacttacatttccagtcttctatattctagcccagaaaggaagctaagcataagaggaggaggaggaggattgaacctcgcaaaagacttagctattggaataaagaccaaacaaatacccaataaatacttcaacaaggagtactgtgatagagaaagagaagaaaaatcggagggagtttggaatgagttttgcaactataagcataatgtaactaacttagaatgtattgatatgatgaacgggccagcaatatgtgttggaattagaaatcgtaaatatgaagttttttcagtttcaaagcaatgcaaattcattgaccccgaaattcctgttgaaatctttccaacaatatcagacatttgctatagtggaaaatacttgaatagttcattggctacatttaatattactaagccaatatgtccttgcatgattagttcaagtccagttgataatttagaattaaatgaaaatacaacaatagcaacaacattaactggcaatcaaaaaacaagagactttattctacaagacaaagccaacccagaaactcagaaaatgctcagagggcctgaaggaatttcagacagctcttccaattctggtttaattcattttaccgcccaaactcttaatcatactattccagggaacaatacaaactctacactaaaaatgctcaattcttag

SEQ ID NO: 2980 - DNA, 3039 bp, Cryptosporidium hominis
atgatgaccacgaggtacagttttcttcatgctcttatttgcatttggttattatttcggattattttggaaccggttaatggcaaaaatgactcaaagttcaagtttggaccgcagcatcctcctcatgatagagcagttatcactgactttgataactatgcgattcaatattgtggtctaaaggactcagtctttaacgtagctcattgtattttccatgcatttattgaaatacttgaagaaagggagctcaaatatgaggattatgagagtgttattgattttttattacaaggaaagaatctagcatctcaccagaagttaatctcttctacaaataattgtcaaagtatggttgccccatatattaaattttctaagcctaaatcttcaaaatctattatgggagttagaatttctacaaagattgaggattattgtaaatttgcctttagatgtattagtaatgggtcaaatacacttattaaaagcaaacagtctgttatgcaagaacaccttggaaaatggatgggtatttctttgaaggaaaatgagggttttggcatagttatagcttctagacttgattttcagatttctcagcttaaagtccgttcaaaagaaccaaatgaacttttaaagattggatgcaaacttgcatcagagtctccatcaaagagagagtttctttgtatggagatctttaacaacaaagagatttgttctattgttgccccttataaattatcatttaaaggttggtctcatcctcctatagatcctattcaaaataagcctttcaagtttaatcctaagactatgattgatgagaaaattaggggtattgtgaatattcaagttaatgaagagcttcctccttactgtatgcctcaagagattttttcttataaacctcctccagaaacctatactaaagaaaagaggataattcacttttatactgatctaagccaaactgaaaaagccatcatcgaccaatttctaatgcattttgtgattaattatggcaaaatcccaagagttatttttgatagaagatccagatatgcaattgaaggatggctttcacataaaaataaatctccaatcatctcagtacataactctatgtattctctaggaagaaagctccattacaaggatgcaatgagtggaatgttatattcgaattcaggatctaaaaaggaagcttatccttacaatcttcctcaatttaaagtattttctgtatattctgataaaacacatacttttgatattagtgacactaatccactgatctccacttgtttaaaagaaggatgtgcctattttataggaagaagtgctgcaatgactccagttctagtcgtcagagcctcgacaataatatcaataaagagctttaaacagtcctcggcatctttccttgtcatgtttttaatggaatttgcggaaaagtatttgttttttccaggaaaagttgaaactattgacattattgttgactgtagaggtttctcgcttacaaacttttcaactctattaagaatcaaaccaatccttctatattggcaggatgaaggtattattaatcaatatcctttgagattcaacaacattttcatcattcaacaaaacgatatctggactaccttgaaagacattcttggaagattctggctagaagaaactattaagagtgtccaggtcattagtaatgtctccaataatcccaaggacaatccagatcttaagcttctttggagatacatttctccgcacttaattgaaattgatatgggaggctccagacccaagttgcaaagtggtcaattttacccatttaagatcttaccaggtccatataagcctttcaatactaatctactagaccctcaagtcactccaactcttagtgactggcctagccctgattctaattcgcccaaaaacctctgcaagctccttccaaagaacttcttccattcaagggaaaaaaccctggatgggaatgagaatgttgttcccatcaactggaaagaatccaagcagcttttaaatagtattccaaagaatctatggccagaaatgtcaactccaacatcagaatttaaatcagaagataacttagaaaataaagcggactctaaagattctttagtctcagaaaacaaaggagaaaagaatgatattgaaaatcctcaagatactcaaaacaaaaatgacacttcaaaaacaaccatatatgcggaggagctcacaaagagtacccctagaagtattaatactttaagtagtggaaaagatagagatctacttcttcagttattacttactcagaaaatgctcggtaatctcaaacagttccactccctccgccttgagaaaatcaagaacaagcgtaatttggaagaacaatgtattcaacttgcgaccaaacatattacattcttctcaaaattggtcgataaagctcatattgaaattttgagtaaagttgctaaaatgaagcaaaacaaaaaggcgccaattataccgcaagttgagaagaggttatccatttttgaagcttatagagatattgcttcaactttaaatcttagtagagttaagaatatattatctgaaaaaagtttaagctacttagaacaaattggacgcaagatttcaagaattgagactaaaatcaacaaagcaaggcaggagattagaattcttttaaaagaagatcctagcgtattgaaagaaaaagcttcatcagcttggaacgaactcttgaccgctttaaatgagcttggtgaacttagaaaaggaatgagtgatatagagcttaaagagaagaagataaatattaaactgagacaaatgtgtgaacaacttacctcctcaatgggtgtaacaaagtcatttttagataattacagtaaatatgaccactatagtatgttcgagagttctcttctttatgatatgattaatacaattatcaaagggcaagagtattcttttgagaactcaattaatggaaaataa

SEQ ID NO: 2981 - DNA, 579 bp, Cryptosporidium hominis
atgccgtacatttataataagggtttcaagtggttcttcactgccactttagtattcatatttggcttactcattctttcttctcgagctgaagaaatagagggtgaagatattgttcagcttgtggaaaatgaccacaaacaagcagaaggcaataatcaagaaagccaaaaggcttcagagaaagttgttgagcttgagggggctgatttgtctgatgaaacttcggaagttcaaaatccagagcaaatttatgaagcatgtgcgtcattacaggaatcctttgaaaaggaatgtagtggcgaatcaatggataaatctcttaaaaagttagttgaggtttgtagtgatcctgttccagatgttcaggaagtattgactgctgcttctgagattgctagaaattatagtgattctagtctttctgaaaccactgaatgctatgttatgatatataccacttctttatatatatcttcaaatagtcagacagatgaacaagaggatgatggttcccttgaaattgaatctctggagactgacgattcacaaacagaaagtgaatttgaaaacaactag

SEQ ID NO: 2982 - DNA, 1017 bp, Cryptosporidium hominis
atgattaggaaatttcttttctccagtaggtactctgcaagtacttggttttattgtttcctgttgatcattctgaatgtgcaatattcaaagcttcatttgaaggtgacaaaatggttttctgaaatatacaatcttttggtcagttcgttcaactcaaaacctggggagagttatgaggatgaaataagggaaaaaatgataaatctaccactattcctcatattcctctgtgtatttagagtattaagtaatttcttcctaacagtaatacttcttaattggcgtaattatgagtcaaaatacttatttgataattggagattcattaaaggagtagaaggcgtgtctcaaagaatccaggaagatactcttcaggttttgaagcttattttgaatcttttcttcaaagttgtgatttctatttcaagaattctggttcacattccaattttgattgaacatagcaagaaagtttcaggaattccaccgtttccgagtggatttgaatattctcttatttcttatcttgctatatcgatttcagtttcgattcttggggtttatttcacatccaggaaaatgagctctaaaatcatgcgaaaggagattgttgaagctgaatttagaaaacagcttattttgggtgaagaaggtattccaagacttaacttgtcactaatagaagatactcttgttgatgagctcaagttgattcatagtgatatttatttatactcttttagatacagcttaataagcgaaagtttggcgagtcttgttgggtttctaccaactatacttttaattccagctattgttagaaaagacatcacgataggggggagggccgctattattagatgcttcaataccgtcacttcgggcattacttgtttcttttttaattgggatgatatttctgaactttacaccgctattaagagactttacaatcttgaacaacgtatcaataagtgtaaattggagccttcaactttactaaatgaggcataa

SEQ ID NO: 2983 - DNA, 1002 bp, Cryptosporidium hominis
atgattctattcagtggcctcagcagaagatctcttataaagttgtttctttttttggctgcgatttccgcatgttcagtacttctgttgtacttggagttttctgggaactctcaacttaaaacatttggagatgtgttacaagcagcagttaaagataggtcaagtgttagtgcttcggacctgtacacttcgttttttgcattggtttcttacaagctagccgttgtatttttgaagtcggtatcttcatttctgtccaagaagagtattttcttttggagattgcaactaacagagtatttcttagagaactgggagaatatttacttaattgagggagtatctcagaggattcaggaagataccatgagatattgtagactttttgagaagttttcaatttttgttgtacaggatttattcaagctttttatatacttgcctttattacttgatttaagtaagcatataacaagaacatggtttatacccaatacaagacatttattacttgttttgattataattaactccataattgggacttccattattattttcccaagtaaatacttatctagactcgtttataatatagataaggaagaagctgcatttagaaagaacttggttttatttgaacttgaagaaagagacttttctaacttcgactttgatgggaattataatagtgtggataatactcacagaagctactacagaagatattattttattaaaatccttcaattattgcattttcgcctctcgatgatcacttattggttgtttgctcatccatcaatggtacctccttataccctaggtcttcttaaacagacaatgcatgcatttgatgaagtctcatcagtatttaactttgtggtatctcatttcaaaagcttaatagagtacattgcagtttttttgagattgaatttaatggttaagcaaactaaaaaagctaaagaaaccgataaatctgggatttgtcattaa

SEQ ID NO: 2984 - DNA, 2193 bp, Cryptosporidium hominis
atgaaccagggacaaattttaaaaggtttaggatttctgatattagcgatttgcttgaatgtggaggttaaatcacaacaagtcagtacaacaatagaatctgatctgtcactgaatagcgacataagcaaaaatggtggcacagagccaataaaggaagtagcaagttcgaatggaacaatgaattcaacttctattactgaaagctcagaagagaatttgggaaacaagttgagtaatccagaaattatcccagtaaatatgaattttacagaagattcatgctttaatagaactttgccaattaactgtgataattcgaatagcacgttgttggttccaattacgtctagattcacaacaacaattgttggagattcatacaaatttggaatgagttatgaattcaaatcagaagatgattcggaactaatttcattcaatttgggctctaaagagaatagtgcgatcgtaaaaataagttcattagtgaatggaactcaagtaaatgatggaataacaactttagagttgaaagggtgccaagatgattttacgattattcaagatgcaacaaattctactttagggattggtaggatgacttttgtaatggttttgacaaatacaacaatttccttcactttaaataacttggtatataatattttaaatattaaccttgcagaaaaacctattagaatttccaagatccaaacatctggacttgaaaatgtaagaatttcggtaattccatttatagaaaatgacgaaatggaaaactgcgttctaagtgtaccagtaactggtgctagtatatcaaacttgaatatatctccatactcaaagacttgtctttcatcaaatgttgtaatcccaaaaagtactttaattcctggtagccaaatattattgggaatgccgggatcagtatcaagtaaatccgtaaagatgccatcaacaactcacgtgatattaaattcaaattcaggattaattctcttccatcttattattaatgataacggtctgtttcttaaagggacaagcggcactgatattatacgatctaaaggaggatattttcctttacaaagctatggattccaaagttatgcaattaaattggtctttacttcgttgtttgttacaatatcagtcaatggcttctatgcatttgacccaatcgttattccaaatggggaaattccatatggaataacctttgaagggcttcaccgtaaacctacaaccactgtacttccaacaaggccctgcacaaggtattcttattcaggaactggaacatgctcaatcgacggaatacttcctgtgcttaagtcaagtaattctcagtcgaaagatagccatggacaaacttttgtagctgttagagtagcttcagatcccactgaaaataaaaagaaaacaatgattagcttcgataacgatgcagatgtttccgagtttttagtaggagtaaatggaagaagtgcggttttgataaccaatttaaccaatcttgataaagttgattatgaaaatataccacaaaatgatacttttgttcttaaagatgaaaatgctggtggattacgtagaagctactttaacaatttagaaaatgtcgaaagtaccaaagtaagtaaaacattgggcgattattctgtgaatattagcggtgataatattgataagatttcttctgaattccaaccaataaggaaaagttgcgttcttgagcaacaccgaggttcttatattcctactgtatgcgacagcaacaggctttgttttacttcagcctccactggttctccagttggaggcgtccttcatttcattggaggattttccaatggcgcgttgaaagttgatatatacacaaaaaaggatggtttttcctttcaaattgaatacaacagttctggaaatattaatgtatttagaacttctgcaataaaagagaatgaaccaatttataagggccattatcttagtagtgccacttctagttctggaagaggggttattagtattaaagatcttgggcaatttttgcttctttccattgataagatggaggtaaccaaaatctcaaaaggaggatatgggccagatggaaatatttcctgtgttcagttctttgcaaatgagtcagatgatatttcaatcttctttgaaatccagtaa

SEQ ID NO: 2985 - DNA, 1887 bp, Cryptosporidium hominis
atgttctttagtggattcggaggaagacaaggaaacccaaatccagattctggaagtggtgataaagattctggaggaaaatatacgggtgggaatggagggggaagcatcaatggaaactttgacccaacagctctggagagaggagcaaaagctctgaaacaattagattcttctcctaatgcgcaaaaagcatttgaaattataaagctccaagagaaaacaaaacagaaagagcttgaacgagatattgaacagagctctgcttataggtcaaaagcaaatctagagagaactcgaatagaggctgatgagagaagaaaaacaattactcatcagcaggaggaggagagggctacatcccaatacaaggcaaagcttgagacagaggcatactacaaaaagctaaaggaacaagaaagccagaatgccaggatgctaaaacaacaacacgacaagtttttggaacaggaagagattagaaaaaagaatgaacgagaaatattggagatgaaaagaaggcaatcggaatatgagaataagctgcagcaggagaatattaaagtgagaattagggaagaaactattggaaggattaaagctgagagagagaatgcagatataagattgggtgaaattaaagctaaagcaaaagaaagtagaacaacccatttagaatcgattaaaacaatttttggaggtattagagaaatggggagctctttatatcaagataaatcaaagcttacaatgttggttggaggcttaacagcgatggcttttggaatttatggagcaaagaatactacaagagtagtagcaaatatgatagaaactagctttggaaggccaagtcttatcagggaaaccaatatgagttttctaacaagacacggattaaaagtaagaaacaacttcttttctccagcaatcgctttcagacttttaggactgagaaataaattagtaaaaaaaccaaaagtctttgaaaatattgtattgccatctgaactcgaaaatagactaaattggactgtaaatactttggtaaactcaagaagatttgatgtaccatttagaaatatgttgctttggggaaaacctggaactggtaaaaccatgtttgctagaaagcttgcaaaggaaagtggattggattatgctatcatgtcaggaggagatgtgggacaactaggaaaaaatggagtaacagaattaaataaagtctttgattgggctcgtaaatcaaataagggaatgctgttatttattgatgaggctgaagcatttttgtcaaaaggaagagaatccacaacttccagtaaatctgaagattccagaaatgcgttcagtgcttttctccaccaaactggaacagaatctaaagatatttgtattttacttgccacaaatgtcccaggaactttggataaggctgtaattgatagagtagatgaagtttttgaatttcccaatcctggctttaatgaaaggcttaaacttattaaacaatttctagaacttaatttcaattgttcttacgaatcagggaaatttattaatttaccatcattatataattcaattaagattcatccctctttagaccaagcatttttggatgtcttagctagaaagacagaagggttttctggaagacaactttccaaattagtcttaggaatgaaatcaatagtgcttggatctggggtggaatctctcactcgtgagattgctgagtctgctctttcttggaagcttgatggcgaaaataacttgaatttgaattcctcttatttttctcctactgcttcggaatcttttgcaaaacaatcttcacacgtaaatcgtgataattctaatagtgatttaacaaatctggagtaa

SEQ ID NO: 2986 - DNA, 378 bp, Cryptosporidium hominis
atgtcagaaagctcaatcttgctctacgaaaacaaaagccaaagagaaagtggaagaccttggaaagatactccaaatctaaaatccaaacttcaaaagagagtcacgggtaagaaaaagacttatgaggagaggattagggagagaaaggaaattcaaagaatcagaggaatagaattggctgaaaaagaggagagagccaaagcaagaaaggaagctaaggaaagaaaaagactaaaacaacaagccaaaatgaatagggaaatactttcttcgggagtacaagtaattacaaggactgacaagataaagaactggaacaagaaggcaagaaagatgctaagaaaggtctcattagaatctctgaacttgagataa

SEQ ID NO: 2987 - DNA, 1392 bp, Cryptosporidium hominis
atgccgagcatattttggatatatttgacttttcatctattcattggagtatttgcagaagacagcagctctgagaaacttttgaaatctttagtttttatcagctgtgtggatggccagaaacaagataaatcaggtaattatgtaagccaagagtattggaaagcaattcaatctgacaaaccggatgctttattttggatgggagattctgtttatactaaatgtgggtctccagtatgtgtaagtaagggataccttgttcaaagtaataattcattttatagagaccttttgaagactggtttatttgttgatggtacttgggacgatcacgattatggtgttaacgatggtggaaaatacgttgctttcaaagacgagagtcagcaactatttttagactttatttctcttcctaaggattctccaagaagaaataggaagggtgtttactcgtcacatacttttggtcctcctggaaagcaaattaaagtaattatcttggacacaaggtatcatagagataattattaccttcacgaaagatatggtatttcatctttcgcttatttggatactccatttaccagtatttttgcagcatctcttcgtttctttgcatctatttttggttatggccattcatatcaaggagatatgttgggaaaggagcaatgggattggttagagaaagaacttagtaactctaaggctcttgctaatattattatctcatctgtacaagttaccacacaatacccaattgttgaaggctgggggcattttccaaagtctagagagagattgttttcgcttattaagaagacaaaaccaaaaggactattctttttatctggggatgtccactggggtcaaatctttgagtctaacgattctcaaaattcattagttgaaattacttcaagtggaatgactcatagcgtaagtgaccgaattctggatagttttgttatttctacaacattaccaatctttacgggctggtctttgaatgacaagtctccaaattactttattagagaaaactatggaaaacttgactttgagtacttatgtacagattctaaagaatgttcagggatcacagttaaggccactattagggacttgaatggagatattcagctaaagaagattttcaaatttgataatgaaagtaatgaaaatcatatcgaggctatttctagaattccacaaatgattgttgaaaaatcagcaaaacagatatttggtagattatgcataataatcgtctcaatcatttggggtattcagattgccatcgtcttcttatacttcatattacgtataatcacgtcattcacaagactcttttcaaaaaaaaatagcaaagcaaagagtgaataa

SEQ ID NO: 2988 - DNA, 1950 bp, Cryptosporidium hominis
atggcgatggatatcctaaaggcttgctttcggttttcttttctgggtcttcgttcgaatgagcaatggctcggagaactgtttagtctaagctcggaggatcaactggggtcacaaaaggtggagttgaatttggatgggcaaatatttgggggtttgagcgttaaacagagcttagctttattgagggctcgtagttattttgaatctttagagttcacaagagcttttggagtcctgaacgatgaaatttctttaaataaatcgggtatcgcaatgttcatgaagaattattatcaattactttcattggaacgacagaatacaaagactgatagattggaggatctggtggttcctccatctgaagcaagtatgacttccttaaagtattcaaaaatagaaatggaggttttaaactttttgacttgtctgaacaattcaaatatggatgaaaaaccagaggttgtaggattattggaatggttggccagtattgttatttacaggcagaataggtatatggaggctcttgagtttcaaataaattctttaaagaaggaccctttgaattggagttgttggcaggatttggtgagaaattttatttcaaatggacaaggaaacatagtttcatcatttaagccatgcgaagatgtggaagaaagtgatctcagccagaatgatacatttctaaatgaggatttgcatagaaatcttggacttcaaccctttaaaaagaagcagagttctggattatcaaggagcttgagagattcatcattcaaagactttttgaattctcttgggctgaatgaaagcttgtacgctcacttggcctatgctctttatctggaaactactgggaaatggaaggaagctctttgcgaatataaccaaatatccatggaagtaaaagataacagcccgtatattgaaagtaggattgccagatgtaatagagagcttggggaccttgaaactgcattaaaagctcacgattccattcttagcaaagacaaagcttacttgggaaatgccatagaactagcttctatatattctgaatcaaagaatattaaagaactaaatcttcttgcaaaaaggtgtgtagagctctccaaatactctgttgatacttgcgttgtacttggaatctatcactggctcactaatgataaatacaaagctctcagattctacaagagagctcttcttatggattcaaggtcaagccaaacttgggtgctttgcggttatgctcttcatgaattagggaatatcaggagttccctttttgcctacagaaccgccttgaatctcgactcctcaaatgttcaggccatttttggaatcgctcaaatttattccagacttaatcttcacgcttactcaataaaactttacgaaaaagctctaaaccaatctcctggggatgctttcctttggtacaaccatggaatttccttggaaaaggctgggaactaccaggaggcttctagaagcttctataaggctctttcttgtgaatcatccaagaattcaagcagtgattctgaaattaaatacatgggaaaacttttaaagcttgaaactgaccagtggaaccaggctggatctctatattgggccagaaaaattattatcaaggctatagaacttggattccttgaaaaagcttcttctaaaacagactctacttttgacaccagctactcgacttactcagatgaaaacgaattcttctcaaattggcaaagactgagatggtccataagaatgattcctcagaaactccctcttgacctaattattgctcttgaatgcgttcttcagttacattctacaccaatagatgaaaagaactccgttcaaagcgaactacttgttgaaaatataagggaacttttaaataatcccaaatccttccaaatttccaaagattattag

SEQ ID NO: 2989 - DNA, 1110 bp, Cryptosporidium hominis
atgagatttgtttttactagcgattataatgatgataattcattatcccatagctcctatctaaataggccaaatgcatatggatactcaagaaaagagttcaaagctcgttcactggaacattcaagcaagactgcaaagaggattctcagtcatgtcattcctgagctaagtatttcccaatttaatgagtctgtgcgtatttttaatgcatatttggagtcctacaaaaatacaccaaaaagcatccctagaatagaatctctgatatcagcatctgcatacatatcggttagaaaggatggtggatatctttcactactagatattgcatccaggcttaaatccaaaaattatagaagctttgctagcctaattaaacgaatttgtactcgtctaagaattaagaatcttccaaatccctccattgaagagtctctaaaccacgtatgttataaagttgaaaagtttctcaaagaaaagacgattcagaatgcaaatgagcaacaccaaaaggaaactataattttccaaaacccggagaaagaaaccgatgaaatcagaaatttaatgttagattctttaattaaagactcatccattgatttggaatccaaaaatttgagaaattacaattcaaatcctggctcttttttaaactctatgcaacatctcaaaactaaagccgaggcaaaaacctctttagattctctcattaaggccaaaaacttttccttacttattctcaaaactattgcccttgatcaagatcatgcttttttaaataaccatgatgacatcctcaatccattatggctttctaatggggtttctagtactcccataatttctgcatcattatacttctcgttcaaattatattgtagaaatatctcttttaatgacttacttaaagctactggaatcagcaaatcatctataatcaaagccagaagatctctttctcacaagcttagactcatttctcagaaactctttcctggatggcttagtcctgatatgctaaagtgtaattctgaattacctcccactataatcgaatcacttactaaattaattcagtcttactattcaaatcttaaaacataa

SEQ ID NO: 2990 - DNA, 249 bp, Cryptosporidium hominis
atggatatcaatttattgaacccggatcccagagttgaagctcagaaacataagttaaagcgtttgattcaaagtccaaacagcttctttatggatgtgagatgtccaggatgtcttcagattacaacagttttcagccatgctcagagtgttgtattttgtggaaactgttctgctccattatgtcagccaacaggtggaagatgcaaacttactgatggttgctctttcagacgtaagaatgactga

SEQ ID NO: 2991 - DNA, 1035 bp, Cryptosporidium hominis
atgtcgaataaagatgagaatgatgggtctgtgttgtatgaagaggtacttccagacccattctatgatgatcctgaatttatgaagttttacagtttaaaacttccaatgaaattagctaatgaattttcaagatttgttaataatgaccagtttacaaagagatttcctcacataaaaagaatgcgtaaagtagttattaaagagaatgacttggaattgaaaaatttctcaagcagttcagaagatagcagagtagagattttaataggtgaaacacaagagtgtttgcctgttgaagctgataattacttaaaagaaaaccatattgataaaatttggaatgtaatagaggttccaaagaatcctccattaactagggaaaagttttcccaaatttcaaaaatttggcctttatcatttttaaagccaagatttactccagaagtactatcagatcaagtacaacatgaatctgataagtttgtaaaacttgcttgtaaggttggagagtttgcactatctattggaaatcccccaagaggatgtgtaataactttaaagggaaaaattgttgctattggagaggataataggaattcagattatccttggatgcattccgttatgaaagccattgataactttagtaagcgcgtatgctcatcatcttcatcaatgccaaaaatgactaattcactagattctaaaatacaagatgaaaatcagggaagcaaaaacaatgaagatcacaaagaccacttgattgaaatacagtctaaatatagtatttctgaagatcaaatactttcagattcagaattaaaagatcaatatttatgcactaatggaattgcatatctctcacatgagccctgcatttcatgctcaatggcattagtgcattccagaatttcaaaagtattttatatgtacaaagataaagaaagggggtttcttggaagtaaccacaaattacattgcgtttctgaattaaatcatcactatagagttttcagggctaatattgattaa

SEQ ID NO: 2992 - DNA, 1506 bp, Cryptosporidium hominis
atgctcaaagacttctcacaaacttttgagcgctattcccttcctgagaagtcggaatatttggaaatctcaattttggttgatcaagacttggatcctaaagaatattctaaatttagtgaagctcactttctgcaattattaattctagctcaaaatcagttaaaacttttcctagagtctagatttatacatgaagcagttccagaaaattcaaaaattattgcagtaagttcaaatctacctttattaattactctcagctttttactggaagataagaaaaaatctcttttggtatatgatgaattagaagattgctttgttggatcttttacttgctttgatgcattattaattttttatatactatatattcttgtcaaaaatgaaaatagtgaagaaatagatgataatttcccattcaaaacaatagaagaactttcaagatgcagtataaagcattggttaaagaaagttttggatacaaatgaagctctttccaaaaagctaattactatgtcggaaacattatatgagggattaaagctttgtttggatttggaatctaattacaagagaattaaattaaaagatcaagagtttaattatagtgatttgggaacatgggttattgaagatagaaatgatttatcagagtctaaatcttttaaagaagaatttggatctaaatcaatgggattatatcctatatgttatttttcacctctaactattctttctgacctagtacagaatttacaaatttgttcaggaagtatccctaaagaaaaatttcaaccagaagatgaggtagcaactgctgcagaaaaggatgatcccgattgtgatatgactcctcaagggagtgtttttggtacggtatttcacaataaagtattaaaacatttaggaatggggaaaaaagtccccaaatctttaaaagcaagttctccattaaaattagctctggaaatgtttttaaaggaaggattgactcatattccaattgtgtttgaagaagataatacatttacaggaacagttttaactatggaaaagtgttgtatgtatcttgcaagatgcgtttctaatcaagaaaaagcactaatggaagattcaattgagaatattttcaatatatataataaagaagcttatgacacactgggaaacacagtgattcagctctcagggttgaattgtggaaaaggttgttttgaatataacaataatagtgatatatcaatatcaaaaatcgatacaagaaagattggggatgaaaaagaatttaaggaagaaaaccaagttaaggataacacagaaagtgatggttgcaactcatcatttttggttgatatatgtttgagtggtgcaatttctcatattttattatcagaagatcaatgtttaattctggttgataagaaaactaatcaagttaccgcattattgacagctttagatatttgtaagcttttgactggcgcgcaaactcaagaataa

SEQ ID NO: 2993 - DNA, 1782 bp, Cryptosporidium hominis
atgtctacaaaaaatcccatattattttctgctctctgtgttgtgaaagggtccatttcaactttgtttggactatctggtaaagtttccaagcttaaattcaagaatgaaaaggtatcttttaactattctctttcaaaggagattgaaatgaatgatgatacgttagaggaacttaacaatattattagttataaaataaaagagaactcctttttccaagtcttcaaaatcctcagcaaagaagccgcctcgatttatggtagtgaacatcttgaaagtgatcaagctattccggatgatattgagctccgtattgtaacattgcgcaatttttatttgtctgcaaccagaaacccagtattaaagaatacaaaggatattggaaatgttttaattgaaaatatctctttagatcatgagaattctgctttactagtgaacttcaaggttgagaatcccttggtaagagcttcagaggagaactttaaagacctttgctgtgaggaatattcaatccaagatattaaagatggaaagttcattgttccaagcttagaggactctctaccaatttcaataaacctggatattattggagatgaactggtaaatccttgggaagttaaggctgacaatgcttacggaatagattacaataagctaatcgataaatttggatgcaaattgattaccaaggatatgattgagagaatggaaagattgacaggtcaaaaagctcatcatttctttagaagaaacatctttctttctcatcgtgattttgagaagatattagatgtatacgagaagggtgagctattttatttgtacactggaagaggtccatcgtctgaatcattgcatgtagggcatctagtcccattcctttttactaaatatcttcaagacacatttaaagttccattagttattcaactgactgatgatgaaaagtttatattcaagagcaacttgacacttgaagaaactcataattacgcatatgagaatatgaaagatatcattgcatgtggattcgacccagaattgactttcatttttacaaatcttgagtacattggagaattatatccagatattttgagaattgaaaagaaaatatcttgttcgcagatcaaatccatttttggatttaaggactcttgcaatgttggaaagtttgctttcccagcagttcaagctgctccagccttttcaagttcattcccacatatatttggtggaagaactgatgttcattgtttggtgcctcatgcgatcgatcaggatccatactttagaatggtcagagacgttgccccaaggcttggatatctaaagccttcatcaatccactctattttcctcccatcccttcagggttctcaaaccaagatgagtgcaagtgtccaaaactcgtctatttttgtaaatgataatgaggaatccattcgaaataaaattatgaagtatgcattttctggaggtcaagctacagaagaagaacaacgtagacttggagcaaatcttgatgttgatgtctcatggcaatacctccgtttccttatggaggatgatgaaaagcttgaagagattggcaagaagtactcatctggagaaatgctttccggcgaaattaaatcgattcttgtgcaagaactggttaaattaactaagaaccatcaaaaaaatagagaggcagtcaatgatgatgttattgccaaatttacaaataaaagccgagaacaacttttgaaacttttcattaacaaaaagtaa

SEQ ID NO: 2994 - DNA, 3045 bp, Cryptosporidium hominis
atgagtaaattttatacattaggaaatggaaaatatactttgggagtttgtgcgatggaaaacaaagtagaaagtcccccaatgaagagtattttaaatagaataacagagacaggaaaatttacaataatagtatttatgcaggatatgatagtgaatgaagatatattaaattggcctaaagtagactgtttgatttcattttattccactggatttccattaaataaagcaatttcatatgcaaaattaaaaaaaccaataatattaaatgatttagaaaagcaaattcttatgagaagtagattggaaatatataatgttttggacaaatggaaaataccaagaccagagtgcataacaataaatcatagtgaactatctgaagagaatcatgatatattttatgaggagtacgacttcattatatataaagggcacaaaatacagaaacccttcattgaaaagccaatattttcggataaccacgataattggatatactacccagagaacagtggagggggatgtaagaaattgtttagaaaaattggggatagaagtagtgaatacgacccaagtttatggaagattagaaaggatgggacatatatttatgagaagttcttacctacatttggaaccgatattaaagtatatacagttggtccaatgtttgctcatgccgaagcaagaaagtctccttgtttggatggaaaagtgcagagaactgaaaaaggaaaggaagtccgatactctgttatgttaagttacgaggaaaagttaatagctcaccagattgttaaagcatttaatcaaacaatctgtggttttgatatcctaagaactgtaactggaaaatcagttgtatgtgatgtaaatggattcagttttgttaaaggaaatgaaaaatattataatgattgtgctcaaattattacatcattatttattaaaaagctctttaaaaagaataaaatcataccaatgatcaaatttgaaaagaaaaaaaatatgatttcactaacaaaaaaattcaacgagaaaaaccctgaaattcaagataattccaaatttaacagtaatgtgaaacaggaacaacaaaaagatgagcttagtacagttattgtgataatgagacacggggtcagaaagcccaagctaaagttgaagtttgaaactcaagaccacagaattatttcgttgatttcagatgggaaagaagaaacaaggctaaaatctccagaagagctttctcttttattggtaaaaaatacacttatcttggaaaatttattcatgtatcttgaagatcattcaaaaattttgtcagataatgaaatccatacaatatgtaaagttttaaataatcatctaaaattacaggcatttctgggtgatggaaaaggattttctggggtaaataggaaggtacaattaaaacaaattgtacatgcagaaaacagtttaaacaataaaaaaacagtactgttggtagcaaagtggggaggagaactcactagagtaggatgcgaacaggctgaggaacttgggaaacatttgagagctacattatatccaggtgactcagagggattgttaagacttcattctacctttagacacgatttaaagatttattcaagtgacgaaggccgatgtcaggtaacaagtgcagcttttacaaaagggtttttagatttggagggagatttggctccaattttagttcagttggtcattcgagattcttttgctagaaacttattagatgatccacatctaactatagaaaggaagaaatgtaaggaaattattgaagaattattaaatattgataaggttgtaggatatgaagaaattttagagatttggaaaaattacaaatctgatttgaaagaggactttccgtcagaacaagttataagaactttaatgtcttgcggaaatccctattctactttgaaaagattgcatatgctcatgaaagaattggtgatgaaaattcatatagatcaagatgaagaaaataatattgtaatttatcaaggttttagacaaagtttggattcattatttaaagttcatagttctgagaaaaatgatggttttcctgtgtctcaagagatgatgcaacgttggaaccaattaacttcatcattttttaatgaagaaactcaaaaatttctcactgcaaagattccagatatagtggataatgcagtgtatgatatatattacaatgttaactttattaagaatgaggtttctttactactttatgaaatctatgagacagtggttccagttggtgaatttgtaagcttgtttcaatatggattatcaggagaccaaaaagtaagtataggaaaagctattgcagagaatttgatagaaaagctactacaggatgtcaaatattcgtatttaaaaaaattacaatgtgaaaataatgagaggaaagaaaacgagaatcaagacaaaactgcaggatttaattttaagaatggtaaaaaaatatttaataaggcagttgcaaacaagaaaaatggttctttcaatttccataaagttcatccagaagaacatattcgacttaaagaagaggaggcaaaagcttttggaattaagtcaccttggagaatagttagaagtagattttacgtaacttcagcatcacatattcaatcattagcaaatatattttcctcaatgtataagaaacaaatatctttcgatgacaaaaccagtttattggatttggaaaatactttttcagaactcaattacttgagccatttagttattcgggtatgggaaagcaaatcagtttcagaatctaatcaagatagatttaagttggagatgtttgtaagtaagggtgtaaaaaacaaaataggtcatatttttactactggaattgaaggagataatcaattcacaagtcaaagaataagtgagttgtttcccttaaagaaagtcacattaaagaactttaatatcaccgagttcgaaaacaaaatcagagaattaataaaagattaa

SEQ ID NO: 2995 - DNA, 2796 bp, Cryptosporidium hominis
atgaaggttaaagtgatccttcgagcaccaaaatcacagatcccactatatatgacgttgaatgatgcaaaatttggaaatgaagaagtagcaacatcattaaatgtagtggagtctgacgaagttgttcgttgggtaaacaccacaaatgaaaaatctccgactaacctgcaaattgcacctcagaaacaattagtaatttctgatgatttagcaagaagtataaccaacagtatttctgatatcattaagaataagaataaagccaataattctatggaaaatcgggtaagagatctcaagagtaattcaattttatcaagtgagcgccataaatataatgtcagtcatgtaaaggatgcattacttgttaagaagacggttccagaattgcccattaagaatgataatgataatgttaaagcaaatagtaatgaagccattacagtcgaaaaaaatccagaaattggaaagattgaaaaacttttatctcaagatctagacaaatgttcttcaccaaactctggaacaatgggagtttctgttgggagcaaatataatggaaaagaacttaaatccaacataagaaaaaaatattttaaaagttccaatttaaaaggtaataaaagtgattatgaatataataaaaaatttagatcaaatgaagattttccagaatattaccatgatttatttcctcaatttaatgatagtagtgaggagaaagatgttgatgattctccaaaagatagtgattttgaccaatttagaaactctgaaatgatttccaaaaagatacaagatgagattgaccacgcttccaaaatcgagtctatccaatgcgaaattgtaaaaacctttaaaaatctcactttgagtccttgtttgtgcaaatctcaagaatcaccaaataatccctacgatagaaataaagttataatccaaaaaagtctttttattaacgaactgcgtgagaaagttcctttgaaaaataactatgtaagtccaaaaaatgattcacgtaatatgtatcttctcattcatggatcaggtaaagaagcagaatctgcagttttatcgaaagatttgaagtctaacactgtttgtaatttgacagacaaattatcttcaatagaccaagccaagatatccaaatctccaaaaagtcccaatcctaaaaatatatctcatgaattaaactcagatcggaagtttgaacatgtttttgataataattataaagaaaccaatcatatccattttgaaggtcagaataaatgtaaaagtcaaaatcaaagtaaaagtggagctcaagatgaaaatataggtaaatatgaccatactaatgattatttagataaagatgaaaccaaagttaaaaatgaacaaaagagccaaaaggaagatctagacccaaaatcccaactttttcaagctctttctagacttagcttggaactttcaaatacaaacttagccttagaccagtgtttgaaggaaaaggaagatgtgatttcatccatggaaggggtacttattaaaggccttcaagacaaacttgataatctggaactgctttataaaaagatacaaatcaaacaagatcaggatgaactgaacgaagatttgaatcaagttgaaaatctaaaaaaagactttcaatcaacttattaccaacataaatcccaaaatgataacgaagccagtatattctttagtgaacatgaacatggatttgaacaaaacaaccatgatagccatgaagagacttttaataaaaataactctggaaaattaccaaatactgatctgccacttttgagagatgaaatgctttcacaagaagaagaacaaactaattttgtcactagaaagcccccaatacaaaaaattgtccaatcatataatgaatcttttaaattccaaccattaagcagaattgaatcaaagagatcaatttctgtccctgttcatgaaaatcaactttctaatttccattgcgaaaaaaataccaaaagtattgaagaaataccatctttgtgtgaactacaggataaacattacagaaataaaaatttgtcttcaagtattggaagctttagcaatattaatagcaataatttaattaccagcaaatctccattatcaaaagttggattaaagccaaactcaagctcagaaagattgagcccaaacattgaggagggatctagaggaagaacaaagttccaaggcaaccatcattccagagctgcaaccagagactttgtagcagaaaataaatccaatgtcatgctgaatgcagccaagtcgagcagcagtttgtttcaaaataatccaaacaaaaaaaataccaaattaataaaaaagaaatctccaaatggaaaagctaaccaaaattccctcaataatgatgataataacggtaaagttaatgcaatcaatcataagtatcatctcaaccaaaatggagttaataattttgattcaggaaatgaaatttatccttcccttgaagttggtggtccaatagccagaatgaatggaacatgtggaggatttgttccatgtttccctgggacatacttaaatatgcattatgatccacattttggaaactttcctggcaataattataatagaagtaattaccaatacatgaataatcacagtcaatttcctcaataccaacaaccaaattatcaaaaaatgaatggttatattggagcaaatggaattgtggataataatactccaagatgtccatattggtgtaatttaatttgtaggacttaa

SEQ ID NO: 2996 - DNA, 234 bp, Cryptosporidium hominis
atgactttagagcagaatcctaataatgggatgcctgagactggagacttggtaaatattaagtacaagatcattctgaaagatcatccactcatttccgaaattccaaatggtaagtttaaatgtaaaagctctggaggctcatttttattacaaagatttttactaattctcttttccaaacaattaatctcattttgttattttgtattcaataccatttttcctacttaa

SEQ ID NO: 2997 - DNA, 1209 bp, Cryptosporidium hominis
atgggtagatatataatattggatacaggcgctatattgcgactagggaaacatgactttatggacgatgttttgttaacagtaccttcagtaattcgagaggttaaggacaaaaaggcattggagaagatgttttacttgcaagataggattcaggtaatggagccttcagaacaggattgcggttttgtgaagaagttttctaaagagactggggattttgggtttctttcagagacagactttcaagtaattgcattaaccttgtcttaccataagaagtatgatgaaatttcaaagcttaacagtaagcctagagagattagtcttgttaccaagtctgaagaggtgggaagttgcgagaaagggatggataaggacttacaggaggtagaaatggaggcaggtgagcagaaagaacaaagcacagaagatgaggatgactgggagactgctaatggacaaagcagcagaagagaggaagttcagccagaggaagatgaggaagaggaggatgaggaagaggaatgtgaggaggatgaggatgtctccaaggaactggaagatgatatattttctggaggatggattaccaaggcaaatattacaagtgttatgggaggcttatcttctggatcccagagccactttgtggtagcatgtatgaccactgactattctatgcagaatgtattactccagatgggtttgaatcttgtagagatacatgggttatcggttaaaactattaagaggtggggacttctttgctgtggatgttatacttatgagagagatacaagccgaaagttttgtggaaagtgtggaaatgctactttagatagagttccaattaaagtttcttctgatggaacaattgaattagactgctatagaaagaaagtgaacctaagaggaactatttactctattcctaagccaaaaagaggtgttagaaatcaagaaatcattttggcagaggatcaacttatgattggaggaagacaaaggttactaaaccatcaaagaaagaaatgggaaaaggcttgcaaggaaagggaccctttttctaatagtggagctgatcttgaaagcagttgggggaagcagtttggaagctttaggtaccccgaaataaagattggaatgggaagaggaaacccaaattctaatagttggcagaagaaacgtaatggtaagaaaaaatga

SEQ ID NO: 2998 - DNA, 1308 bp, Cryptosporidium hominis
atgactacagaaccagaggtaaaagaacaagtcctttcaaaaaaggcattgaaaaagcaagaaaaacaagcacttaaagaagctaaaaaagcagaggcaaagaacaatcagcagcaacaacagcaatcagttcattggagttcagttattgtacattcaaccgaggcatctccatatggagtaattccctttaattgcaaaattgagagcaggactttttcaaagattaaggaattgaattctaaccagaaaggtgagaaaatctggttaagaggtagaattacggagtccagatgtaaaggatctttaggatttgtattgctcagacaaactttctacagactacaattagttgctgatgctaataatggtagttctaaggaaatgattaaatggcttggatgccttccaattgagagtatgatcgatgtatatggcactatagtagttccagaaactccagtggtttcatcaacacaagatatagaggtttcggttgaaagagtttactgtgtctcatcggcttgcagtgaattgcctttccaattaaaggatgctaatagggttgaaactgaggatgaggattccacgattattaaagttctacaagatgtcagactggacaacagagtattggacttgagaacttatttgagtcaggcaatattcagaattcaatcggaagtatgtagattgcttagggaattcctcacagaaagagaattcattgagattcatactcccaaacttttaccaggtgcttccgaaagtggtgccactgtattcaaagtagactacttctcaaatacagcttgcttggcacagtcacctcaactccataagcaaatgtcaatttgtggagatttggaaagagtctttgaaattggtcctgttttcagagcagaaaattcaaatactcacagacatttatgtgagtttgttggagttgatattgaaatgaacattgaaaatacttatcatgaattggttgacgttttcgacgctatgtttagacatatattccgaggaatcaatactcattgcaagaatgaattacttattgtctcggaatataatccatttactcctttcgtcatttcagaaaaaactccacgccttacttttgaagaaggatgtaatctccttaaagaggcaggcgctgaaattccagaggatctgtctgattttgatatttcctcagagcaggaaagattactcggtaagttccatactaagaattttctagtaagattgaaaagagcaggttttgagaagagcatacataatttaaagtgttattggacttga

SEQ ID NO: 2999 - DNA, 249 bp, Cryptosporidium hominis
atgagaggagaagaaatattaagtggagcacagagagtacatgattacgacttattagtaaaaaggtgccaagagtgcggtgtttcagaacattctcttagagactatttgaactcattcaagctaggcgctcctcctcatggcggatgtggaattgggcttgaaagagtcattatgctctttttgaatcttggaaatatcaggaagtcttcaatgtttcctcgtgatccaaagagacttagtccataa

SEQ ID NO: 3000 - DNA, 2523 bp, Cryptosporidium hominis
atggaagaaggatatgattgggaccaaattagcagcttccaaatagtggatggaatgaatatttcaagttcatcattattggatgatgagctattgataacgtcaccagattcatcaaataacggtaatagtgtttcattggagcaaagagaattctccagaccaatttgttcgcctctttcacagtttttagtaggttctgacggatctaattcaaaaaatgtaggtcaaaaacatttttcacaacaccaacatactaatagtgctggtggtgctggtggaagtaactttaacttaaataacagccattcttcaattgttggtgagtctcagcattatggattacaatctgggttaacaaactctggaaataatattagagataactcaatatataatactggatatcaatttaatgatactgaaaagatttccacaactgaaaaggaatttactaaacgtaaacgtccatatagtaataatagtaataacaatatcaatgttggtagtaactcatccaatagaattggtaactgtactcaaaatagtttatctggaattaccagatctgttatgggtattggcggaattggagcaggagttacaaataactcattaactaagactcctaccaagactcgtaccagaaaagtgcgagaaagttcggatgattttggaaattcttcaagcggaccgtcagttcattcaaagtctggctactcttcaaattcatcaggagaaagttgttcttttggctcgtcttcaaatatttcggaagaccttaattctgttaagtattatgaaggatttaagctacctctcggagaccttggaagaaaaatgcttcttaagaaattgcgtgaaatacatactcaaaacccaacgaaaatggagaaggctcttactgaccatggactttcttatacaagaattagattcgcaagtgtccaacaacttttcaaaatctcttatgtatgcgatgtatttgactatgctctgagcatacattgtgaatttggaaggccaagacatagagattcttccaaaagtgtccaactctcctctgtaaattcaaattcaaatatgatccaacaacaatcgcactcaaatatatcatccagaagagtaatagattctcaacagcataacaatggactcagtggaggagctgcagtacaaggaggtatttctgaaaaatttgaatcgcattctgctatcggcaatacaaatggaggagttattccaagaggacaagggcttttggatgattcttcaaaagtattaggaaaacttgagaccgatttagatacttacacaccagaaacatccccgtgtagtcatcgatcatattcctccagtaaaagtctttattcaaaggattcgagcttgatttctaatacaccattaaacaagattgaacatgatattacttcaccaatttcgatattctccactacaagtggttcaccatcctcacaaagaaaaagaagaggatctgcaaagtcaagttataatttctcacctccccctattcccgttacaaactctccaatacaatcaggagacccaaaagatatatcttccttgaatccagaactctctaactttatgaataaccagaacctaattaattataacataattcaaggtaatgtatccaataataatatgaatggaaactcaactgtttcaggatttagtacacaaagtgatgtttgtaccagccattttcctgatcatcagcagcaacttcaccataatattgggcattataacaatataaataaccacattcaaaatggaggccgagctcctcaccatcctcctccttcgtaccataagaaacacgaagaacatgaacctttggattcgatgatttccatgaatagcggctcagatagtattttacaaaagccagcaaaaagacaaaagattagatccaaaaagaagaatactttggcagatattagaagtgagcctccaacacaggcaacttattcttattccagctcaactcagcctggaataaataatggttcgagtatatttgtctgcggagatattgatgagatttactgtacctcaacaattaacactgaagttacccccttttaccaaccggaatcggagattgctcaccttggtgaatttgagacatctcatcatagtcataattatcataaccatcaccaagattcaatccattttatttcttcgactgaatcacatgaccagaatattccaatttgttcagcatttggatcaccctttgattcttctttaattattagctcttccctggatactgaaagctcccaaaattctggaattattacatgtgatagcccaacatcattttatctgtattcacaaccaaatatctcttccaattatgatgaatatatggattcttcttgtctcaatggattccttactcagggcttaaattctatagaaatgcttaattcgagcgagctagaaatggacaactttgacattggatgtcctttaatttcaatttaa

SEQ ID NO: 3001 - DNA, 780 bp, Cryptosporidium hominis
atgtctgatttacagaaactggattccaggtacctgaaaatactgatttcagcaattctaatcattggtccttgtattctgtactttatttcaacatcaaaatggctttttatgcaacataattacttgttaattacattgagttatttacttttcataattatgacaacttccatggtattgacgtttttgaaaaatcctggagtaataataccacaatccaagctcagcaatccaccctgctccatagatttacagattaatgcacagattgttaaagtcaagttctgctctaattgcaaaatgatcagacccccacgaactgttcattgtaatatctgcaatcattgcgtagataggtttgatcatcattgtccctgggtaggaacatgtatcggtgcaggaaactacaaattgtttattttattcatctcaacactatttttacttgaactagccatgcttttggggtcatgcaaaatggtaaaccattttacttacgaagcctcacatatactgaatttgggaaattctaccaaaatctttgttcacacaatgaatcactctgctggagctgctgtagttattgggtttgcctgttttaccatcctattttcactttctctccttatattccacttgtatattggcgccatgaacaaaactacttatgaagaaattaaaaaactttatagtgagacttcaaatccatggtattctggaatttcaaggaatatagctgagttgtttctaagtccatctccaaaatttaattattag

SEQ ID NO: 3002 - DNA, 387 bp, Cryptosporidium hominis
atgatggaaacctcttataatgaagaaactggagaaaaaaaccttcttcaactaaatcttgcaaaccgagtttctgaaaaacttgcaaagactggactttggaaaaatattaatgtaaaatggtcacacaatattcagttacatattgttactgctgttcaaatcttattttcttccaaacagtatctcaaactttctacctttattcctctcagcgatttagaccatattgattcctccttttttgaaaatttgcaacaagactcaaaaatcattctgccttatatcaactcaaaaattagtcactattatgttcttgctattgttagtagtgatgacgaacttatacttcaatcagttaactttgatcttaagaaaattgtttga

SEQ ID NO: 3003 - DNA, 2466 bp, Cryptosporidium hominis
atgtctgaaatacacttccaacgtattgggtccaaacatcttctttcccctccatctttagtacttacatataatggaaataagtgtttaattaatgttggtgagaatgtacaaagatactgctttgaacataaaatcaggctttctagattaagaagtattcttctaactaatatctctgttgaaactattggaggtcttccaggtcttcttcttacattaataggagttggggttcaaaagctcagaattgtggggccagaacccataactcgttatttaattatgtttggatatgtgattagaactcagaaaaagtatgaaagctctataaacactgttgtatctattaattcgcaagaatttctggataactttgatggggtaaaatccgatctagaaattgagattattgagttaatgccatcttcttcttctgagccactcaaactcgaattagatcatgaactttttcttgaatgctatctaaatcattccttttcaggatctcagatttgtttggattttgaacataatcaaattccaaactccaaaaaaagatgtaccgaaaactattcatcttgtttatcaaatctatccatattgtacatgtttgagtttccagaaaaaagaggaaagtttgatgttattaaagctaaagaacttggtattcctccaggacctctatattccaaactaaagaatggagaaagcgtacaaatttctgaatcgagaattatccagcctagtgatgtttgctctcctcccatcaagctaccctggtcaattattttccataccctagatccaactgagtttgactttttctactttagaatctctcaaattctcaaattgaaagggtttgatttaactgaaaccgctcaagattctagtaattgctcaagtgagcaatacaaatcttgttcaaacttttatatattcgaattccaagcttgttttgactcttttttagactttaataacaatttcttaaagcttgattcttgctttatccaaaataaatgctatctatctaaaggaattattaatgttataaggctaaatgaaagattaaatttactcaaagatcaagaaattaacccttttgtgacttctcaatttcttcaagagttcctaagccatatctctcccaatttatttcctttaccatcagctaaagttgatgagtttacttggaaccaacagtttttcatatcatcaaaccaaaaatctcttcaaaatactaactctattgcaaatatacacaaaaaaaaagcaaagtttgctccaatttcacaagaatccgacgatcaaatcttattcctaaaacaagaatttcaagatattttctccaattatatagaaaacaatgaaaaaacactttttcctcttttatatgttcttggaacaggatctgcaattccctcgccatatagaaatgtctctggttaccttttacgtctcgacgataatacgagcatgatgctagactgtggggaaggttctatgtcccagcttttcattctttgcaagtttgattttgacttattttcaaaaattattgcttcaattaagatcatttttatttctcatccccatgaagaccattttttgggtattttcaaccttttaaaacttaaaaactctatcaatattcaacaaaaagttgaaaatagctctggatcagtcaaaaatgacaatttctatcacataaaatatgatgaaaacctccaaagagtccaagaagtttattttaataatgaaattaaaagcaaagattttaagaacttggtaattattggaccaagaaaggtagaaaagttatacaatttattccaagagaaaattatacaagacaaaggaaatagaattagaaattgcgaaatttcttttatagctatagaaaagagaattaataaaagctttgataaaatatcagatcaaagcaaactggtattagatgatttctttttaaagcttgaacaattccctgttaaacatataaaatcttcttatggagtaaaagtaacatttaagcttgaaaatagtttgaaaattagggatggttattcattattcaaaattgtattttcaggagatactgctactccatgtacatctttggaatatgcatcaaaagactgtgatatcttaatacatgaagcaacttttgaggatagtttatccaaagatgctcaagaaaagaatcattcaaccatttctggagcaataggaacagcttataatagtttagcaaagttccttttacttactcattttagtcaaagatactttagcatgccaaaagttgagatgaaaaatgaggatttaaagagatactttttaaataacacgctctgtatgatggatttaatgataattcctttaaaaatagtggggaaattaatagaaagattccacaatttgaatgatttaattagggattatttgccacaagtttaa

SEQ ID NO: 3004 - DNA, 3096 bp, Cryptosporidium hominis
atgtcttcaaatattgattgtggcagtacgatggattcttttgagatttctatgaagctttctgatcctatttataatgaagaagataaccagtttagaatggaggaggatgctattcctgattatgttttccctcgagaaaatgagaataacttcaatgaaataattagttcgggcaacttatacaacaaccagatctattatgaaaataacagctatggggaagatgtaaatatggcgtgcttaaattctgatttgaataagaataataatagtagtagtggtagtaatagtaagaattttaacaaaaagaagcgttcaagtttgtcaagtaatacaagtgagggaggagcctttaagcttaaacatgagttaacatctgaagatgatattccagaagaggtaacattgagcggagactatggtattacttacagatacattgcagagttttcgatatacaataacaaactttccaggatgatgcccttagactgtttaccaaataaatttgaaagtatttactttatgaatgaggagggaacccttgattcttttgtaaaagcagcagatcctgaagtgaatgttgattcgaattatatgggagccacagaaaaatcacaagatgatcaaagttttgaagaactaactcttgttggtactttgatcccttttgaatatattttaaattatgagaaagaaaagactaatattcttaaagagaactttaggaagttacagagaattcgtcaaaaaggtgggggaagttacaagccaaagaagatgaaggaaatgccaaagtcaattttaaagcagggagacttaaagactttccagattacttgtaaaatacattcctggactattgaatttggaggtaatctgtttgatacaccacatatatgggtcaatagtatgtctgaaaatggaagctcaaaaacttgctataggctatgttggccagcaagcaaatacgtcaagttattttcatctgcaaagatcaagtttgaagttatttcaagacttattaagactttactttctccaaactcaaatagaattggatacaagactttccttgatcaggttactgggaaattggttgacaaatcatctaataaaccagtttctaagcagcaaactgaggagcaaacttctgaacagattcctgaaatgagcccagagcctgctagtgagacttcaagtccaactaagaaagcttgcaaggatacaaatccttctgtggatcagcctacaactgcatggggtgagcctttatttgttgctggattatctgagaaagaggttttgttgatgtttccctttattgagttttatttacaaacttactcgaaaaagtataatctatccaaaactttgggacttcagataattacgtcaatgaaaaataaactcacaaaaatgatattaagtgaagattctactttggatgaaagctatataagttcaaatattaatagcttgttgcaaaacaatgaactttcagagaagattttcactagtaataagctacaagcaagttcagtaacatgtgctacaactgctaataatttaaaaagaagacgaagttctgttaataagggtgaagattctcttaaatttgctttagtcaagtttaaggacttcactgatagctttgggacttgtcagaaaatactcaagatttcggacttctgccactcatttggtgatttcttagaattaccgatttattcaagttcactacttagtattcagtcattccaatcaaagagttttgttctggaaaaatcaaaatgcatttcactggaaattttaaatcaagtatatttggaactgaacaaagttattggaaaattgaaagaagaaagagcttctggtttaattagccaagaaggactttgtagtttgattaaagtagttcaggcttttcctcaaaacacattattttcgacaattaagtgccttattaatgccatttctgagaaagtttttaacttcaagaaaaataatacagaagattccagccaaacagtaaaaaccagtccaagcatcaaaagaggttactcttcatttagaaatgactccgaacattctgattcagagtctgatttaaagagttctgaaatcaaacttaaacttttggatactttaagtatcaataaatcctctattgattgcgtatcttggcctgtaattttggatttgctccttacaaagatgaacgagtctagcatgaatgaacttagtgactatttggacgaaggtgcttttgatgattatagtagtggggaacagttaatagtagaagaaacaaaaatggaatcttgcgatattacaccaaatcaaaactcaccagctcaatcaaaaaaacaagacaaaaacaactccttatgcgctttaaatagtgaatcgttctttgaaattctaaattggtcgattgatactcttggaagtggtaagataggcaaagaattcattgataatgtatttaatactcagaaaaagaagatcaacattgggagaaatgataattttattggggtggatcgattctctaacaagtactttttgtttaataatataaatacacaaaatacattatataaatcggtcattattgtttcaagctgtatggaaggtcttaacaataaatatatctctcattctactccttgcaaaaatcccctatgtactttatcagctgaaggaaacttaccttataatttggtttctactccagaagttgctgaaattcaaaactttttgagattgaattcaacctcagcaacaatctcatcaaagcctgtggttaaatctgcagagccaaactataagtttgtgagtaagaagaaagagatagaaacattgatcaattctctttgtgaagatcatttttgtgagttccaactgaaacttaagctaaaaagcgcattcaatggaaaagagtttgagcatgaaacattcaattctgctaaccatgcacaagaatgtattgactataccataccagaccatgttccttttaacatatcactgctcaggactggccaggacaaacagaacttttatttcactgccctaggcatagcatag

SEQ ID NO: 3005 - DNA, 654 bp, Cryptosporidium hominis
atgagtcaaacgtcaatactgtcttatttgaataaaaggggcgcagaaaacatttgcaaggacagtattgagtgtgggaatgacttgaatagagattcagcagtgaagaataggagaatatgcgttgaagaaacagaaattaaatcaagtaaggaggctgaggaagagaatcaagagtactatccgagtgagtcggtgttgagggaatactttggagatgagtggtttgaggctcttaaagacgaattaaggaagccctattttgtgaagtgtatgaaaaaggttcaagaaagaaggaattgtgctaaagtgtacccacccagtgacaaaatgtttagttgtttcaaagctactccattgaacaagatttcagtggtaatcttgggtcaagacccatatcaccaacctggacaggcaatgggacttagtttctcagttccgaagggcgttccagttcctcctagtttaagaaatatttataaagaaataggtaaaggcaatcctggtcatggagacctgtcatcgtgggctgaacagggggtattccttctaaactctttactttctgtagaagaagggaagccaatgtctcacaaagactatgtaagtttgacagtaataactacagtgttagagaacaaacaaatttattga

SEQ ID NO: 3006 - DNA, 669 bp, Cryptosporidium hominis
atggcaaaatcaaagagagtaaagaaggttcttatgaccaaggatctgaagaagaagagaaaggacaagtcagaaataatcgaaaacgtacatgagtacattggtaaattcaagtttatttatgttgttaagctgaagaaccaaagaaatgctgctttaaaacaacttagagttaggcttgaacctggaaagttattagttgggaaaaacaaacttcttcaggtcgcatttggtgcagactcagattcagagtctgcaaagaatgctcataaaatctcttcttttcttcgcggggaaagaggtcttatatttacagacttggctcctagtaatttaaacaaggtactggaagaaagttctacgatggaatttggtagagaaggttcactatctgacattacttgcgttgttgaaccaaacacagagttagaatgtttatacaaaaatgcagaattttatatgagaaagcaatttcctcagcttaagccaactctttttggctctgatcagggaaaagttatcatatgcgagaaagggaaccctttgaataaataccaatatttgttacttaaacatcttgaaattccctcagtaaagtttgaaataaaaccaattgcatgtctccacaatgaggagttgactcatttcgaaaatgctgacatggaataa

SEQ ID NO: 3007 - DNA, 3009 bp, Cryptosporidium hominis
atgtcaaacttttcaatggacataaattcctccctggaaagagcatataggacagttccaatactaaagcctgtggtttggagtggaattaaagagcttttggatgtttcaaggaattctcttggaagtaagcaaaaagagccagggtattttggtgtgtcaaagcgagcaagtagtgggaagggaatagtaaacgacttgggaattacaactcttgagcgttcaatccaatatcttagctctagactggaaagttatgactctaaaaggagatacttagcagaagcttttaatttcaaaagggcccctcatagaggaggctgtgggcaggataaagacaactatagtgagttaggatcaggaggactgccaaagtatcttcaaactagctattcaaatttcctttcatacttgatagatgagtctactacgtctattttccagatttattattcagaagtctttgatttatttttcacagaatggaatgaaagaaaatccaagatccttgatggtcaaaaacaggatatagtatcaggatattgtaatgataattctcatctatcaaccaaatcagaatttggacttttgcttaatcctagaaagccacactttgaaacaatacaagagcaaggagttggaggatctagaagaactgaagactctattaatgagtactattatgttctttctgagattattccaaatgttactgtttctgatttagcttctgacaaatatgtatctattcagaaaatgtgtctttcttccttcaattctcgtatccagttgattcaagaaatgggttctctattggctcctgttgaatacaaggaggaaatttcattgttatggagacttttgacactattagttggcaattcctcaaagaacaattatacaactcgtcagatgatttctaattcaattcgagctttagaagtttctgctgttgataatgttttgtatcacaattctaacattttcttaggaaacagatatggctcaggagtaggaagtagtgtacttatttccttaaagaactttaccaatttttgtataaagttgttcataagtgaatcaacagaccaacggaatatcaattacaatatgaatttcccatgcgaacaagttcactactggtttttggcttactgggcatttagaattgggtctggccaaatactttgggatatggcatccaaattctctcatatacctcaacatttctccttggtatgtaaatgtttagcagcaatacttctttcaacaagtagttcactcttaatttctcaaacatatgatgatattgttcaaggcgaggaaaattggattaagcaatgcgtacaatttgactttaatagagacctttactctagcagagaatatagagagttgaattctatgttttactcaaaaccaagccaggatgcagacttaagagaacaagcctattatcaggttattttcagtataattaacgtttcatctcagtctttgaatgtgatgaaacttcttcctaatacaaatatggaagattatatttggtatcaacttcatattatccttaagactaatgatgacaatgaatcagcaaaggaattaaatactttgtataatagacttcgaaaccaggtagaccaattttcctatggaggagaatcatcaagccgagatttatctattcactctcaggaagaggttagccccttcttattgactcatacatccagaagaggagatgttcatgcaggaagcactaagttaagcttaagtcgtagccagaattctcatttacatgaaagaactatatctagacaagaagataagaatgagttaaatcagaatgatagaatggtaaaagaacagacaaatctcaatatggcaagactaatgtgctacactttacattttggggaggcaatgaggtggatttattcttgtcatcatgaattaaaaatcatacaacttcagtgggttctttacttagcagttgctggtttaattccactttggaaaaaaatagaaaatgatcaatttggagtcttctcttcattttctgacaagattgagccagaagatagagttttaagcctttatgaagttcttgagaaatcaattaaaaactttaatattcccttcccttttgttgcaaaacttgcaaggcttttcccggaatcaatgagaacaaagatattacaggattatgtagagttcagtctattacatgatattgttgaagatgattacactgatagtgctagtttccatacttatattgaacaaggaaagtcttttgttaagtttgatacatatgagagtatgaatacaagtgaatactctgaaatatgtgaagaaataaacagtattatagcaagattagctaaaaataggggccattatattacttcaattttatttttcatggaagcaaacctcttggaggaggtcttggacactattttagattgcttgagacttccagtttgttattcttttacaactctcaatacgagacaacaacttttctttgacaaattacagaccatcataaacaaagtttttacagattcttcttatttacaacaaggtcttgcagttcagacaaagttggatgaagttaaatatttgaatgagattgtgcatgcatttgttttgattcaaaagggtttctatcgctcagctaaagaatatatagaatcaaagaacttcatcccaaagtcggagagtggaataaactcttcaaatgtgggattcttaccaaaaattattgaagcttatgtagtgtcactgtttgagctttgcagaaacggcaatgctggcagtagcattccagatgatgttcataatgccattttctgcaacttccatattattaattctctggtaaattctcttacttcgatgtatagtattcagtcaagctctgcagaaaaaattcataagcttcttaaagagatgctagttttggtctctcccgatcaactcgctctttctaaacattcctaa

SEQ ID NO: 3008 - DNA, 450 bp, Cryptosporidium hominis
atgtcaaaagcaaaacaagagagagcaatagtatatgtaggccatattccatttggattatttgagcctcaactcaaagaatacttttcccagtttggtaagattttgaggattaagctgagcaggtccaagaagaatggtcactcgagaggatatgcatttattgaatttgaatcaatggaagtggctcagattgcagcctcaactatgaacaattatattatttttaagagaagtctcaaatgtcacgtacttcctaaagaaagtattcacccatacatttttattagatcaaagaagaagcattcttctgaatctaataatgccttaactgaagatgaaaaacaagcaaagattgataagtctgttctttctaagaaaaagaggctacttaaaatcaataaaattcttgaaaagaataatataaattacaagcttccttctgagtag

SEQ ID NO: 3009 - DNA, 2046 bp, Cryptosporidium hominis
atggtgaaggaagaaagtaacaaaagaaaaagagacaactccaggagatctgagttagaaaatgtctctgttgaaggagaacttaataacaacgactcatttattccttttgaaaagtccaatccaatatttgagaattactatagattacaacaaatatgtactgaaaatgagttccaagatttcattcattctctttcttctcagcttccaacaactttaagagttaatatttctcacccattgcactcattattagagtttcttctcaacactgaaacagaaaaatcatataataataatgctattttcaacttgaaaagactaagtaagaattgcaagttatatttgacaactgaatattccagaaaaatgctcaagaaagagtctcagctagctaagctacacagcttcatagtttctcaagatgagtttggaaccctttcaagtcaggaacttgtttccatgttgccttgtatatgtcttgatcccaaaccaggccactttgttctagatttgtgttctgctcctggaagcaagtctactcaaatcttagatatgattctctcatcaagagatgaccaacttgggataccatgcaaaaaaggtgtattaatttgtaatgatctaagctcaaaaagattggatacactctcatctcgtctaagtagaataccatctcccaatgtactaatcacttgtatagatgcatctttttttccaacttttaaaccaagtaaaactactattacttctctttttcagtttgacagaatacttgtagattctatttgttctggagatgggacactcagaaaaaatcccgatatatggacaatatggaggcctgaaaaagctttaagccttcataaaaagcaagtttccttgctttccagagcatttaaactactaaagaatggaggaaaacttgtttactcaacatgcagcctaaatcccatagagaatgaagcagttatctctactctattacggaagttccccgatgcaaaactcataactccaacaaacctggatgaaagagaatttgaaatttctaagggtcttagaacatggggagttcattttgaactgaaagaacaagacaaacttcaactttttgatactttagataaagtcccagatactccctttaaggaaaaacttacagaaagtatgttccctaataaagaatggtatgagtctgacaatttcatgaaatgttttagagtattacctcatagaaacgatactggagggttcttttttgcagttgttcaaaaaaatggacctgatgaaatacctcaaatcgaacaaagatcagaatcctcatcattcaaatatgagacagttgaaacaaaggatttggaacttatattaagcttttatggccttgataatcagaatatacaaggaaaacttaatggtattgaaaattttccatccaaaattaagaatcatttaaataatataaattctatagaaaaatcatcttttgtaaaaagaaagtctcatgataaaactatttatctcattggggaagatgtctcagagcttattatgaattataatctagaattagatcttagatcagtaggtatccgagcatttgagtatcttaaagggaaaatttctggagacggaagatgtaaatggagaattaaccagaattcatccagttatttagttagattaatgaaaagaagactaatctttgtgagtatctcattgctagatctacttgatgatgaaaataaactcattggaggtaaagaaattttggatcttgaaaagagaggagaacttcttgggttgaaagaactttgttctggaatatcacaggagaagaaattagaaagtggtggtattttagtagtaattttacctccaagtattataaattacggaggaaacggtaaaataaatccaaactttaaggaattggaccaaggagtccctctctcgggaattctatatgaagattcaggaataagttttttcgtttcaaagaatgaaataaagtctattaaagagttaatattaatttaa

SEQ ID NO: 3010 - DNA, 891 bp, Cryptosporidium hominis
atggaacaagttgtgatggaaactaatcctgatgacgttgtttttgttatggatagtcatattggacaagcttgttacgatcaagctatggcattctgcaatgcagttgatgttggaagtgtaattattaccaaattagatggacatgccaagggaggaggagcactttcagctgttgctgcaactggagctccaatcatctttattggaactggagaacattttgatgagtttgaaccttttgaaaccaaaggatttgtttccagattgcttggacttggagatattagtggtttaatggctaagattaacgaggttgttcccttagatagacagccagatatggtcaataggcttgttcaaggtatatttactttgagagatatgtatgaacagttccagaatatgttgaatatgggttctccaagtgctcttttgtctatgattcctggaatgggtccaaatatccttgcaaaagaagatgaacaggcgggtatagaaaggcttaagaaattcatggtcattatggattctatgacagaaagtgaattagataatgaaaagacgattaatgcttccagagtagagcgtatttctaggggaagtggaacttctaatcaagatgttcaagaacttctttctcaacataaaatgttctccaagatggttggacagattggtaagcttggtttaggaaagaaaggaggattggatatgtcatctattatgaagaatcctgctcaactcatacaaaagatgcaaaaggctattgaccctagaatatttaaacatatgggtggagctcaaaatatgatgaatatgatgagggaaatggataagttccagggttctccagattttcagaagatgtttggaggtatgggattttag

SEQ ID NO: 3011 - DNA, 1035 bp, Cryptosporidium hominis
atgttggctatattaaaaggtgcttcttgcaaaaaggtgattttttcatgttttttactggttattttccttgcaaacatctcccagatcttagcagaagaccaaggaaccaccagcactcaaaattcctcccaaaatgaaagctctaataaaaagaattttttctttctatctttgaacaagtatgtctgggttcacgatgcttgtagttggttccatgctttaatgtgcattacctgttatggagttatcacttttaaggtatacagtgatagaagtgcattaggaatttccatgcaaacattatgtgcattatgtttttctgagttttgtggcgctcttctcaatgtttggttttctctatatactggaattactttggattggtcattccaaattgatataatttctacatttttatcggttttgtgcttatatactgtatggaaaaagttctcaaattctattgaagatcaatatgatacttttggactaaatattctagtgaggatactttctatcatgggttctaaatctgtagataaggatgcgatgcgaaatggtgaaagggcaggaaaaatcaagcctactggtattgcaggattaatttctggatctttatattggcttgtactttacattttggccattccactctctttcattttcttaatgtttaggaccagaagaagactcggtttaattacttccctcctagcttatgatgatgcagttagagcattagctcttgttcctcaattatatatgttccatattaaaagtccaagaaaagtttctgagcatttggccttatttgtggtatttgaattcatactaaaggttctggcactattttactggatttcaatgcctctatttagaatgcctcatgagtccaggaattataatatagctgtccaaatctttaatataggtattctcttagattttgcttaccactactttagagccaaatttaatggagagaagacaattcaatatgcctctgacttaattatcccattctcactttga

SEQ ID NO: 3012 - DNA, 273 bp, Cryptosporidium hominis
atgaatgctaagaatgaaatcgttcacattacctcgaaagttcttaaggaatcaatccaaaaccgaccaaaaatatcgtctgaacctagtcaaaaaatagatggaaaagtaattcaagcaataggaatgatagtggaggaatgtatagacaatagtttattatcaggggtgcatagaatgttaactagagactcatctgaagtgaagattgaagacatcacaaactatgttaaaacaaactacgggatttctaagaaattgatcgataaataa

SEQ ID NO: 3013 - DNA, 417 bp, Cryptosporidium hominis
atggactatcgaaagtgggacttaccaaaaaagattgtcagaccaccagagcaattttctgaatctcctgaaaatcgggacttcatgacaagttaccaaagtaactttaaacaatgggaacttccaaaattcaagaaacctcaaccacctccagaagttgtttcttctccttatggcaacatcaattcagtctacagagaaaattatcagcaatgggatcttcctaaaaagattgttaacccctctgaaatttacaatccatctaaggaggatcgaaattttgagactgtctacaggaactcctatcaaggcgtacaacctcccgtttgccctgttagtcttcttccccctattcctcatcctcctcctggcagacatactatgttttgggattcagtctctaaaaattggtactag

SEQ ID NO: 3014 - DNA, 3273 bp, Cryptosporidium hominis
atgtttgctgcaacaggtctttctaagctctttacgtcttgttgggctcaaattccagataatcaaaaagaggaaaccaaaacatttctactaaattacctctataagtgtggtcctgatatgttacgttcagctccttatttggttgggcactatgttcgtcttttggctcagttggtgaaatttgggcttctagactccttgtctcccaggccaacaattaccgatcaagttgggcagtttctaagtgcttccacttctcattggatcattggtttaataatctttacgactttgactcaagagatgcaaacttccacaggtttatactttgcaaagtatagaagggccgcaatactgttcagagatacttcccttccagtaatattccagattgcaattaaaactcttcgtcagttccacttgggaagcgtttcagtttctactcagcatgaagagtatagacttcttcgccaggtactccaattaaccctttgctgtctttcttatgactttatgggaacagtacctgatgaaacatctgaggagcagaatacagttatgattccccattcctggacaattctcagggaggaatatattcccataatattctttgatatctatgcaaaatgctgctctccgaacagttccatgccagattgtgcctctatctgtctccaatgtcttatcctttactcctcagttagaagatccttcttccctacccaagctgatagaactcgttctttagcagctctaatgactggtacagctggtatcatccaaactaagatgggccttgaacacgagagctgctatcatgaactttgcagacttttggggaagcttaacactgcaaaccagctcacagaactctcgtcttcggaagcatttggactctggatagaccaggtttacaattttactattaagtctcttgaggaatggagcgtcttaccaaacagtaagcattatctccttggtctttggagtcatatggttatccctttactctaccaaggggatagagctccacagaatcttgaaaagtatatccatcatataacagtcaccttcatccaaagtaggatgaagcttgctgaggcaattgctagaggctcggatgtagaagaccctctggaaagcgaagttgcaagaactgagcagctcgatgttctttctcaattgagtagatgccaataccacgaaactgcagaattcattgtacagctctttgaacaggttacagattcagctaaaaacggcagcatttctcaggattgctttatttctcaaattacctggtgtgtgtatatgcacggagctttaattggaggacatagcattaagttaagaagacctttactccccagtggctcttcatcctcatcgggaactagcagaccagatcagaagaaccaggtatcacaccatgttttgaacggaaagcttgctagacttgtctttggtctctcccaacaaactgaccaacttccagagacacctgagtcattagaattggcctatctctatttcttggagcagtttagaaaggtttgtctcggagattacgcaaaacaatttattcagcctgagactgaggacgccaccttggcatcaattctgggcgtccaatctgatgatgatgttttgagcctcattattagcaagattggaaggaatctacaagccaagagtaatatggagagtgtagttcaaaagactctttctctatttcacgaattggtagctgggatctcgatcgtccagtatactgacagaactacccatctcatagtttctggacgacttcttctcaaaaatgaacaagtcaagaagatactctgcaaccatgcttctccagagtttgctttcctgaataatccaagatatggtagacataggacttcttactatttcactctatcaaaactcttgttcttagagtcaaaggaggaagagcctggaactcagcctataacaacttttgaagatttcatgaaacctttagagaaagtttttactttgatctgggatgaaataatcctcggaaataattcttcaaatgggggtggatataatattggacagttcagggttccattaatggctttggcaagagacttaaggggcatttgtatggcttgtgtaggccctgaaagctacaaccaactttttaattggttagtaaatcgacctaaacagcttggacagagtagaattcatctcttcacttgggcagctgacaaactctgggaggactctgatgtaatgaatgctttgctcaagttcatggccgagtttgtggacaacaaatcccaaagaataaactttgataaagcctctccaaatggaattctattattcaaagaagtttcttcattaatttgcacttatggctccagaatcttatctaaacctgattcatccttccagaatatctataaggaaaagtataagggtttagctacaacgttagctatgctctgtcatgctttatctggaggatatacaaattttggagtttttgaagtttatcaagaccaatcactggaaaacgctttgcaacttgcctgtaggatgtgtttggtgattcctgagcatgatttacagtcatatattaagagcctcaagtcttattatgaattcttagaacttgcaaccaggtgcttcatgtccacattcatcacttcattggaaccacaaaatcttgcaaccatttgttactcaattgaatctggtctgtgtgcagttgacaatgtggttcttcttgcctgctgtgccactttggatcattttgtaagtttcattttcacgactcttgagaaggaaaagattgtccttcctaatggaatgggagtttctagaaataacgataatatgaattatgaacttggaggagggagcccatctctaattcggcaagggtctacccctgaaggaaaagctgtatataggtttatgactgaacaacccaatgctttgattagaatcatgcagttaatgttcaatttaattacgacaggggatctcagtacttggaccttttcaaggtctttgctagggatgattcttctatttaacaatgaatttcagaacatccaacaacagcttattaaccagcaggttgatgaaaagaaagccaagtatcaatctcttattcaggatcttcttaaagggaccgatggaaccctctcagcagttagcaaagatgcctttacaagaaatctccatttctttgcccactcaattcgttcaaattctctttaa

SEQ ID NO: 3015 - DNA, 363 bp, Cryptosporidium hominis
atgacaaacccaaaatcttttgaaggattagatgcttggagagaagagtttttgattcaagcaactccaaaagacccaaactcttttccttttgttgttctaggaaataagttggatcttgatcagaaatctagaaaagttagttcccaaaaagcttcagcatggtgtaaatctaaaaacattgaatactttgaaacttctgcaaaaaatgcaacgaacgtagatgctgcgttcgaagaaattggtcgaagagcactttatagagaaacttctgaagatcaagtttacattccagagccattaactctcaataataataaccaacaacaccacgaaatcggatttgggggctgttcttgttaa

SEQ ID NO: 3016 - DNA, 1029 bp, Cryptosporidium hominis
atgagtaccttttgccaatcaaaatcagtagctaaacaagtttctgctaaaggagttgaagaagaagcatttgtagaaattgataaattacaatcagcaggaattaatgttgcagatattaataagttgaaaactgcaggtttatgcacagttttaagcattattcaagcaaccaaaaaggaattatgtaatattaaaggtctttctgaggcaaaagttgagaagattgtagaagcagcacaaaaattagatcagtcatcaagttttcagtctggaagtgaggtcatgagtagaagacaaaatatcttaagaatcacaacaggaagtgagcagttcgacaaaatgttgatgggtggatttgaaagtatgtgtattacagaaatttttggcgaaaatagatgcgggaagactcagatctgtcatactttatgtgtggcagcacaactccctttagaaatgaatggaggtaatgggaaagtctgttttattgatactgaaggtactttcagaccagagagaattgtaaagatagcagaaagatttggtgttcagggagacgttgctttagacaatatcatgtacgcaagagcatatactcacgaacatttgaatcagttaattagtgcagcagcaggaaaaatgattgaggaaaagttcgcactcttaattgtggattctattattgcattgtttagaactgaattctcaggaagaggagagttagcagagagacaacaaattttgaataaaacattaagtaagctgaataaattggctgatcaattcaatattgcgatagttatgacaaatcatgttatggcagaccctgcaggaggtatgagtttcatgccgaatgtagcaaaacctgttggcggacacgtaattggtcatgcttcacatgtaaggcttagtttaagaaaaggtaagggcgagcaaagagtatgtaaagtttatggctctccacatctgccagaatctgagtgcgtaattcagctttctgatggaggaattattgatccaattgattaa

SEQ ID NO: 3017 - DNA, 396 bp, Cryptosporidium hominis
atgtcaggaaaaagtggtaaatcaattaagggaccagcccagaagcagcaagcagcaaagaagactgcaggaaagtctccagcagacggtggcaagagaaagagacgtaagagaacagaatcctttgctctttacatctacaaggttttgaagcaggttcatccagagactggtattagtaagaagagcatgagtatcatgaactcttttataaatgatgtttttgatcgtctctcagctgaagctgtcaagttggttcagtataacaagaaaaggactttatcaagcagagaagttcagacttcagttagattaatgcttccaggtgagctctcaaagcatgcagtctctgaaggaactaaagctgttactaaatacacctctgcatctgcttaa

SEQ ID NO: 3018 - DNA, 2292 bp, Cryptosporidium hominis
atggatccaaagagaattcaaaaaggtacggaaaaaacactttccagtgttggaaaaattggtggagaattcaaagtagaaaagaagccagaattcataaatagacgtctctcactattcaaaacgctttatgaaaaacaatgtgcattactccaggaaaaggcttcaaaaaatgaaccaattaaaattacccttcagaatggtggtcaaagagatggtgttaagttccaaacatcccctatggaaattgcaagacaaatatcaaagaaattagcggagagctgcattgtagcaaaaatcagatataacaaatcattatttattgaggatgatgaagttcgtggtattgaagaagatgaagaagaaacatgttgtcaagggcatgaagatcaaagtgatggatggagactttgggatgcaactagaccattagaaggggattgtgaattagagattttaacatttgattctcttgaaggtagtggtgttttctggcactcttcatcacatattcttggtcaatgtttagaaaatgaatatggagctcaagttacaattggtcctgcacttaatccagggttttactatgactcatacatgggaactcacagtgttagtaatactgaatattctgacattgaaaattgtgcaaaaacaataatttctgaaaagcaacaatttgaaaggctacaatgcaataaagaagaagcattggaactttttaaagataacccatttaaggtttcattgatcatgtcaaagatcccagatggtgctcaaacaacaatatatagatgtggttcattcgtagatttatgtacaggtccccatattcctcatacagggattgttaaggcttttaaagtcacaaagaattctggatgtaactggcttggaaatactgaaaatgatgcattacaaagagtttatggtgtatctttcccagataagaaacgcttagatgagtacttgaacatgttggaagaggctaaaaagcgtgatcatagattacttggatcaaacttacagctattcttcttcgactcaaatgtatcgccaggatcatgtttctggcttccagcaggagcaagactgtataataagttaatggactttattagaagcgaatacagaattcgtgaatttactgaagttattaccccaaacatttttagttgcgatttgtggaagacttcagggcattactttgcttacaaagaaaatatgtttatttttgatgtagaagaaaaggaatggggtctaaaaccaatgaactgtccaggacactgtgttatgttcaaacatatgaatccatcatatagacaactcccaattagattagctgattttggtgtgcttcacagaaatgaattttctggtgctttaaatggcttaactagagttagaagattccaacaagatgatgcgcatatcttctgtactcctgaacagatccaagaagaagtatttaaagctcttgactttttattcttcatatatggccaattgggattcacattcgacctctttctaagtacaatgccaaaagaacatttgggaacagaagaacagtggaaagaggcagaaaatgcattaaaatctgcattggacaagactggtagagactggaaattaaaccctggagatggagcattttatggcccaaaaattgatattatgctttgggatgccttgaaaaggcaacatcaatgcggaacaatccaacttgacttccagctcccaattagatttaatctccaatatagaactgacgaaaatatttctgaagagtccacaaatcaagagcaacctccctctcaccaaaatgctgatcaaaacccagacaatagtcttaaacaaggatacaaaaggccagtaattattcacagagcaattctcggtagtgtagaaagaatgtcggctgtaattcttgaacatacaggaggaaaattacccttttggctttctccaaggcaagccattgttctctctatctcagaaaaaactgttgaatatgctaaatctgttgaaagagagctttccagaagaggttttgacgtttctggagattacagtgctgccaccattaacaaaaaaattagagaatcacaacttttgcaatggaactacatgcttgttattggcgaaaacgaagcaagagacaaaaaagtcactctccgctgcagagataccactattccccaagaattacttactttggatcaacttattctcaagttctcttctatgggcttcccttcaagtatcgactcaaattcttctaaccaatga

SEQ ID NO: 3019 - DNA, 243 bp, Cryptosporidium hominis
atgaatagactaattgataatggcttaagtcctgaatttattaatagtcagtcggttgattcattaagagatatgttatatggagttggattctacaatactaaagcgaagaatttgaaagaaatatctagaatcattattcagaattattctggtaaagttcctgaaaaatacgaacagcttgtaatgttaccaggtattggaccaaaaatggcaaatttaattttacagattgtaagttaa

SEQ ID NO: 3020 - DNA, 4671 bp, Cryptosporidium hominis
atgaggtggaagacattttcatttttgttagcatttttgagtatttctctgatagtaactgcaaaagatggtgaatcaaactactacttcttcaagaaggcaatttctagctcaactttagtagggagcagttttaatggagaatttgacccatcaaatgcattgaatatgggaaatagcgagtggaggtctgcaagtaacctctcaccagaacaacaaattgtttacacagcttttatctcagcaacagcaaaagcaattggtttgaaaatagtttggagctcgagtccaagagaaactcaaatccaggtttctcctgatggaattaattatgaaattgtagttccaaatagaagagcaactcagaacgagaaggaatttactgaagacttcatgtttgaccattcaagagatgtgagagcagtgaaaattcaaatgaaggcaaagccaagccaatacattggtattagacagctggttgctcttggatcaggctctccattagcgatgattatatcgggaattacagacgagaaaggggacaactgcttacaggttattggaggtagagttcaggatgactttgctcaagtagatttagattcatgtgtatatggtatttctgcaggggatggaagagaattatggaaaatgggaccaaatggacaaataatcagtgcagcaagtaatcccccaaaatgtttgatcgtagcaaatggggacttcagtggatcttctcctttgcttattcaagattgtgaaattgcagaacaggctgaagatggtcgattattctgggagtttaatgaaaattctcaattacaggtcaaaggaacaaatgcatgtgttaatcaaataaataaggcaggtttcggagttggaacaacaaagctggaattgagtggaacagcttcttccacaatggatgcattacatacagtggatgcagcaatagatagtgatatagcaacatattgggcatcagcagcttttgaaagtactggtgaacacaaagtttcaatcaatttgtcagctaatatgacttatcaacttaaaaatttaagaattgattgggaatttcctccatttacttattctatcgcagcaaaggtagatggcgaaatgagacagattacaaaggttgagggtaatccatcaaatacaacattgaatgagatgaacggagtaatttcagatttcattcagattgtcatggaaaagccacatccaagatatggtaaatactctaacaaatatttgtatggtattagggaaattgaattaatgacaaataatttaagatctgtggtttcattctgtagagatgctgccttatcaaaagatgcaagagataaatactttttgaattatgtagaagattttgattctaagggatctgaaatggtaaagagtgcagctagagatgttatgtccagaacaaaaaaccttggagtgttaaatgatagagttaatactttgcttccatcgattgatgaatgttttactgataagaaagaatatgtatcccgtttagaagattatatttcaaatgctaaacaattaaaagaaggtttaggagcagttaaggaggaaatttctgtcggggttggaaatgagccaggagatgagccaaatatcccagcagaagattgtttttcaattgcttcaagaaatccaaatgcaatttctggtttctactggatattaccaagatgtgctccagagcctattcgagtatggtgtgatattaagtttggagcatcatattatatttggaatgatggtggaaatccaggatcatatatttcagtcacatctgtttcagatataagaaagtactgtgcacatgttggaatggagccattagtgcttaggaatattgaacaaatttctggaatcaagagcgcattaggaattatgggattcaaattatctgaaggtagcggtattccattggctgttgattatggttgtttagatggaaagtgcacaggatcatatcaagatttaagagatggaacaacagatctgtccagcttggttctctctttggcatctccagaatctactgctacaacattatttggaaatgatgctgtaggacttggattcagtgaaaattatttaagtttcttcaacttaaaaaattcaaatattgttggaattgtttgttcaacaaatgtggtaccaactcaaaaacaaattaatcacgttgatattgattgtgacactgttgcatacaaaaatccaatatttgaaggaccaattaatacaaacatcgttgtacaatgcccaccaggttgtgcagagtataaagccaaggtatatggaagcgatggtatttactcagaaaagagttcaatttgcaaagctgctttacaagttggagtaatttctacaaatacaggaggaatgttcaatgtagctttggaaggtccaaagaattcatacgaaggatcaactaagaatgaaattgagtcagaaaaattatcagggattccaactagaagtttaagaattagtactatttcaaaagaatgtccaattgatgttatttcaaagggaggaaatgatctacatcaactctctactgctacaactctgaatcaacaggcaaaacaaggacaaaaattacaaaatccagttaaagcctccactccagttatcaaaacagatttgtgggaaggaaaaacgaatgagcctttcattagtaaaattttgaaggaagcttcacaatatattgatgagtcatatggtgtggatccatctttaagttttgcaactcaagaagagtcaaagatggcaatattagagatgagaagaaaactgaagccagcagaaatgttaacaaaatcacaatcaccaaagataatggatgttgttgataatgtcgatcatattgcaaacgagctattaaaggttactggtgtatataaatcaataactaaggaacttcttgataaattggacgatgtcgaagcaattcactcttcacaaactggattccaaagtttcacattagatacacagaaaatgccatttgaacaaacattttccgtatatgatatgccaagaacccaaagaggaccaagtgattggggttatacaaccacagcaattaatggaagaactaagttgcttggacagaattctccaatcactggttcatcagaacattcaccaagaggaacctttgcacaaattaaaaacagaagattctttgattttacattaactactgaagtctatccaccagtctcaggtatttttggtattgcatttagagttagagacttatctaattactatttgcttgagttcaaccaagaagaagagagaattagattattaagacttaaagaaggtattacttacattttagatacaaaagaagatttcaaattcaaagaaggagagttccaaaaagtagagattacagtacaaagagatagaatttacgcaaagattggagatattaaacttcaagttgtagatgaaggcttactttcaggtactgttgcattctattcaaatggagtcgttggcggcgtatactttgataatgtttcaattaaggccaaatcttgcaaaaaattcttcatgtcaccagctccaagatctccaagatgctcaaattataaacaatgttatttgtcaacatttgagacaacttatgatattgttaacactaacgatgttaatggtaactgggaatatattaaagaatacaagggaagaaccaatgcaatggttgtcaagacatctggtgaatctagaatactcttaaaagaaactcatacttgcaaaaatggttatttctccttcgattttaatccaccttgttctaatggaaaggtatccggaattttcagatatactgacaatgataattattatcaggttattgtttcaaacacatcaacaactttggttaagaaaactaaagctaaaactactctgttaaagaaggtcatgtttggtttcacacaaaatgaatggaatcgtattcttgtaaactttgaaggtacaacaatctatgtttactcaacaaagtacaatggaaatactaaggagattattaaggtcaccgaaaaagatactcaagtctcacatggtagagtaggactgagtgtcaaaaactgttctgaaacagcctttgataaagtctcacttgagcctttcagagttgactcgaataaagacgtcgaaaattctacagataaagaaaaaactgattctatctataaatcttgtactttgaacactcatattttgcaaagagaacaacattgtgaaactatgtttggagctaattcacaaaagtcggtcacttgtactaataactactgtactgaatgttgtgattactacacaaatatgattacagacaaaacatactataattcatgcaagagtacttgttcaattaatgatagctatgctgaaaattcaacaaaggaatacattaatcagctcgctacatgtatttctggaactagtaaagcctttgacatttgtacagaaactgatcaaaagtgcaaaattgaggtttgtgatttatgttgcaatagtgcattcgatggaatgcaaaaggatatccaaggaatagttgtcaaaggttgccagactcaatgcagtcatagatttgataccgataaggttttggcctaa

SEQ ID NO: 3021 - DNA, 1359 bp, Cryptosporidium hominis
atgtcagattcctcaatttcgtccgatgaaagtgactgggatcattcctggggatgcccaggagatttctcggatttaccggtgttgaatcaagaccacagttacccctatatgttctcatcaagttggtattccccagaagaccaagaaaagaaagaacctgtataccaaacagagttttattcaaataatataacaactggttttccgaattcagttaaaactgttcctgggaatgttgtggagagtgagaaggaagatgttacgccagattacctggataattcggaatttaataatcaaggagtcaacttctttgactcacagattcctaattgtagaagccaaagacttcaatataatacaaagttatgtattgagtatattgaagatgatatttcaagaattatgtggaatctggaacagcaattccaagaatgtgttttaactaaagactctaaaagacagagaaatcacggattcagtatcgaggaagtgtctgaaattgattctgtcgagcaaaagaagtataaactgagatcttacatcagcattttgaggtatatcactatgatgattgaaagttgtgcttcaattgaaattcaatgggcaaaggatgaacttgaaatgacaaatttgcttcgaaataatattagcgaagcatttatgaagcttcaaaaagttaatttatctaatgagagttcaaataatgatgctgtgaagtcgaatgatttacaaaagaattcaaattctttaaaagtccgcaaaagtaaacgtattcaagcaaaagttcttgaggaagaagtctgtacagttcaagctggtagtccaaaaattgaggtcaatgattttcactctatttctgatgaaacatccaaattttgtttctgtaaacaacctgtactagacaacatgattagatgcgaatctggaaatcaatgtatttatggtgtttggtttcattttctatgtttaaagataattaatgaaccacaaaaaacttggtattgtccaggttgtactagagatgaggaatatcgagctttgtggtctcatatattccaaagggaagctttaaagaaatctatagaagctaatatctcaaaaaatcaagatgaaactgaggcaaatgcaacaccaattttaattaattcaaagaacgaaaagaagaaaaatagttgtaaaaaggaaagaaagagatcaaagagtgtagatgggtatcctaagaagaagcaaagtagaggaagcttttttgatcgaaataatgaaatttcaaattacactgaaagtctcaacaacaattcatatgaggaaatcaagagagaagctgaatacaaagaaatcccacaaaatatttaa

SEQ ID NO: 3022 - DNA, 1218 bp, Cryptosporidium hominis
atgaacttagacgaaagagatgactcggttacggaggagattggtagagatgacattagaggtgccaatacaacatcggatgatgctttgaatcctcatattccccagttcattgctaaggctccttggtatataaatcagcaagaaagcagcttagagcaccaaagacttagggcagatgaggcaaaaattgacttggatagtggtataaaaaagggagtgctcggagtggttcatgtcaaatataggaaaggagcatgcacaaattgtggttccatgactcaccaggcacgtgattgtttggaacgtccaaggaaagtaggtgctaagtggaacaacttggatatttgcccagacgagataattccagaaatcagaaaaacaactaatttagatgaaaagagagataggtggagaggttttagacccgaggactacaaaccgataatagagcaatttgaggcagtggaggaacttgccagacaaaaaagagcaaaaaaagtggaggagtccttgtcaaataacaagaacaaccctgaagataagaatgaagaattagatgagaaggatgagctaaagttgggagactttgatgaaacaacttttggtgcctcatcagataaaaccaggacaaatgtaaggaatttgagaattagagaagatactgcaaagtacttgcgtaatttggacctcaactctgctttttatgacccaaaaagtagatcaatgagagaagatccatttcacaaatcttcaaatatcggtaacacctataggggagacaatgcaattaggaattctggagaagtgtcaaagatactcctcatggaagcatttgcatataataaacataaacaaggggaaagtatacacctacaagcactgccgaccagatcagaaatgttatataaatcaagtatattaaacaaagataatgacaatctcaagaagctagaagaaatttccagaaagtatgaaagaaataaccagtccagcatctcaaagttagagttaactgaaaggccaacaacagttggtgaccttagtagcatgaatacaaaaaccacaaaaaaatttgtgtcttcaatttacgttgaagacgaatatatatcgaatcacacccaagtttggggctcttattacgatttggaggccaagaaatggggttttaggtgttgtaaacaaacatgtagattctcaaaatgtactaatatttaa

SEQ ID NO: 3023 - DNA, 3144 bp, Cryptosporidium hominis
atgcttgggaacaatattcatgatgtaatcaagagagcgaggtatctagaaggtttaattgaatgctctcctcctgggaaagatttacataactttgatgggactgcgattataagactccctccaatttctgaaggcctggttacccaaggaaacacaattacccaattccctataaatcttgacaacattgtattgaggggatgcatccttaggtcaacagaatgggctattggctgtatagtatatgcaggacatgagtcgaagatccagatgaactctctaaagcctactaaaaagatgagtaatgttgataaattcacaaataaaatggttttggtagtcctggttattctattttgtctctgtatgacaggctccctgctaacatataaatacatatttgacggagtattcgatcatcttgattaccttggggtttctgacgttaatgagatatcatatagagccactggccaggccattccaatttcttttgtccctgttgttagattctgtacttggatcgttttacttgcaaatattatcccaattgctctagtagtctcaatgaagattgttaaggcgattcaaggccagttcatttctagagatagagcaatgtatgatgcagtgaataagacttatgctgttgctagaaattcagacttaaatgaggatcttggacaagttagatacatcttttcagataagactgggactctcaccagaaatattatggaattcaaatcattgagtgttggtggagttcactatggctcaactgaaacctcctcttcaaaagaggataatttaatcagggaaatagaaattcctcaggttaatatcaaagatgagaatatatttttggatatcaagtccagaaataatcagagcatcaaaattggaaaccttttgattggtattgcagtaaacaattctattgtcattgaaaaccaaagcgagatgtttagcatgttatattactcaggaagaatagaacctgatatccttccagagacttcctcaccaagtacttatctaactggattaaactcagatattactttgaatcctgataataataagcctaagcctaggcttggatcaaattttatgacaagcatcaaatcaatttcaagtcaaagttccaaatccgcatcaaataacagttccaacacaagacagaaacctaaatcaaattttcccctatattcagctcaatttccagacgaagctgctctatgttatggagcacagtacttgggggtttcccttatatgcttaaatccgaaaactaaacatttgatattggatgtttttggagaacttttggatgttgaaatacttgcaaagattccttttaccagcgataggaaacgaagtagtacagtagtgagaataaaaagactaaatcccgaacataatatgaaggacctcggcattatgtctgagctttaccgagaaaggattatggttttttcaaaaggagcagattctgctatgattcctttattgagacagtcaaatctagagaaattccagaaggatctggagattggaaataaaatggctaatcaagctttgagagtcctctgtattactgaaaaggagatttcggaagatgagtttgcaaattggaaccaaaaatatcaattagctgtgaacaatgttgaaaatagggaatcatctctacaggaagttgcttctatgattgaaaaggatcttttacttcaaggggtaacaggagtcgaagatagactacaggatgaagtaccagaaactatcaaatgcttgagagatgctggaatcaagatttggatgctcactggagataaggttgaaactgctagggaaatcgctgcttcagctggattactgagtcctggacatgaaatcttagaactcacagaaagtacatgttcgaataaatctgaaattaagaaaagggttttaagtatctgtaaatcattaggcataaacttagagtcggacaaaagtgaaagattcctaaggaaagttaaagctagtggttcaaaatctgaaaagaaagaaactaacttttcaatacttattgatggagctgttctggctgagattttctcagggtcacttgcaaacaatgattttgtttcagaatgtaaaagatttgaggatattacctccagtataagttcaattgaaaagctttttgtacagatgtgttgtaagtgccgtactgtagtttttgcaagatttgcaccttcacaaaaaggtaacattgtcaggattgtgaggaagcatatggatgaaataactcttgcagtaggagatggagcaaatgattgcaatatgattcagacagccaatgttggaataggaattagaggactagaaggtaaccaggcatttttaactgcagattatggcataacatcttttaaggacctaaaggtgttgcttttagctcatgggaggcttgcatatagaaggatatgtaaattggctttatatatgttttacaagaatctaacagttggtattcctgtttttatttatggatttttcactctttggagtgggactaggctctattttgactattggtaccaagtttataatgtaattctttcttcagttcccattgttgtagtttcagtatttgactttgatgtcacaaaatcagaatccttatctaagccacatctatacagtcttggccctgaaaacaaatttttgaatacaaagatttgtttaatttatctactcaactcagcttggcatatctttgtcgtctttacaatcccatacatactttttagagttaatagcacaaatttgtttggctcaaaccagtcaatagtaggagcagccatttattatttggtaatattagttgtaaacatcaaagttctattaatggctgaccatatccactacttacttggatttgcggtggcattttctttattcagttggatttgcactctttttgtttgtgctgcttcgttttcaattggaagcgacgtctatacgatttggattcccttatataataacattcttttttggattaccctgatttctgggcttagtatttcgctttggccagactacttttttaaagttttattcagtgagtggctccaagtagatgataagtag

SEQ ID NO: 3024 - DNA, 321 bp, Cryptosporidium hominis
atgtgtgaaaaaaaaggtttaagccttccaccgaagaacgatgagcttagaagagaggaaaatgagtcgttaaaaggtgagtcattaactctaaggctcaatttcaaggatctggatggaattgttgaggagcttagtgtaaattcttcaactgaagtgggatttgtcaaacttttgatagccaaaagtaaaaatgtacaagcaaaggatattagaatattccacaacggaaagaatatgatcaatcccatgtcgctgtgtgaccatccaggtgttttacctccttcagttgatgtagatgtttatcttaattcagtgtag

SEQ ID NO: 3025 - DNA, 2340 bp, Cryptosporidium hominis
atggagatgattattaaaaatcttacttcagatatccaatctgtgagttttaaccaggttgactccgtttcttttctgattgcaaagtttggacaagcctccttggcagaaaagagaaagctactcaaatctagaaacgcctctttatctgattcgaatcttttaatttccagtcattatatcagatttgttgggtctattttagaatgttctgagattatgtatttcaactgtaagtgctacaagccaacagaatctggaattcacagggaaatattcctgagaaactcaattcttcaaatttttagaaactttacagatcttattgggagcaatagtgggggaactcttaatatccagactgatgaaactagaaagattcttaacaaaatccttgatgtcttactctctaattgtgggtttcttaacccacactactcaatttcctaccaatcttccaagtcagttgtagggatcaccaaatcatttagcaattgtctttttgattatattccgaagttggtactattactgaggtcacatgagacattgagtctgatacttaagcttgctgaaaaaggtacaattgaaaatgaatgtcttgagtcttttaaaagtggattgggatccaaatctttaaacactatttgtgaagcaattggtttcctcttattcagcaaattaaaatctagaagtaacattacagaacaacaagaggtggtccttcaatatgaggaaattgtaaagccaatgctagagttgtctcacaagctaattgagcagatttcacagaattctggtggaagtgatagaaaaaatgaccttctaaggtggagaagtgcaatggaacttgttcaaatgatttcttcaatctcagatgctcttactgaacagattccagctttgtcccatctttggagagcttctctgaacattcttttgctgctcgcaagatgttcaaacttggttttaatctcagaaagtggtggagttcagatatccgtgctttcacctatgcataggtttatacgaatcatgggtcctgaaatttgtaattacatagttcctatttgtagctcatttttggcatctttaattgattctgagaataggatgcaaaaggcattccaaggatcaagatactcggaggcatgcgaggaaatatctcatttaatttgccatttggtaacattacatggaaactcgggagactttacaaaaatattcgagacactgattccagaaatattcctatatattttgaaactatggttgttatgttggccatcccctatatccctttgtagcatagatgagagatttagacaaacagtattagaggatatagcattctcagtggaagctcatcaagccagaatgtccatacaactttcacttgtgaagatcattaaccagctttcaaagggaaaaacaagtctcgagcttttagcaaaattatgttctactcaaggggaaaaaatgagtgaggcaaaacaaatactaaatcaggtaattctaaatccagtaggagtgacatctaattttgggataaaatcttatgtaaatttggttccttcggcttttttgtttagagaagctttggccagcattcaaaatcccattctatgctttctaatttcaagcttacttccatctctctcgactccaattcattggctcgagtataatggagataggcatttattcacagagcaagatatttacatccaatcagttgaggtaattacaagcatatacttgaaaatacttacttgttcagatctaaactcttcagacatgtcacaagagcttaagaagattggaattgaagtttctacatccttcctatggttttcaatattgaataactctcaaaaggaagaatcattgctaaactctcagctgacgtttcttaagctactaattaaaggggaagctcctcttgtccttatagagaaaaactccaataaacaaaataagagaacaactcaaataggccaaaagtatcaacatggccaagatacaagttctattattgttcctttgaatgtggtagtagctacaagagatttggttctttctgggactaaagcggctttcacacaaaataatccaaatggtgttaataacccagatagcgtttcattcgcaagaagaagtatttccttgttttttgggtatcactactttgtactcctatcatttatgcccggtagtggacttctagatgagacatttaaactattgaatgagatttctcaaacaaatgaccttcaatttaagcaaattctgaggaagttcatagaaaactaccaatcatatgttagacaggtattataa

SEQ ID NO: 3026 - DNA, 2745 bp, Cryptosporidium hominis
atggaccgtacaacttttatggatggcttaagagccttccatgaaagtcagggtcgagcatttaggccccaaaaagtatcaggccacactttagatccatatagaatgtttttgatgatagttgcaaggggtgggtattctagagtgaataagaattccagatggtttgtttttggaaaaccgatgggaattgatattccagaagggaagcaacaggaggttgggtttgggattaagaattattatttgaactggttaagggagtacgaaaaggcgttggacgatagtataaagcttgcaatggcagctgaatttactgctaataatccagacctagttccaaatcccagccttgctttgtcttactatacccaaacttctacttctagtacaaatgaagaagcacctttaactcgttctgctgcagcttccctatccagaactagaggaggaagatctaatgaacagatggagaactcaaggatggagaagaatcaggtagtttcagatccttcacaagtgattgactctgctgacgctttatatttggttccttgcgaaagtaattgtcttcataacaaaccaatatctcccaaaaacctcacaatttacgatattgaagagccttattctccaaagtatcctattacagatgatttatggtatttgatggcacactttagaaatccagattcaaaaatggaagacaaaattcagattattaacaatctaatggccattgcagctaataaaagactaaacctaagcagttttccttcaattttaaatgaattctctgaaataatgaccgtttgtaccttttcaattgactctcaaatacttagaaaggagaaacttcagagagagaatcccctcgacattaataaactgaaattaatgattgaaaagagaatttgtctattggatattgctttaatccagaagcatcttttggcctcttcttctaatttaatttcactaattcttaataacaaggaaaacctggagttcatttacgaagtcagtagctgttctaacattggcaaaaactttcttagaatctcaaattatctcggtaaccaacctgaaaatgatcaagaagcattaaaccagaacggaaatctttcaaagatgaacgattatcctaatcagtcagttcctgaatctttatctcattcgaatacgctaaaaacctgttacttgaggattcctgaagctgttaaagctcttgaacaaattaacaacttttatacagagaactctattcagaataaagagttgaatatagtccacttaaaggcccttttaactgcattacttacggttttcagaacaagttctggaataatattttcatatgagagaaaattccataatgaagttcttcccttagtcttagtatcctcgaattatcgtcaaaaggcaaatcctcactcagagaaagttattattaagtttaacacaagttctcaaatacaatacgaatcagatagtaaagaaaatagttataattatgatgattttagcctgactaaggaaattgatccagattcaatgaatgagataagcttcaagaatgagctcagaaagagaaccaaaactatgaaacataatgatcctgatttacttgaccaagttttagaatatttgaattctgaaacaagatattcctgggctatcctttcttcaacaataaattctcttaaccatctcattcccgttgtttttgatgaaaaatttgatgaggtattgaaccttgtgaacagctttataatggagattttcaaatcctgtagaacatgttctcagttttcaatcccatcattgacaaattgtatgagagaagtgaggaaaaactcttgccttcttccctgcttaatttataataaagaaggaataaaatttatatcagatattctagaatttgggtgtaatgtgattttaaacattacttcaggacaagctcaaagcaaggttaaatgcaatcaaaagctcttaaattctttttttcagacaattttaaagctatcatcaacatgtatcggattttactcattccttaaggatgaagagaactttaaatcgggtttattttcttcaaatatcaaatctataaaatattcgtttgaggaattggttctaccaatttccctagcaactttagtaactatttcagaacatgtttcctttgggagaatcttccaatcattttctaatctaaattaccactatcttcatcaccatacccaatttactcaatccctaattgaaaaccagtctagcaaccaagctattaaccaagaaatcttaaatataagcgatagtaatgattcgtttgttaaagatcaaatcttgattctttggggaagagaaatcattggtcctgtttttgagctacttaaatcagaattagatgaatttgctaaaaataaattggaaaaaataccagtttcttgtttaatgctttctcagtatattatttacatatcatcagaattaatgtcctggaaaaattctcagaaggatcccaacttacagaaattacactgcaaatcttctagagaaattgcaataggaatcctttctccattcattgacattttaattgaacttgcatggattccctctacctttagaaacctattctggtccattatttcagaaatctctaactttggagtctcaaatccttctgtaaccctaggtatctctaaatttacagttgaaaatcactctacagattga

SEQ ID NO: 3027 - DNA, 3691 bp, Cryptosporidium hominis
atgaggaaacaaagcatgaagataccggtacataaaaccggagatctaaaaatgattttgattagtttatcaggaattgcaagaatttgtttgacctcagttcttcttttttttagtattccaactaactctcagtatgtgagagtacctgtggagacctgcccaggtaattttgcactagtaaatggaatttgtgttcatcaaattgaaacacaaaagattccagtttgtccagaaggatttgtatccaaaggatcagagtgctatttggctgagcctctccttaaagaatgtcctacaggttttcaaatgcaagacaaacaatgcgttaaagaagtctttgctgaaaaggaaaaatattgtctcgatggcttagaaatggattataatacaggtaaatgttactacaaagaggaagttaaggcaatctgtcctccagggagcattaattttagagatacctgtgcgatggctagagagccgatgaaaatttgtcaagaaccatacaaatttgactctaacacaaatttgtgtattgaaagaaaggcagctctcccaactgtagtttgtccggaaccttttgtttttgatacttctttaaagatgtgtattcaagatcagattgagccaaagatttgtcccgaaggatttaaggatattgatgaagataaatgtgctacatggattcaaccagaatatatttgtccaaaagggactcagcttgagaatgttagacaccaatctctttgtaggtatgttaactattcaaatcctacattagagtgccctcctgggtcttttttagagggtcagatttgtatttcaatgtccagaattaataatagagtttgtcccataggatttgttgaagttgaagatcaatgtgtaaattaccaggaacctttgtttcattgtccagagggatatgagcaaactattcataatggtagcaaagtttgtttaaacactttgtcagttgaaccagaaatatcttgtccaaataagcattcatactttgatgaatctaataagctttgtatttcagaaattaccttagaaaaggaatgtcctgctaattctttcagatctaaggatttgtgtttacaaaaagtaaaaggagaatgggaatgtcctgctggaactaaatataacccagaaaaccatttttgccaggaaatattatccattgaaccaaatattatttgtcctccaaattctaaatttgaacaaagtacttcgacttgtgttggctatgaaagaaatatccaagtttgtcccccaggatacgaagagattggagaaaacgaatgtgctagttttgtatccccaagaagaacctgtccaaatctccagagtttagtgaatggacaatgtgaagaggttattctatctccagctgagacattatgtccctcgggttcagaattatctgactctgtttgtattttaacgagtgagaatacttcaaaaagaaaatgtcccttgaattctttagattctggagattattgctcggttatagaatccccagaaaagcaatgtattgaaggatacaaatataatcctgaaacacaaaagtgtacaaagattactacaagatctccagatttggtttgtcaagaacccagtaccttaaattcactaggagaatgtatttatactgaagttattccaaaaatatgcccaaaaggatctagagaagattcgaaaaatgagaatttctgtattatagaaactagagccaaatcaaattgtccggaaggatattctttaatagaaaataaatgtataaaagagaaaagagctgagggagagttaaattgtccagtaggatatgaaatcaatgaattggatatgagttgtcataaaacagtacaaagaagtaaaatttgtcctccaggatttttggataacggagatgaatgctttaagacctcaaaacctagttctttctgtccagaaggatttggaagggaaggaaaatatggagattgtgttcaaattaatatttcagactcaaaacctcaatgtccagaagaaactattggacttgattcaggaatgtgtggaggaagaaagcctcttcctcttgaatataaatgtctcaaaggaactaaaattggagattcctgtctggttgagagttttatagatgtttcttatgaatgtcccaagggatattatttgagtgagatcaaacaatgccaaaaattagttgaatatgattgttctgaggtaagtattgttcctgttccttgtggaagtggagtcaatactataaatacttctaatcttggattttatggtcaaagaaactcaggaatttgttctcaagccataagaaatcataaaacttgcactagaactgaggcttttcctccaaagatttcttgtccacagggatcaattaatattggaaaagagtgtatgaagaaagaatatcttccaatgacaagaatctgttcagaccatacaaaaaccctggaaacgtgtttcgaggaatttatgatcccaaaagttaatatttgtcctccaggctctagcatgactgaagataataaatgtgcctctattgttagaaaagctccagaattaatttgtgaagagggatatattatggaagaaggaaattgtattcaaataactaccaaaatttgtcctccagaaggttgtactttgagaaatatcatcgattcaatacgaatttgtcctccaggatttgtttttgaagatggggcttgtatatttaagcatgaagtctttccagaaaaagcctgtgaaaaaggagaactttctagtgcaaatcaacaaatgtgtattgaaagaattgttaagatttgttcatatagtaattgtgaaattgttcataaagaacccccagagtttaaatgtgatgagaatgaaactctaaactcaaaaaccaaactttgcgaaaaaattaatattggacctcaaatcttgaaatgtattaaaccgttcaaattagtaggagatcaatgcgttcaccaggtatctaaagaatgttcaggaggaaactgctcagttactatttcaattccaccaagaattacatgtaagcaaggaactttgatttccagaaatcaatgtgaaagtatcaaaagaagtccttctattcttacttgtcccaaggatttcactattcaggatgatttgtgtgccaaatatgtctataaggaatgtttgaataatcaatgtgagaaaaaagttcattttcctcctattattgagtgtcctaatcagtattcacttttccctggaggaaattgttcaaaaagagttcatcatcttcctcaaatgaaatgtccccttggaacaaatctcatgaattcttattgtattagagaggttgaatcgatttgtccaagaggaggatgtttagcccaagaaactttccccccagtcttaagttgtccttctggattccaaaagaactctcaaaatttgaactacggaggaccaatttgcacgaaaaaactatttaataatggagaaatctcttgtccaaaaggatctattatttctaatggaagttgtctcacttactcagtcaaggaatgtcaaaacaataattgtgaagaattgaaaacaataactcccaataaagtttgtccaaatggaacagaattagttaatggaaacacttgtaaggaatccgagattgttccaaaag

SEQ ID NO: 3028 - DNA, 891 bp, Cryptosporidium hominis
atgattctgttcgggattttgttttgtttttttgttacgacattcttttcaatttcctcattattctttttgttatgtttggttattcgtagaatttatatgaggaaattaaataattatgcgacaacaaggaatattgttgttttagttattggagatataggtaggagtccaaggatgcaaaaccatgctttgtgtatttccaaaagattttgctccaagttggattctctggggaaaactggaaagctaataaatagaaaagggaataaagatattaaccagaaactggacgacaaaattaataataaccacgtttatttggttggatataatgaaactatttgtagttcagctgtgactggggacaaaaatattactttacaaggtattgagaaaactcttgtggatcaatacagaaaggttctcccattgtgggcttttctattcataaaagtaattgaacagtcattgaggattttcataacaatcatgaaaattccgaacctctctgggatagtattacaagctcctccatctataccagcaattcctattgctttgttagtttcttatattaaaggagctcatttaataattgattggcataattatggccatactttgttaataaccgataagagagagaatagtcaattctctttgataaggagaatataccaacaaattttggttaatagttacaaaatattagagttctcgttaggaagactttcacattctgcattttgtgtttctaaagctatgcaggaagacttagcaaaaaggggaattcaagcaacagtggtatatgataggcctaatgatgaatttaaacctttggattctatttcaaaggagacattctgtcttgttcaaatattttggtag

SEQ ID NO: 3029 - DNA, 621 bp, Cryptosporidium hominis
atgtcgaattcttcaaatcagtacaaaaaacgttctgaatatcttagaatgggagaactcgcctttcaaaaaactgaaaagattaatggggaagttttctctcttatgtacggaagtttagttgctcaatttgttaaagatcttgataatgctgaactaattaattcaaagcttgagaagattggatataatattggtattcgtcttgtggatgaatttcttgccaaatccggtatttcaaaatgtgatagtttcagagatacagcagaggttatagcttgtgttggttttaagatgtttcttggaattactgctgaaaccaaggattggaatccggaagaaacttcatgcgttctagtattcaatgaaaatcccttggctgactttgtggaacttcctccttgttattcatcttcattgaattatagcaatatggtatgtggagtgattagaggagctcttgaacaacttcaaatgcaagttgtatgctactttgtcaaggatattctaagaggagacgcaactaatgagatatatttggagctaaaagaaagattacaggaagaattctttgatgatgacgacgaggaagaggatcaagagaacgagtataaggaataa

SEQ ID NO: 3030 - DNA, 1965 bp, Cryptosporidium hominis
atgttccgtaataaattgtttttgaaattctgtttcttatatattttatattttttcaccttttatttttcgatggttgttacaatatctttaagaaattcaagcaactcaggaaagaaattggacttggaaggtttaaaggaaagtcttgctaagggtggtcaggaccacattttaaatttgttagagtctggggattctgataatgtaaatagactaatttctcagttaatgactttggaaacttcgtgtgtgggtggtgggttacttggatatattaacagagctaagaagttgttgaaagactcaaaggatggtgttaatccaagagaagggtgttatcctgaagttccagaggtagttaacttagatgttggtactgaagactttaaaaaatatgaggaacacggcttttctgtcctaaaaaatgttgcctttgttctagtagctggcggtttgggtgaaagacttgcatttgagggaataaaaataggaatcgagctgtcaatggcttccaacatcacatttttccagttatacacaaactatatcagggagtatcagagaaggttgaaggaggcttttggagaagatattgtgattcctttgcttatcatgacatctgacgatactgacagtatgactagaaagtttttggaagaaaatgatcattttggcttgagagaggaccaggtgtatatagtaaaacaactcaaggttcctgctttgatagattctgacgcaaagattgcattggatcccgaagacaaatactcaatcttaacaaagcctcacggtcacggagatattcacactttgctccatgcttcaggacttttgaaggatctttttgagaaaggagtaaaatttttggttttcatccaagatacaaatgctctagtctttaattcagtacttccagtattgggagttacatcaatgaattcatttgtaatgaatagtttgacaattcctcgtattccatgcgaggcagttggggctttgtgtaagctcagatatccagatggaaagaaaattactatcaatacagaatataaccagctcactcctttactcaagagctgcggtttaggatcagattttgctgatgaaaagacaggttactctcctttccccggaaattcgaacgtcttgttcatttcaatggattactatatgaagaccttggaaaagactgggggagttgtacctgaatttgtgaaccctaagtatttagactcaactaaaacagcattcaaaagcccaactcgtttagaatgtatgatgcaagatattccactcttatttgaggctgactacaaggttggatgcgtacaaatgcagagatgggctacattctctgcttgcaagaatagcttggccgagggaagagcaaaacatagtgcaggagtctccatagataccgcctctataacagaaggcgacttctatgcagctgcctcacaatatttgagattggcatcaattgaaaagggtgtagtttgtagaattgaagagagtggaagggatccagtcactggaaaggatgataagaactctctaatcaaacacgaaatgatcgccggaattccagtcagagttggagcaatggttgttttgcacccctcattcgcgattaagtattctgatcttctccaaaggattcaggctggtcctattattattacaagtagatcctatgtgcatttagaaggagatgtggtgattagtggaaaattctttgtagatggttcagttagaattgtggcaaagaacggctcaaggattattattaagaatctcattgttaacaacagtggaactactagatatcatatttctgagcaggatatgggacatgcaactagcaatcaaaaaatcagaggatatggaattagacacgagcaaataagggaaattatcttggataacggagaagaagttattattgacgatcaaaactaa

SEQ ID NO: 3031 - DNA, 2028 bp, Cryptosporidium hominis
atggttttgatatcatgggaatgtgtgtgtgatctgacacatcctggccagtctttgtatgtggtagggagtcacccaagactgggagcttggaggattacaactgaggaagaggagaataagcctattcgacttattactgacaaactttcctatccagtttggaggacaagcgaacctattaggattcgaggtgcgtgtcttttagagtataagtttattatcggtaaagaaactgaaccgaacgagattttagagtgggagccaattcaaggaaaccgatacttacaagtcgacgagaattttccagaatataagtatattattcattgtagttggggaaatatttctaaaagcacgataaggtttgaagaatatttcggtaatgatggcaaagttgatgattactcatatagagcaaagcctggagcaaggtatatttcaccagaaaatgcagaaatgtactctgaggatgaagaacctaaagacagaggtgcttatgaaagctctgtaacacctccgctaatgttgagtaggacagggtccagattaagacttctattggacagatccagatttattttgagcaccaaaggtgacatcaaccaatattatactttggaaaatactataggaaggggttcttggggtgaggtgaaaatagctgtccagaaagggacaggaattcgtagggcagcaaaaaagattccaaagtactttgttgaagatgttgatcgttttaaacaggaaatcgaaattatgaagtctttggatcatccaaacataattaggctatacgaaacttttgaagataatactgatatatatttggttatggaactatgtactggaggagagctttttgaaagagttgtacacaaaagagttttcagagaaagcgatgctgcaagaattatgaaagatgttttaagcgctgtagcttattgccataagttaaatgtggctcatagggatttgaagcctgagaatttccttttcttgacagattctccagattctcccttaaaattgattgactttggcttggcagctagattcaagcctggaaaaatgatgaggacaaaggttggaactccatattatgtgagcccgcaggttttggaaggtctttatggcccagagtgtgatgaatggtcagcaggagtaatgatgtacgttttgctttgtggctaccctcctttcagtgcacctacagattctgaggtaatgcttaagatcagagaaggaacatttacatttccagaaaaagactggcttaatgtttctcctcaggcagaatctttaataaggaggctattgacaaagtctccaaaacaaagaattacttctttgcaagcattagaacatgagtggtttgaaaaacaactttcttcatctccaaggaacttattgctagataatgtaatctctaactttagaaggttccaaggcctttcaagattaaaaaagattgctttgacattaatagctcaaaacattgatgaaagagatatcctagatttacacgacacatttatggaattggatacaagcagagatggaacgctgagcagagccgagatcattgaaggaattaatagaacaggttgtagtccaacaattgggatcgatgctcttcttgacgaaattgatcctgaaggtactgatactatttcttatacagactttattgcagcttgcatccaagagcggcaaatgtcccatgaaagtgcatgcaaagcggcatttagagtatttgacattgatggagatggacagattagtaatatagaatttctcaaggtcatgtctctttctagtaaggctaagaaatcagacgatgaactagctcaagaactgagcgaatttatgaaatcaggagatttagataaggatggaacgattaattttgatgagttctgccatgtgatgagaagagtcccatccaaatttctccttggggaggcttctgatgacacaataaatatgatgaaaagatgttcctctagaactaacattaatttatag

SEQ ID NO: 3032 - DNA, 3951 bp, Cryptosporidium hominis
atggagaacatagaaagtgacgagtcaaaatccgttggaggagagcaagaaaaaccacgcttgattatccataagatagttctggaaaattttaaatcttatggaggcagcaaggttattggaccatttcacaagtcgtttactgcgattgtggggccaaatggaagtggtaaaagtaatgtaatagatgcaatgctatttgtgtttgggaaaagagcaaagcatatgcgcttgaataaagtttctgaactgattcataactccaagcattacccaaacaatgaaaaggcaagcgttgcagtgcattttaaagaaattatagatgtacctggagatgagcatgcctacaaagtcgttcctaattctgagattgtgataaagagagaggtacataaaaatagtgagcaaacaaaatactatattaatgaaaagctttcaagttatcaggaagtcattaagttattaagtggaaaagggaccgacttggagcataataggtttctaatccttcaaggagaggttgaattaattgcccagatgaagccaaaatctacaaatgccaacgaggatggcttgcttgaatatattgaggatattatagggagtagcagatttattcctgatatagaaaagcatttaatggaactagaacagtttaatgaacttcgtcaagaaaagttgaatagacttaaaatcgcagagaaggagcttaatactctgaaaggtccgtataatatggctattgaattctttactcttgagagagaaatttacattgccaagctattgcttcatttggaggaacaaagagatgctatgagacacttaaattcgttgaaagatgagcaaaacaaacatttgaatattagaggagagctagctcaccaaaagaaagccttagaagataggcgagctgagcttgaagttgagaacaaagagactaactccagagttaacgaattaaaggttaagttagagaaagaggaaaatgaatttaagaatatattactgaaggatgaggaactgagagccactttaaagaattcaaaaaaaagacttttgaaacttgaggaatcagcggaaggtgaaaaaaaacttataccagagttagagcaaaaaatcgttgatttggaagatgaagttcgaaaaaaacaaaagcaactcccaaagatctcgaaggaactcgactctgctcaggagaagctggaattgttgcagaagaatgttaaggatgggattgaagagtctagaaagaagaaggataaggcggagcaggagctatcgccactacaaaagaagcttttagatctccaacaatctcatgatatgttaaatattgaattggatatgttgaagcaaaggcagattcaaaaacaggagaacgaagaaaatagtaagagggagaaagaaaatactgttaaaaggattcaagctctaaataagcaaaataaggatttttctaagaatctaaaggacagcaaggctcttcttgatgaaaaatctaagaaacttgaacagctgcagaaagatctaagtgagaatagcagacttctaggtataaaaaaggtcgagttagatgaggcaaggagccttttagcttcaaataatcacttagaagctaaggtttctgaatcaaagcaaaaaggtcccaagatgtcattatcagagactgttatgaaatatttttctgcaaataaaaaaagtggagtacacggaagactgggggatttgggtcaggtggatgacaaattccagcttgctctggcctcctcagtgccgcaggttgaaaacattgttgtgcagactactgaagatgcacaagaagttgttaattatgtgagaaaatcaaatttgggcaggatctcgtgtattatcttggaaaaactttctgttactctaatacaaaatatggaaaaaacatttaaagctccagaaggatccaaaaggttctttgatcttgttaagtttaaggaccctaaattcaagatcgcctggtattttgcaatgagggacactctaattgtcgatgacctcgatattgcaaccaaaatttcctataatggaaagcaaagatggagagttgtaactgttaatggggaattgatcgactcaagtggaacaatgacaggaggcggcccaaatgtttctgttgcaaagaacgctggtaaaaagtcggaaaagacttcagaaattcccactcctgagcagcttaaaaaaatggagacagatttagaggcctgtcaaaataaatgcaataaaattaaatctgaatgcaaggatttagaagatcatgttcaaaaccttaaaaatgatattaatggttatacaattacccttgagaaaatcaagattgaacttgcttcaatagaagagactgaaaagtctagatctgagattcagtccgaaactagccaagaatctcctagtaatcaggccgatattatggcagaaacctcaagattagaatctgaaattggggggttgaaaaaacaaatctctaccctagaagcttctttgaagcaaaagcaaattgttgtagatcgcctcacaaatgagatgaacgaaattggaggcccagaaatgaagaaacaatctgaacttgttcaggaacttacaaaaactattggagctctggaaagtgaaatcagcaagagccaagtagaaattactttgtctgagaaaaagaaatttaaggccatcgaatccattgagcagtttgaaaataagtccaaggctcttaaggaagcgattgataagacagaatctgagcttgtttcacttgaggaagtcgcactgaagattatggaaagcaagaaattcgctgaagaggagttgaactcattcttgaatgaacacagttcattccaagctagatttgaagagattgagagggaaattgaaaagcttgagctccgtgatgtagagatatccaacaaactgaatgagatttctgctaaaatctctgaagttgaaagtcaaaatataaagcaactacaaaaaaagctccaaaaagtcagagcagatgcatcttatattccatctattccggaaatagaacctgaaaagagtgagcaaccagtgccagaaaaagattctgaattagagtctttaaagagcaaatttcttattcaggatgttcaggatgccgaatatgagaaaatacttggtgatatgacttctacaaaacttaaaccgcatattgagtctttgcaggcgcagctccaggcaatttgtgagcaatattcaaatggaggttccgtaaaacaattcagaccttcctcagatatattctcccagtattctagtcagctccaactctttaatagaagaaaccaagaagttgaagaagcaactaatgctagagatgaaagcaggagacaccttgaaactgtaaggcaggccagacattctgagtttatttctggcttcaaaattattgcatctcaacttaaggaaatttaccagatgattacccttggtggagatgctgaattggaattgattgatagtgtggatccattttctgacggtataattttctcagtaaggccaccaaaaaagagttggagacccattcataacctttctggaggagaaaaaacccttagttcccttgccctagtatttgccctacaccaatttaggccgtcgccactctactttatggacgaggtagatgcagccctggactttagaaatgtcagtattatcgcaacattcattaaagagaaaaccaagaatgctcagtttatcgttgtttctctcagaaaccatatgttcgaaatggctgataggctcgtcgggatttacaaaacatttgacattactaaatctgtctcaattataccgggtaactattcttctgatgttaaaagcaaaacctccgtttatagagacagagaaaaggcagaagaaggtgcaggagatgaaaatatcctggaaaatgcctaa

SEQ ID NO: 3033 - DNA, 612 bp, Cryptosporidium hominis
atgaaaattgagcctatatattttgttgtaatcgtctttattgctttattcccttttaatacaaatgccctctacttcattttaaatccaggctatacggagtgcattcattttcatgcaaagaaagcagaccatattgttggatcatttgagatagattcagcatatgagggcgttagagtttctctatttgaaaataaagggtcttcaaaaatttttgacaaaattgaaaatagtggagactttagtattaatgcctcgaaagacacagaatatcaactttgctttaagaatctaatgaattcggtgcaacaaacagtgaatttcagcataaagaacatggcatataattccaatattaacaatgttatgagcaatattgaatcaaaaaagctaattggatctatggagaagctatacgaaagaattacagttgcttctgagaaacagagatatgcccttacaagaaaaaggttccaaatggaagcaatagaatcatctagaaagaaggccgctatatggagtattcttgaactcttattatccttcggactggtggccattcaagtttactatatcaaatcttacttccaggttaaatacctagtttag

SEQ ID NO: 3034 - DNA, 2457 bp, Cryptosporidium hominis
atggcaaaaaagagaccaaatcaaggcaaagggacttcagggaagggcaagcaaaagtcgccttcaaatggtaagactaatgttgagcagaaacataaacaagaggagaagattgaagagcctcaagtaattgaggaaactccagcagttgtagatttttctggattatctgcaactcaaaagaagaatctaaagaggagattgaaaaagaagagtatggattcaaacccccaagagggccagggagctggaaaacaaagaaaaccactaactaagaaagagatcgaggcaatgctaccaaatgacccgatgtccaagacaagatcagaattcctttccaaaattaactctaatttacgtggcatgttagatctttcagttttgccaatagaggaggttctgagtaaaaagggagaacaggaacgtgaattgaacaggcttttgtcaaatatctcagagactttgtctaaagagtcctctaacttgaagaagccaccaaagcacctcagtgtaaacaccatttgtgagcagctccgcgacttcgagcttgcatccaaggatgaggaaggttatgacgaagaattttaccagcacttgaaggagttgttggtggtagcctcactctatgaaaactaccgcaacttccagaaccaatgtaacgagctgagaactagaatagaacgcaagctctctattaacaaggaactttcgcaggcggcagcagatagcaataagcaaaagaggctggtaaatagagttaagggtttgaaacaggattcttcaattgacaacgattctgttgaaacaaaagtatttgaacttccaaacaataaaggtaatctattggatgtattgttcggctccagcgctaagatggccaagaacctagagaagaagtttggggctttggttgagaagtcgactggtaactcggtacagattacagggttactgaaagatattgagagttgttgggaaagtattcgtcaattggacttcagctctcaggaaacaatttcattagatccacgcgttattaagaagctttactcgatgacagggaatattaacttgaagtcattacaggatgagctctctattatcatcaatcgtatggagaactcattgactattttaggttcaccagaatccacgaaggctgcagttgaaataatcaacaagaactctgatatttcaagcaacactgtctcaatttctgtttcactaatcattgctaaagctttacaattcaacttcctccccaccgtacgttctattgagaaggagactgaaaccagcgttcgcattcaatttggaggtaaatctagagaggtatcaagcttggcggacatttcagattctcaacacgacagcaagattttgatttttggaaagcctgataaatgtgaagttgccaagaataagctctctaatttgatcaagggtctggaagtagagagtatccaagctgatagcaaggcagtaaggaagttgttcagtccgcctggtaaggattcatcagacgactcaaatgcgagaatctctaggagcatattggatgaattctcaaaattgagggactctaacaagatgggaattgttagaatcggctcctccgttgtactagttggtccggcctccgagattaaaaaggccaagccaaatctactagatcttttggagagagctcaatacactccacttactaagacaattcatagagatcagctaagagttcttaaccattcaagacgtgagaaggtcgagaaggaagcttgcgtagaaatctcaactcataagagacaagagggacgtagtgttgtaattgaggttttgggatctgaacaagctaaagctaaagctggaactttaattgatgaaatactaacaaaagaagcacatctagagactttggagcttgattcttgcacatatgacaagctttatggtagtcaacgatcacacctgaggaagcttacttctaacttcccaaatgtacaagttattcaggcagagaaaaagaggaattcgatttcactccttggatcaaaggaagaagttttgaaacttaaagaaaagtttttagaatttaaccgacagactttggaaagttcttcaaatgaaaccaaagaaattatagaaattccaagtggaaagatgggactaatcataggaacaaagggaagtgtgcttaacgaaatcaggagcaaagctaattgtgaatcaatcaacgtaccaaaaaattccagccatgtagttctccagggtacagaagaacaatgcactattgctagaaatctaataagtgaaattctttcaaactctctttcaaattcaaacaccacgacatgcagcgaacaaagtggacctcattcgaacaagatttccgccccagaatcactcaaattcgacgaaaaatgcttccctactcttggaggcacaatttccacattttaa

SEQ ID NO: 3035 - DNA, 1710 bp, Cryptosporidium hominis
atgtctaactctgaaaagaatacttccaatatccagacttgttcttcagtatttgctagggatgagaaaaaaaatgtctcaaatacattttccacaattacgaacaaagcgacctcattaacaaagagtatattttctatctttaagttgtgttctcctttcaaaacagatgcgagcttgggacggccaaaggttctcatcttaggtactgggtggggatttatgaaattggccaaaggcttagacgtaaattccaacgatattaaagtaataagtccaaacaagtacttctgctttactcctctacttacacagattgtctcaaatagacttccaagagaagtttgtgaaatccctataaatgaactcacttatagagggaataaggaggtgataaagtatattcaagggttggccttagatattgataaagagaacaaagaagttatatacttcgactctgaaaagaaaaaacaggaaaggattccctatgattatctgattattaatgttggaaatgaagactcaagcattgttcctggtatcaaggaatacgcattatacttgaggaatgttgaagactcaataaagatgagagacgcggttgttaattgctttaaagaagttaacgcaaattgggacaaaatgagcgacgatgaaaaacgcaaaaaactcacatttattgttgctggaggaggacccacaggagtagaggtttcaggtgcttttgctgagttgaccaaaaacttcctttccaaaaatgaatacaagaagctggctccttttattaatattaagatcattgaaatggcaaacaagctattgccaacagctggtgataaagtttcaggatacacaaaatacgtacttagctcattagcaggaatagagatcttgttggagaccaaattgaagagcgtgtccaaagattatgtggttattcagaaagagggaggagatgaagagttaattccatatggagtttttgtttgggccagtggagcctctccaaactcattaacaaagcaaatttgtgataaagtagaggagcaatctttctttaaaaaggctattgtggttgatgagaggcttcaagttcatggaattcctaatgcatacgcactcggagattgcgctttagttagaccacgaaagttagcagagagatcaaaggaaatttaccaaaatgctctaaagtcgtctttcggtcctactgtcaaataccttagagataacttttcaattaaagctttcccccaaatgtttaacttatcaaaggtcgcagatctcccaaagaacgaggaaattctcacggaagaagacttcaagaatttacttgaaaagcttgattctatgtaccattccccaccacctacagcccagggagcgtctcaacaaggagaatatcttgtaaagttgttcaatgattatccatcagataaagaaaagcaagactgcccagctttcatatactactggaatggctctacatgctatatttatgatgacaacattgcaatctacacgccatttggaagtatgctaggtggaatccacaccaagtatatctggcgattagcatatactactttgaacccaagttcaagatcccgcagtttactttcaaagaattggtttaatccatttggaatgtttgctggagggtacaaaaatgacgagatctacaaaatgaacaatatttctcactaa

SEQ ID NO: 3036 - DNA, 2787 bp, Cryptosporidium hominis
atggatttgaagggtgatgataagggagttgcaattaatccttttttgggtgagaaaagctcaattttacaggaaacaagatgttttagcgaggcccatttaaactcaaaaaaatgctgcacagttttgaccaaggttttgaatatgattaatagtggagagaggcttactgaccaagagtggtcagatttattcttcggaatcacgagattattccaatcaaacaaccaagatttaagaagacttgtatacctagcaataaaaagcttaaaagtaaatgaaagcgaagcatttgttgtcataagttctttaattaaggatatgaatagtaataacgattgttacagagcaaattctctcagggttataagtaagattgcggatggtacaatgatcggacaagttgagaggtatttaaagtctgcaatagttgataagaactcctttgttgcgagcagtgcactgttgtgtggttataatttggcactaagaggccacggagatattcctaaacgctggctcaatgaaataagtgaatgtattcaaggaagggacggaatggtgcaataccacgctttggtacttttattcgaattgagaaataatgatcgactagcaacacaaaagattatagagatgctctacaagatgccaataaagtctttatatagcgattgtctgatgctcagacaaatgaagaatatgttttttcttctctgtaagcaggactcctcatgggaaaatgtaagctggatattagatggtttccatacaatgcttaagagtagaagtgaagctgtatctttagaggcttctaggggaatatgcgatattttaaagtttttgcacgagaaacaaaatcataaagcacttggttttattgacatttcgcaaatttcgaatgctcttcaaatgattttaaactctaatatttcagtggcaaagttcgctgctgtcagaattcttaatgaactagccaatgtcagtccaaatattgtctttaagtgccagcatgaactagaacctttgcttaacgactctaatagaatcatggcaactttagtactcactattttacttaaaatagctcaagaaaataatctggacaagcttgtcaagcaaatccctgcatttattgctgatattagtgatggcggaaaaaaagatattatcagagccactaagaatcttatcctgaaataccctacaaaacacaagaatatcctttcattcttggcgaccaatttgagagaagagggaagccttgattttaagtctttcgtaattgatacattatttgatatttctaatgagattcctgatattctggaaagcattctatatcatgcttgcgaaactatagaagactgcgagtatcctgtaattaccatcagaattttgggatttcttgggaagaatattccaaagaccaatactccctccagatttattaggtatatttttaataggctcatactagaaagctctgcagtaagagctgccagcattgatgcattggttcaaattgccctagtttgcgatgatttaagagaagatatcagaactcttctccaagtttgttccaaagataatgatgacgaagtcagagatcgaacaaacacttactcaatgatcatagatgacaagtctacttcagattcactggacgattcagatgataataagtttgatttaactaattcaagcctttttggagagcatttaatatctaaagagacggacactatacgtaatctctcatttattcttggaaaaatcgtttcaaacgaacctgaaactcttttggacttaaattccataccaacagaccccgtagagtcaacagtcaatggttcccaaataacttcaaatattacttctgtttcagcttctatggaagctctcaatatttccagaactcgaggaaaccaaaaccaaacagaaagctcttccgataaagcctttactggggtcaatgtttcccttatatatgaacgactttcagactgtatttctgctcaggatttgggcagccatttattcacttcaacttctattcctctaactgaaagtgaatcagaatatttggttcaattaagaaaacacttcttcaatgaaggcaaattcattgttttagagttccaggttgctaatactttaaatgatgtgctcttaaaaaatgtaaatgttgaattcgaggctgaaattgatggattttcgattatagcaagcgctcctattccaaaactcgagccagggcaagctgaatcaattttcgtgcttattcagaattctacacaagatcacttcccaaatgtttcaaatgttattccatgcaaactagactatttatattgtgaagatggtgatgaaaattctggatataatgatatatttactattgatccaatgactctctcacactctgactgtataatccctaactgtttgaggcagggagagttcaaaaatgtttggaatattctcgaaactagcggaattgaacacattgccaagttctcattttcatacaaaaatatcccttcagctgttaatggactcttggccttagtcaacgcagctgcatgcgataatacagagaatgttaacttagaatcctctaatcacactctcttgttttccggtacttattttgcaaaaactccctttttatgtaccgcgataatagtaaacaatgcggagcttggctgcctagttaagattacctgcagatcaaactcagaatctgtctgtctggacgtcattaaatgttttgaagcagcataa

SEQ ID NO: 3037 - DNA, 333 bp, Cryptosporidium hominis
atgtcaaatgctctaagaactgacccctgcagtgtggacttaaacaatatttcaccctatttctttcaagttagtgtaattttcctgggtttactacaagatgaattatttctcaaggtaattttggaatcctttcgcagccgcctggaaaagttgttcctagtttcaatctatttgcatctgcctaattcttctgaatcttcaaagatgaataatgaccatacgcaagtatttctcaaatctcttacttcaatcgaaaaagatatgttagaagaatcatctattagttactttcaatctgcaaatgctttatactgtagaagagtaaagtag

SEQ ID NO: 3038 - DNA, 2331 bp, Cryptosporidium hominis
atggaaactctaatttccagaataaaggagggaacatcttttagcgatctttattctggtatttaccagaagatagttgaagataaaggaactgagcttgcccaaaagtttgttaagattatgggacattgcataggaattgagttcagagatccttctttaataatcagcccaagatcgtccccagatgttctagtacagaaaggaatgactttcaatttatctattggattcaataatctagactctaatggcaaaaagtacgcaatttggatttgtgatactgtatttttatcccaagaagggaatgtggaagtcctgacacaaggatgtagcaagaagctggaacatgtctcatatgaactggatgatgaagaacctgaagagcagaaacctgttgtaaagaaagaaaagacttcacaagttaagaaggaaaagccaacaaaaaaggagcttgatgagtctgaagatgagtttgacgatgatgagacagaagaggatagtgaagacgatagacattcaaagtcaaaaaaagattcgaaggaaattaaaaaagaaaagaaatccaaagaccatttaataattgaagatagactaagaagaactgccagaagagtaaataactctgaacactcggaggaactcaaggagatagaaaacaggcaaaaagaacttagaaaacgaaaacttgttgagcttcagaagcggttcggaggtaagaaggaggaaaagaatgaccaaaaaggagatatttcagactctgaagaggactttttcaactccaagctttcaagttataagtctgttaaagagtatccaaaggaaaggagctctagtagaatttatgttgatactgcaaaggagagcatccttgtaccaatttacggtctgttggttcctttccacgttagactacttaaaaatgttgtctgtactcaggaagagggcagaaaatcttttattttgagaattaactttctgctaccaacaggaatttctttggagcagttaccaagtaccttgaagacccctgtatttattaaagagctaatgattcgttcagaagatggaaagacattaaatagtatcttcagaagcattaaggagttaattaaaagatttaaacagaaaggcacacttgaggaggaaatggctgaacaggatatgattaaaaatcaacagccaatcgattttaatagatcaaagcaaagagtagttcttaaagatgttggaattcggcccacaattggacagggcagacgccagcacggtatattagaggctcataacaacgggttcaggtttagttcatccaagggtgagacaattgatattttatataccagcattaaacatgcaatatttcaacctgtagaaaatgatttgatagtcattttacatttgcaccttaaacattcaatttggcttggaaaaaagaaaacccaagatattcagttttactctgaggtaggaaaccaaattgatgatttagagcagagaagaggtagaaatgtgtatgatcctgatgaaataatggaggaacagcgtgaacgtgaaacaaagaaaaggtataaccttgaatataaaaaattcatacaaggaattgaagagttgagcaaaaatagttttgaagcagaaattccttatagagaccttggattctatggtgttccaggaagggctggagtttcaaatgttcaactctttccaacagcatcttgtctggttcatctactcgagttcccaccatttgtactttcattggatgaaatagaagttgtatcatttgagagggtcgaacagggacttcgcaactttgatatgatttttgtcacaaaagactattcaaaacctgtaaaacgagtagactcaattcctattgagtatttagatttaattaagcgttggcttaacgaaatggagattgtttactacgaaggaagacaaaatctcaactggaatgctgtattgaagacaatattgagcgatattgaagattttgtacaaaatggaggcttcaacggtttcttaggtgaagatagcgatgatgaagagggtggaagcgacgacgacgatgatgatgaggatgaagaatattctgagagcgatgaagatgatgaagacgatgatgacgacgatgacgatgaggatctttcggatcttgaggaggaaagttctgatgactcttttaaggagctttcaagcgatgaagaagaaggtctaagttgggatgaacttgaaaaacaggccataaaggaggacagaaagaggggaagggaacaggacgaagatagaagagtagactctggatactctaggaagaggcgttaa

SEQ ID NO: 3039 - DNA, 1584 bp, Cryptosporidium hominis
atgggagtatacagcactccaaattcgccaaatagatcaagccacatacctccaaatgttcaatcacagatgtttccaagacaaatgccaatttcaagggttggagtcatggggaagcctccgggtttaggaacacagcttacaccaactcaagaattgatgatgtcaacatttactgctcaaaaccaaagtatgaatggcgttccatttccagcgccttcaataccgcaaaacctgaacgttccttcctctccaatgccttctccagaaagagagcaacacaattcgggaatagggacaaagttacttaattcatttataccttggatgggaacttgtggtactcaaccaagtgccggacaaaatacaggtttaaaaagcccaaattcaggtggaattggttcagttttttgttgtgctcctgaaaaatcaggaataatgactccagaattccctggttcacatgattctaactatagtttctcaaataatgcaaaagaccaatttaagggaggggtgaatccctcaaataatgatttggaaaaggaaaacaaagaacttagagaaagtctattccaattaggggaagctgttcatgatttcgtttcaaaaaataacccaaataacgaatcgcagttaattgcaacgttatcaaaacaattgagtacaatccatcaaaggataggagacatcaagtattccgttttccctacgaaaaataagattggaatagaaacaaaaaatgacttggttcttaatatagtacaaacagtgaacattatattcgggaaaatcgaggttattgcttcgattttgaataatgatcattcagctttagtattcgtcaatgaaattcaaaagtctctttttgatattggtactcatctggagaaactggatgaactttataaatcaaaaggttcggaattagaagctgccaagcatgtttctatcatgatggaagaagataataaacacttatcagagaggcttaaagattctaatgaacaaatacgaatgttaagagagagaattatagtattatcaacaaatatcgaagataaaagttctccgcaagcacaaacttcttcacctttgtacaagaaacttgaaagcgagaaattggagttggaaagaaagattcaaagtattgaacaacaactagaggaaactaagaaagctctggaggtttcacagaacaaatataataatctgattaaacaagaatcaatcaatgctaagtggccaaattatgaattaactaaaggtaggagccacgaagatttagttgagcttctaaagaaaattgatccagaaagcaaagctctacaatctattgcagaaaatatggtcaagaaggatcaaaatatatttactcctcagcctaacttaaaagaccgagtccttaacgttcaagttcaagaaaaagatatagatttcttgaaaagtgactccacacttggtgagttacacaaagacactattaggatgcagctagaacaattccagaaattacacttgatcaatgagaacgttaataagaatgctgaaagacctctattaaaagcaaaagataagaaataa

SEQ ID NO: 3040 - DNA, 570 bp, Cryptosporidium hominis
atgctaaccaaaaaattaaaccgtaatttctttaatcaatcaaaattttcgagaggaattgtatatttttgtgaaagattggtgccttattcggtgccagagttgtattctactgttatagatgtgacaaaatataggcagatatttccatggatttcagaaactgagataactaagatttggggatctattcataatagggatatttttttttcaaaacaaaaaatcaaatttggtatttttgggggatatttatactccattgtagtaggaaggaaaccaaattcaataatagcttactggccaccaaatgaggctttgaagatacctactgcaattgagaagtttccatcctttgttagatctcatagaacaagttgggaatttattgggaactataaatatggcttgactaaggtttcgtgcaaactagagtttgaatttgatacgattctaatgaataaaatagcacaacgctatatcaaagatatgacagagacaactattaacacactaatagatcacattaaaaaaagcaaaagtttgaatacatacagtctgaatatttag

SEQ ID NO: 3041 - DNA, 411 bp, Cryptosporidium hominis
atgtcagtattgcttgttggaagacttggagcagcattgggaggtattggtggattaggaaccggggcatcaattggattaatggctcactctggaaccatatcatgggttataggcctgatattaggccttctgttgggtcttgttgttgggttttctcctattgctagatccctaaagatgaatgatagatatataagaagaggaattaggcaaagagaactaagaaggagaagtcgtctctctgaaggaagctatcattctgaaggattttcagatgcttctgggactgacagaggcaaaagaagttctgttcaaagacatacatctgcagaatcaagagataacgctgctcatataagtgatggacattcgcaatcttcgagcagtgcagcaaacaatgtaaattaa

SEQ ID NO: 3042 - DNA, 1473 bp, Cryptosporidium hominis
atgcacgaagaatggattatccgggttttctcttcctccggaagatcaagagtgacaattccttcaacatgtaacctttcaatgttaaagtcaaagatagctcagtcgcttaaggttcccgaagaacaacaacttctaagtttagactcacacgggaacacactactgaagggagactcacttagtatgctccagcatggtctttctaatggctcgatagtttatttaattactgatgcaactccacagattgctacgcaaagcatccaaaggccaaaacatatgacaacaagtgaccttcctcaacttgaaaagaagccttcaaattcgaactattcatcttctacttctgcggattctaaggatatgaataatagcgtggaaaaaagtgaagggccacattttaaatcatttgattcatttttaagcgaaagaaattttgttactgatgacctacctcttaagcagtcctacaaatctttctttatttcaaaaggagtaatgaacaaaatacctccttcagttacactaaggcaccaagcttatcgacacgttgaccaccttgagatgatgaatttgtctgaagcaatgcaatttgttgactattggaggtcaaaattaggtatgatgaaacaaagagtcggttggatgtatggatactatcgagaagatagtacatatccaatgggtattcgagctgtaatggaagcaatttacgaacctccacaagatgagaaagctgaaccaggaaagcttattctcgaaaatgatagttttaaatctaaagtcgatagagttgctcaatctcttggtctcgaatgtttaggattggttttcacacataatgagagagacgaagtactaacttctaatgagattgttactcttggaaagcttcagttagaagcactaaaaacgcttcattacactggctatcctgttagcagctttatttgctgtacaattgccccttgtaagtctatccaaggaggagaccccataccaaatgcgtttgcagtttctgaccttggattagctcttctcagagacaaaataattgatgagaaaggattaaaggacgacactcatattgttattagagaagaggagaagggtgagattctaccacaaatcctagaaaagggtgtatctacccgcaagtttgatgcccactggctaatagtacgcattaatgagtccgcccctatccaaccaaaacctttcttttcctcatcgcagtttcccagagaaaatagaattgttcctcagaagccaagcgatgtctcagaatttattaaatccaggctaacatcagtacctttgacttcctgcaatctcctcaacgactttcacctattgttgtacctagcaaaattgtttgacgaagctacggcaatcagtatatgtgaatcaatcattaacaaaaccccagtagatcagcatttactagacattttgatgtccttaaactaa

SEQ ID NO: 3043 - DNA, 1473 bp, Cryptosporidium hominis
atgcccagagaattagttacattacagattgggcaatgcgggaatcaaataggcatggaattttggaagcaactatgtactgaacatggcctggatgccaatggaacagtaataaaagacagtggcccacttgaagatagaaaagatgtgtttttctatctttcagatgacagtcattatgttcctcgagccttactatttgatttggagcctagagttctaaatagtataaaatcaagcgaattcaaacacctttacaacccagagaacttctttattggaaaggagggcggcggagctggaaataactggggttgtggttacgatacaggggaggaggtttatgatgaaatactggatatgattgatcgagaagtggagggctgcgaaagtatggaggggtttgttctttgccactcaattgcaggaggtaccggtagtgggatgggatcttatattttagaactgttaaatgaacattatccaagaaaactaattaaaacattctcagttttcccaatgcttaataatgagagctctgatgtagtggttcagccatataactccgtgttaactctgaagagattagctttaaacgcggattgcgttgtagttcttgataatactgccttgagtggaatagctgaagatcgattaaatctgacgaatccaacatttgcccaaactaatgctttagtcagtacagtaatggctgcttcgactacaacacttagatatccgggatacatgcacaataatttggtttcattattttccactttagttccaactccaagatgccattttctcgtgacatcatacaccccaattacaattagtcaaaatatacaacaaaatgttaggaaaacaacaactttggatgtaatgagacgacttttacaaccaagtaatattatggttagcacaaatatgaggaaggggacatatatatcaatattgaacattattagaggtgagactgatccaatggaagtacacaaaagtttgcagagaatcagggacaggaatatggtaagatttattcagtggggccctgcagcaattcaagtagctctttcaaaatataacccatattctactcaacacaaggtgaatggtttaatgatggccaataatacggctatagccggcttattccagagatgcgtagctcagtttgataggttgatgaaaagaggagccttccttgacaactataagaaacaatcagtattccaagatggacttgacgaatttgaaaatgcaagagaggtatcagaaatgttaattgaagaatataagagagcagagagaaacgattatatgcttgcaggttataatacagattctggttcaaagaacttacaacttgatggtttatctagacaagaacctcctttaaatgaatactctgatgacttgtataattattactccaaggagaacaacccaaattataacacttattgctaa

SEQ ID NO: 3044 - DNA, 354 bp, Cryptosporidium hominis
atggctaaatggattcctggatcaagtttgtctatgtcgtgcgtaggattaagagaaaaaattgaacctgagagactaaaaagtcttggttcaaaagaatccgagtattcatacgaaactgttaggtctggtttggtgcagctgattaaatccaatcaaattaagtttgaaataccatacttagaagcggatggcataagctcacctcaaatccaaattctgcccccaagtataaagacattgatagtaaatcctaaaattgaatatccaaaatgcatgaggaggtccgaaaagagaaaactgagaaaagaaaggagaagtacgcggaaggtagtcgaaactagtgctaattaa

SEQ ID NO: 3045 - DNA, 2553 bp, Cryptosporidium hominis
atgaaaggaaaatataagacattttttagtttcaatgttgatattttaaaggataataaaataaacccatatggtcttttttcgagaaacgatgagttgtcatttgaggaaatagggtaccttagatatcaattagactacaatgagtttcccaatactaaggccgacgataaggaaaatctaagtaaggttttccaaaagggaaactcttgcagttcaacaaataaagattcctgggttaaaaaggaccttgattccaggcggatttctatattagagcctgttaccagtgaaaaagttgaattaaataaagtcagcgaggtaattgaatcgttaagcttaaattatatacaaaaagatcaagctgtaatttctccaatagattcgcaagacagtaattatcctgcatttaaattagggagctgtggtaattttgacaaaagtgaggaaggggctacttttcgctccgaagataattactatttggtctcattatttggtgttcataaacataactcaaagaaaaatttaaccttcgaaaaatcccttttttctatgggattgatttcaaccatgaatccttatcacgtaagatctcgctcatttagggagtctatcatgctaaatcacatcaatgaaaggtacaataattattcaaagctccaactatgtgctgtcccatatatgctttaccaagtcaatttggcttctgtaactaacaaggatgatgctccaaggttgaaccaaagctcgtttaaaactggttattcttttaccttggaaattagccaaagttataagcgaacctttatgcttaaaaaattaattgggtcaggagcaaatgcgagtgtattttcttctgatgtttgcacaatagtgaacgaaaagctggttagcgtattttcatgcgctgttaaaattcagcataaagaccttgggctcaatgttagggaaatttatggtgggctatctctttataagagaaataaaaaacgcataacaggtattattaagaggacttctatagaaattgagaaacctttgattctgaatgagtaccaaacaaatagttttaatgaagatattaaaaaaaggtcgccactagttcaaaaaacagccagaagctcaataagtacaacttatttacccggaagtaatataccctccagtaggaattcattaaactcgtgttttgcccctatggatactgcaaatgagaatcaatcgaatgaaaatatggcatttagggcttcagtgaatagccttgcacatactccaaaaataagcttttatgcaagctcaggaaacaccccactaaataattttagaaagagctcagtatcttccgtaaagacagctagtagaatttctgtttcttcgcactgttcttgcaactacgttgattccgcttctgacggaagttctttaaccaatccaattgaaatcggagagggggtaacaatattttgtataacggagctatatatagtttctcaaagctcatcggggatgatccagaacatcttgactagggagatgatgaagggcggccgagaacaagaaaataatcaaaagaatgtggaattaaatgacgaacttagcgcttctgtgggtatctcaatactacctacattttttggagcgcaaagcttacaaaacatactaaacgagttttacctaaggaatggaatgactatggaagagccaatcctgttatttctcacttatcaatttgctgaaacccttcttgcatttaatgaaatgaaaatattacatggagatattaagcctgacaacatattactatatccaaatcctagtttttgtgaggaaggctggaataatgatacaaacctgcttacttgtcacccactaattccagagagccatgaattaccgatattcatgtcaataattgattttgggagaagtctagatataggagaaatttacaaaaacaccttctttgaaggaaattgccatgcaaaaagctttcttcctcctgtaatgttagaaaatctcccctggcttcaccacattgatatctttggtattgcctccacaatacattgcttaattactggaagatatatggagctcacaaagtggagcgatgagaccctcaggtgcttggaatataagaacactaaaaataaacaagatgaaaatgatattcttaaagtttatagctatagaattaagaaccagggttcatgtcttaaaagaaattggagaatagagttttggagcaattttatggccaattgtatcaacttttgccccattctcgactctagatctataccaaactctgctgaattccagggttctctctgtaataataataaaactgggctagtttcagaacagacaaaaggtcttcatgtttcccaatcaattgacgagatctcgcgaaacattactgttttcctaagaaaggttcaagcggacatcatctcgtttttccaagaagaccaacaactcaaaactactctttataagcagctcttgaagattaggaagcagctccaaaatgtctccacctcaaattag

SEQ ID NO: 3046 - DNA, 1377 bp, Cryptosporidium hominis
atggaactgggggacatccatggagtactctcaagcggcctcttggactctgataagatgagaccaatgggcaggaggttcagcgtcaaagtagttgactatattgttgagcgctttggaacggaacgcactctgccctacatctcttcaataatggcattcttaattcaaggatgcaaagatatggaagtgcatgtccaaaattcagcagtctcaacaataggattaattgccagctcatttcttgccgaagagatttttcaacttaatcaggatgttgtagacaatttctttgatccattatttcaattctcaaaaaaggaaagcaatccaacaattcaaattagttcgattgcagcagttagttctgcgatagatgggatgagtacaaacctagtaattatgaatcttaataagcttatgggaaacttggttccaattatgatgaatcctaatacttcagaggcatgtagagccgtagtaattgatactttgagaaagttggttgttcttgtctggacttttctacaagaaacatcttttggaagctctccaggtatgtatgatcttaagcaaaagcaaaatatggagtcagaattgaatgtatgcgcagaaggtcttgaattaaagcaagttgagggtattaacgatcatttgatcctccctattacttggaaacaaatcagcagtatttttaatgggatacttaaagaattacaccctaactatactacaaatagtaagaataccaacgttagaagtgcatctctctctcttttaactgaaattatggtttgttgctttgttgcacaagcaggagctctcttggctgcgcacaacagcaatatccctttacaaaaacccattgatggaattaaaacttatgcagaagtcataattaatgtagttaaccttggagctaaggataaatcgcccaaagttagagaagttgctcaatattgtattaaaaggcttcaagaggctaatgaagcttacattcctgatggtagcgaaatgattggttttactcaaaacatacaaataatcgaaaaggagcagctcaacaaccaaaatatttctaagagttctaaatctcgaaatagaattatgaatgaaaatttctttaaaaatgcaaccgatgaaattttagttaagcatgtttcgcctccctcaagctggagacaaatacaacgcaactctatagaagacaaagagaaacagactaagttagatatgacaacaaagagtagtgaggaagaacaagttgatagagaagaccaatatcctgcttcagtttctagcattacggaaactcagtcagtccacagtaatagtaacagttgcatgggtgccaaacgactcacttcctcaagataa

SEQ ID NO: 3047 - DNA, 552 bp, Cryptosporidium hominis
atgacagagtgcaattgcatgataaagggattcctcgatgggtcgtctctgtggaaatcagttgttgcttcaaccgtatttaatgcatttatgatctttttcggaaggaacttctttggattcatttgctcagtgttctctctcttgattttggctggaggaatttgtgttaaggtagctccagagaaacttgaagctattaaaaaaaaggatttggtaacatctgaaatgctcgaaaagcattgtagttccattgcaaaatgtatgaacaagaagattgaacttgctatagacgctatttcatgggagttcccattcatatcttttatttcattcttagtattggcactttcatccatttttctcagaaatcttggattctttgttttcactaccgtcgcagtaaatattttcttactcaagaactacatcaactctttctacacaagcattgtaggcccaaaggtatcccctcacatcgacaatatttccaagaaattcaataagagctttgaaaaaatcccgaagatgaataacttaaagtcagactaa

SEQ ID NO: 3048 - DNA, 894 bp, Cryptosporidium hominis
atgaacactagaattggcacggtcttggcaagtctgagaagcgagatttttgagagtggcaagaagatcctctttattacaggggcagggctaagcttggactctggaatcccactttttagatcggaatctgacggtggagatggctcggcaatttggaattctgaactagaggcttgggcaacaataggcagcttcaggaaagatcccataaaatggtattctatatttcaaaataacttcaaattctggagcagctttctaacagctaaaccaaatgaaggacatagagtactctcaaaattgtgttcagattttcctaacagaattaaagtaatcactcaaaatatagatgggctcatgcaacagacaaattgcccaagagaaaatattattgaaattcacggaagaattcattaccttagatgtgcaaatcctaattgtgactattcaagttcaaaattttcatatatagattggaaagggctttttaaccaagataataagatcccaaaggacttctatttaaaatggtcatgcccctcttgcagttctccatcattaccattatttcttttgtttgacgaatcatataccagtcatgctttctatgagtgggaaaaagcccaaacatggatgaaagaagctgatttaatgatctttattgggacatcattcagcgttctctgcacggattgttgtctgcactacgcatataggaaccagatccctatttacaatgtaaacatccgccccactccaatctgctttgaactatacaatgaggatggaaacgattttgagcttatagagtatccaaataatcttttaaataacataacaaaaacatcaaccgacttcctaacagcattatttcccagggagaatagctaa

SEQ ID NO: 3049 - DNA, 255 bp, Cryptosporidium hominis
atggcagactctggaactattaagcaaaataacaagagccccagtgatttcctgagacaagtcattggaagtccggttattgttagattaaatagtggagttgattataaaggattactagcctgcttagatgataggatgaacattgccatggaagacacagaagaatatgtagacggagtatttgttgaaaaccacggagataccttcattagaggaaacaatgttttgtacatttcttctccgccaaagtag

SEQ ID NO: 3050 - DNA, 1152 bp, Cryptosporidium hominis
atgaatgaaatttcaggttcactttggaatgcaaataactggcactgggaagagaaagattattctaaatggggtaaagaagagcttagaacaattatggagtctattaagtattcttttgagctcgaagctccaaaatttgaactatcattctcagatctatcaatcagaggtgaagcgtctatttcggtaaggaagaaacaacctattttagcctatgagttttcaatctccggaacttggtcagtaaatgaagtagaaagtcaaaagaagattattcttggtcaaattacaattccggaattctctgtggataattatgaagaagacttccctattgtaattacatgcaaagaggttataaataaggactacaactcagaacttattctttcagagatgaaaaagaagttggttgtaaaactgagaaaaaaacttatggaatttcataataaactattaaataaggaaaacgaccaaagaaagattgaaactgagagagttaaaagagaggaagaaattaaaatagcagaaattgctagagttgagaaggaagaggagaaaagacaaatttacaatcaacaaattgaaaaggaaacgttaattaaacaaagagaatctgaagcatcaactaaaacaattgatcctcatcctgaagctcaaggaagtgtttggaatgcaaacaattggcactgggaagaaaagccagaaaccaactgggttattgctacgttaacaaagatgattgaagagctctcgacaaataaatctgattcaggaaattcggatctgatcccaatcagtttctctgaagtgaaggtgactggggaagcatcctcaagcgtcagaaaaggcaaaaaaatttgcgtcctagactgcagcgtttttggtagatttaatgcaatcattccagaaggaatgttaagtcaaaacaaagagtcaaatctaattggctcattttctctcacagagattaatatgatggatacgcacgattacggaaagaaaattaattatgaatcagcagaattgggattaaagacggctgatatcccagagtttgttgattttaagggaaaaatagaaaaacaaattttggggagtttagatagtgcgatacaaaagttctgtgttgaatttctaaataaataa

SEQ ID NO: 3051 - DNA, 594 bp, Cryptosporidium hominis
atgagttccacagactttggagatttagtgttattgattggtgatttaaaaattccctacggagcaaaagagttgccatcaaattttagagagctgctggctactgataaaatcaactacgttctctgcacaggtaatgtatgttcgcaagaatacgtggaaatgctgaaaaatattaccaaaaatgtatacatagttagtggagacttggactctgcaatttttaatcctgaccctgaaagtaatggcgtatttcctgaatatgtagtagtacagattggagaatttaagataggtttgatgcatggaaaccaggttcttccgtgggacgatcctggctcgcttgagcaatggcaaaggcgtctagattgcgatatattagtaactggacacacacataaattaagggtttttgagaaaaatggtaaattgtttctaaaccctggaacagcaacaggggcatttagtgcattaactccagatgctcctccatccttcatgctaatggcccttcaaggcaataaggttgttctttatgtgtatgatttaagagatggaaagaccaacgtggctatgagtgaattctcaaaataa

SEQ ID NO: 3052 - DNA, 3153 bp, Cryptosporidium hominis
atgaaatttccaaaggacttaataggcttttggatattatcgtcaatgttttttatctgtttttcattagtttatggtactaaaacagaaagcgatgtcaaaaatagtctcccatacttggaactatacaaaggaaacaaacaaggtctattgcgacagcacagaatggtgggagaatttttagaatgtacttatgttgagcatatcgataaaaatttacaagatggaaaaaatgaggattattatccaggaacaggaattgatcgaagcaaaagtagagtggtttctttggaatcaattgatatttcgagtaaaattatcaaaactttggaatgccagaaaaaaattattgaacgttggatgaaagatattactaaaactttaaaagaaaatttgttttcagtcatcgaaataaggagctggagagaaatgacaagaccaaaaagcttgaatggagaagctggagaaattttagcaattctagagaataaaaactcgagtccattaaataaagttaaagaggctgtggaagcatttgaaaagtatataacagaacttcacgatgcctactcagaattccaaaattctgaagaaaaactggaatctgcttctactgaagaagaaaaaagaaccagagcacaagttgctgtgttaattcttggtcaaaaggagaacagaagtctgcttaaatttacaacgataatacgcaacaatgcggacgatgcaagagattcaaaaaaacttctcgagaaattgtttttactactttctggcgaaagttataacaacagaattcttcaagctctggagcttattcaaatttgtttctttttacttaatggtttgaatgttttatccgtatttgaagaacagaggttatctaataagttcagaagggatatggaaagaaggaatttaatttaccagcacaaaattgaaaataaaacgctttcaaagtacccaaaattctcaaattcaccaaattttaaggatatatcaaatttccttttgagttctgtaaataaatcaagtgatgctgaaagtgaaaataaagtaaaaattgaatttattcagatgtttgatgagattactcaagactttggtattcgttgtccatattttctcacttcaatattgagatccggaagagttggtcactctttaaaaggagaagagttgttcgattacaatgcagtaaaaaattgtcggcttgcatggaaagaaatatcttcgtatttatataaagaaggccagattgttccttcggctgcaattagacaagcattgaagaaagccttatacaaacatgttaagacagtttatgtttggcccagaaatgcttcaggactatttaaaagtctttttgatcgttctgaatttgaaagaacatttgatactagcaatgaaaagagatttatatcaacttgttctgaggctataaataaagaaattggtctgggaacttcccatgcagttagtttggacgaaattgcaatcatatgttttgatttctttaatttattagagttttacacagatcagtacaactacggaaatcaggagaatgttggaagagatggaaacaccattctagcaactaaaaagtacgtaaatattaataccttaccatcaaaaattaaggcaaaagcactggacgtagcttgctctagaacattagctggattaatcgactttcccccattcaaatctaatgatcttgacagaacggttattggtattctaacaacaaattttatggaaacatgtgttcaacgtatagaaactgttcttggagaggcgtcgaagtatagaataagtaacccccaaacaatatgtacagaggttagagatatccttaaggattataatatgttgtctcaaaagcctgaaaatatagagggttcaatggatatttttgagcaatttaacattcttgatacatctatcgttgcagaaacttcaaaaggtctatccaaatcctctgatagcattgactatctaaaaatgcttcaaagtaagcttggtagcttacagccaagttttcaatctactcaaagtaaagatataggaatttccccaataagacagcttgaccctgtgaaggcatataatttggtccgaaaaatgcatttagactggatggagcaaatgagaaatgatccaagatataaaggttttacagatttagaattgaaaaataactctccttgggacaaacaaatgaaactttggcatgaattaatcactcctgaattacctgaagttagatatgcagcatcataccttaacaatagaccttctagatttccgttgatttctggagataagagaggaaaacataaaaaaatcactcctttagaggaatttcttaatgaggatttggatccaaaatatagagccagatatccactagttgaaaatggtccgttcgacgaacaagatttttattatgatgacgaatattataaacatccttatgaagattctatagctgccgaagcagctcaaactcaagaatattacattaaaagggaaaatgggagctatataaagaacgagaaaggaagttatattaaagaaagaaacggaaagtatattaaaatcaataaaggagattatattaaagaagggagaagaaactatattaaaaaagacgaaggctattatactaaaaagagtgagataaaccagcattatgccgcagttccagttgtccacggagaacaaatcacagcgcaattagtgagacccaataaagaatataatattaaggcgtaccaagcaaggaataatgctttgattagctactcctatattgacaatggatgcaaaggggaagaattgcctttactttggggacaaagagcaaccattttacatgaaaatatgattaaaggtttcaaaatggttaaatatagagggaaatatgggccaggacattttgtatctatggatgatatatgttatattttggagagagactttaaggtgaaaagaaattattttgaggatatttccaaagttaatttaatggaatgtcaaaaatggtttacagaatacctttcaaaactctggccgccatttaacatggaaggctttaaagctgatgtaaaaactttatgttgggattctggatttagaggctggttatag

SEQ ID NO: 3053 - DNA, 1494 bp, Cryptosporidium hominis
atgattcaacagaaaatttgtcttttcagacatgtattaagaaatataagcacacaggttctgagaactaaaaaacctatttttagacaaataaatggtttgagaagcatagaaagttacaaaattgcaccccaaaatggaattgggcccatattttccgaactcagtaatggaatgagagtaatcacattggaaaatagtaataaaatagcatcgctgggaatcatcataaagatgggttctagatttgaatcaaagagttcatttggatcatcaagagttctttttaatatgatactttcccaagaaggaaaaacttcgcagaattgcttgccaaataaactagcattaaacggattaatgttggcaggtggcttcaatagagaatatacttcatttttattggaatatttaaaagaccaggaaattgaaaatatccaagaattctttgatggaatatttaaattctacaaaaaacaattcagtggtgaggaattagaactcgctaagaaaaatattaaagaggaattgttgtttgagttagagaaccctagcataatgcttaatgaacttttgcattctaccgcatggaaagaaaattccctaggaaataatcaatcaacatcttttgatcaagtttcagatcttaatatacagaatctaactgattttagaaattcaaattttctttcgcgtaatactataattgttggaactggtatcagtcacgaccatttaattaaaaagatcttgaattcatcaaggaagtttgatataacggaacaaaattctgtcaataatttaaaaaacgatgaacaaactatgaaagttccaaagtatgttggtggcttagtaaaaaataagttgccccattacggttttacagatatattggtcgcatttgaaaccaatctgaattggaaaggacgtgaattggttgcattatctgtactccaggcttatcttggtggtggaagctcctttagtgtgggaggtccagggaaagggattcattcaaaacttttcttggatgtattaaataaatttgactgggttgaaagctgtaattgttttgttaaccaatacagtgatacgggattatttgggattcatattacttcttacccaggatactcattagaatctattaaggtaataggaaagcagcttggtaaaatgaaaaatatcagtgaaagggagcttgaaagagctaagaacctagttctaagtactatttatacagcttacgaaaacaggagtcactatatggaagagatttccaaacaaatactttcatactctgagttcattgaattggatgaaataatcaattgtatcaggagtataggcatagaagatatcaaaaaggttgcggatttaattctctccaaggcagacaggcctacagtagtcgcagttgggactgatacgaatcaagtcccaaattacaacgaaattatttcaataatatctaggcaagtcagcaattattaa

SEQ ID NO: 3054 - DNA, 1374 bp, Cryptosporidium hominis
atgaacatagagggcgaaaagccaagctcaacaaattttagccgggtttctactcatagccatattagaggattgggcttgaagaatgatgggacagcatcaaatgatggatcatgcggaatgattggccaactacaagccagggaatctgcaggggttgttttgagcttaatacagaataaaaaattggcagggaaggctgtattattggctggcccacctggtactggtaagacggcaattgcccaagctatagcgcatgaattaggtccaaaagttccattttgtccaatggtggcatctgaagtgtattcagctgaggttaaaaagactgaaatacttatggagaattttagaagagctattggacttaggattagagatgttaaagaggtatatgaaggcgaggttgttgaattagtcactgaagaaactgaaaacccccatggaaactttggaaaggcagtatcagcaatagtattgactttaaaatcagcaaagggaacaaaaacacttcgtcttgctcctcaattaagtgatgtttttcaaaaggagaaagtaaaggttggagacataatttatgttgaatcttctagcggaattgttaagagattaggtagatcagattcatttgccacagagtttgacttagaatctgaagagtatgttcctctcccaaagggagatgtttataaaaaaagggaaattgttcaagatattaccttgtatgatctagatttggcaaatgctaaacctcaaggtggccaagatatcatttcattattggggcaatacgtacgtccaaagaagacggaaataactgagaaacttagactagaagttaacaaaagcgtaaatgagtatattgaccaaggagtggcggagcttgtcccaggtgtattgtttattgatgaagtacacatgctcgatattgagtgttttacgttccttaatagaactctcgaaagctctctggctcctattgttattttcggaaccaatagaggcgtatgtactgttagaggtactgatatgctttcttcgcatggaattcctgttgatctattggacagacttctaataattagaacaattccatataatattgaagaaatgattagaattgtttctattaggtgcgatattgaggggataaaaatggataaggagtctttacagctgattggggaaatcggtagctcaacatcattacgttatatatgtcagttattgactcctgctcatattattgcaagcacttttggaagagataccatttgcaaatctgatattcaagaggtagatagtctctttttcgattctaatgcgtctgctagaagattggctgaagactctaattcatttatcctctag

SEQ ID NO: 3055 - DNA, 996 bp, Cryptosporidium hominis
atggatactttgagattcctttttgcattggagcttttttctcttaactttacaagtcttctaaaggcaaaaaatattgaaaatacatgcgttcctaatttacttagaaacagtcttactagttgggaaaataacatattcatggcagctcatattttccaagtggatagcggaagtttaagtgacaaaatggcacaaaaaaacaataaaaaaaatgtgagcactaaggtttcaaatagtattatttgtctttgtataagattgctcacgttggctcagtacccaccattttggacttcttgtagacatttacttcaattaattggccagttggatccaaaaacatacatttatatacttggatatgctggaagaacagcgtatccctatatgggaataaactatacttgcaacgtactatcattattggtatattttgtatctagtctccctgaatattcttttccctatttaaatatggtggttgatatttctattggattcttggatccacttgactccacactacgcaaaggaactataacagcagtcacatcagttcttttcatattagttagcgcttttccaatgattaccttccatcaaaatacacaaagatttgcaataggcttcgatcgttcaattattgtttatgatcttagaactgcaacaaagtggagagtattacagggacatacacaacaagttgatgcgttgtgttttaataaggagggtgagttcctcgcttcgtactcaatagtagaaaaggctctaaggatttggcaatgtactcagtcaggactattaggtggtttgctcgggatttcaggaaattgtatcaaaacaatagatctcattgaactccccccaagaacattaagctgctcattgtattatagactcaaagttgttaaaatctcgtgtaaaaacacagacgagtggcaattaaggagagaaaataagaaaacttatacaatcactattgataagaattag

SEQ ID NO: 3056 - DNA, 3051 bp, Cryptosporidium hominis
  misc_feature (3036)..(3036): n is a, c, g, or t
atgctactttcatgtggtattacaccagatggaggcgttttggatgaagtcactctaacttgttgtagtagttgggattcaatatgcgcaactggtacaaaatctggtcatgtatatttgtggaatattttaagggtggacaaaaaatccaacgagggctcaccagagaaagagctggtcccttcttgcgttcttattcctaactctctatgtccaattaaacttattggtatggttttcgttttatcgccttctcctttattacaaagctgtacagatgagttgttgttaacattgcattcggataatattatgagatattggtctttggataatggaaggtgcatcgctcaactatcagactcagctgaacacgaagtattgcaactagtgagtctcgcagacaaaaggtttgtgttgcttgttgggcatcaacgtattactataatagacacttggtcacgactaaattgtggagcacttaaaattgcaagctgtccatattctaaacgtagaataaacaacagaattgatgacgacactccagacatgtataaaattcaatctccaagtactgttcagctttcatacgaagataaaaacgagaaatcctcccttaatccaacaaatacatatggagagtatggagaatcaatgatattcaatgtttccactaatcatgattactttgaacttttaaaatggtcttcaaatatctcactttttgactactgtgaagataatagatatcccactgctcacttttacacagtgtctgcaatgctaaatactggtcaagttttagtttgggatttaagcaacttaataagaatttggtggcacttcattcctattcctcactgcgaaatcccatgtccagttccaaagccccaaaaaaataatgttcctaaaccatttatgaaatatagtcaggatgaaacgggatttaataatctggccaaaaactcttctcgctcttcaataaactattctcaagatcaaataataatagaagacaatttgggcgatctggatattaaatatgagcaaatcaagcaggaaagttcaatagaagacattaatgggtcttcatttgaaaggtatgatcatgctttcgatttaagtagtaatgcaagcgaccaatccaagtctagctcatttgatactccttatattcatcaattttgttcaattaagtctccaatgctagctccaacatttttttccttgcatccatgttttgtttcagaaccgatcaatttttattctattccttcaagtgagatgttttcaactcaaattgttgtaactgacttttatttaattgtaaatgcaaaatacagacttataatttggaaacgcactttcctgcctcagtttcaaaatagaaaccaaaggtaccaaccttttggagatttgttcgtcccaaatacgcccatttgtgaagattccaatccaaataatctacaaatggaaatttcaacacaaaatttttcaaatggaagcgagcttaaagatccaatgtatgatattcatcaaacccaacctctaaaaagagcgataactctcaatgtgattaatcaaaataatgaaaatgtggaaattaaacaaaagcttcaaatttggcttgggttttctcaaatatcattaaatattagacaagcctgtattaataaaacaaagacatattcgcctattagaactcttagcatggaatatgaagaaaagcaaaaacattgtgtatcttttcttgcatggtcatctgactttacagtatacagtattcaacttccttcaatagtttgcttcctttttagccaaaattttaaccctaaatttgaatccaatatagctttttctgaacacgatctcagagaaattgataattatggtaactatagtgacataacagcagttcctgtctatatttccagagactattttaaaataaacgataaagaacaattaaattaccttggccatcttgcaagttattggcaatttttcaaaataaatactttgtacgaaaatgacctagaagaatcgccaaagtctggtagaaatatagaccttaatttccaaaaccaaggaaataacgatattatttgggtgcacagaaataatttcagatttctattagaaaagagctgtgagacactccataatactaattttgtatcaattgagcagaattctgacaaaatattttactcattcttcgacttgtcaattattgaatcacaacaaaaacttccaacttactataaatttccttttattccaaacaattcattttcaaattgttataaaagctttaatgacgctcattcttttgtattagacaatgtagaagtatctgactccaaaaatatgtttttccctgttaaacttaatatggattctcaaaatagcattgataatagaaatgatccaattatatgcagatcaactgaaaatgaaatctattggaaatccacaaaatctctgagaacaatttgggaggatgatatcacagattacgataagaaaaataatatttccgtcctttcttgttgcatcactgaacaaaaaaattcgatttattgtataatttctctatcaaatggtaaaattatgggccaatgtcttactggagaatttgggctttttagcatgatgaattgtaacgaagacaaacacttctttggaaatatcgaaaatggagtagtttaccaacttcctctcccaaggccttcatgtggacataaaacaaatgtaattgaaataaaatctgtgacggatggttgtatttttggactaacttgttgtggaaatatattagtttggaaggtagatttaatggagaattttgtaaataaattctctacaggagaatctaaaaataaagatgtacattccagcaataattataacatcaattattcaaagaatattaattcacctggaattaaaggccaaattgtttcaaataatttattttctcttatagcttgtattaatggtttattttttacaaatataatttcacttaacaanggttattgtatttga

SEQ ID NO: 3057 - DNA, 786 bp, Cryptosporidium hominis
atgggtcgcgttattagaggtcagcgtaagggtgcaggttcaattttcaaggctaaggtttccaagagaagaggaccagttaagcttcgtgcattggattacattgaacgtcatggatatatcaagggtttagtaaaggacatcactacagatccaggtagagggtgtccagttgcacatgtttcattcagagacccttacagatacaaaatcaagaaggagctgatgattgctgtagaaggacttcatactggtcaatttgtatactgtggaaagaatgcaacactttccgtaggaaacgttttaccagttggtcagattcctgaaggtactattatctcctcttgcgaggaaaaggcaggggatagaggcaaactcgctaaaacttcaggtacctatgcaattattgttggccaatctgaagacggaacaaagacacgtattagactcccatctggtgcaagaaaaactatcagctctcaatctagagcaattattggtattgtagctgctggaggaagaattgataagccagttttgaaggcaggtaacaattatcataaatacaaagtcaagagaaactgctggccaaaggttagaggtgtttctatgaacccagtagaccatcctcacggtggtggtaaccaccaacatattggtcacccatctactgtttcaagaagcgcaccaccaggtcagaaggtcggtctcattgctgccagaagaactggtttattacgtggtggccgcaagacagctaaggataaggtagaaaagggagtttaa

SEQ ID NO: 3058 - DNA, 912 bp, Cryptosporidium hominis
atgggcttcagcggagataaaatagaatcttcgtgtaatattcggtctcaacgaaggcttagaactgatactgcggaggcagtttttggcaatttttgggaagcaccaaaaaattcaaattttcactccaggggagtgaaaaaaaataaacaaaactatgaacatgagatggctgagaattctacccagaagtcagactcagattccttaaattcaaagtttaatattacaaacttggacacccaagaaagattgagcttttatgagtcacaaggagcagagccatacctttctaagtacccaactataacttctatacttacagaaacacaacctaaaaggtggatgataatgtttagtagagctcaatcttcaagttatagagattctaaagatggaaagaataataaaaagaattctaaaataaattcttcaggtttaacaaatgaagatttaccgtttaacaaaatgcaatttatatggagttctgagttggatgagcacaaaagggtcaagttaaatgacaaaaacagttcaagttcacaatctttattatctgacccaaatgacctttcaccaatcgtaattaattttccccaccctattcagcttcagaatatttctattccatacgaggttctagacccaaggtccgttccatgcggctcatttatttggtgggatagaagagtatgggaatataattttgttcatatggccagaagactatctactaacgatgaaaaaagtcgtaaaaaactcaatatagaaaacccagaaactccaaagaaacagactagagcttcaggggaaagcaacggacaaagttctaagcgttcaagatcaaaagtagaggcaaactccaaactaaatcagaaatcaaggtctcctaagaatgtaattaagcaataa

SEQ ID NO: 3059 - DNA, 1365 bp, Cryptosporidium hominis
atgtggatttaccagtttttggcagcaattagagaaggaagccagtggggtaacttaaccaattcttcaggtgaatccacaagtcatataaatgggatgctttcgagaaccactagacttctagaagcaggaattaaacctgtatttgtatttgatggtgctcccccagagatgaagaaagatgaactgacaaaaagagatgaaagaagagagaaagcgcttgctgaattagagaaagctcaagaagttggagatgaagagcttatcaaaaaacaatctgttagaactatacatgtaacaaaaaagcaagtagaagatgttaagaaactgttgggttttcttggaatgccatgtatagatgccccatcagaggcggaagcacagtgcgcagaactatgcaaagatggtctagtttatggagttgtcacagaagatgcagactctttgacattcggtaccccaatccaaataaaacaattaaatttctcagaatcttcaaacaaaataagtgataagtcgccgagcaaacaaaagaatggtatgcaaattataaagctatctttgatcctttctgagcttgatataaatatggaccaatttattgatctttgtatcttgagtgggtgcgattattgtggaacgataagaggaataggaacaagtacagcctataaattactcaaaaaataccataatattgaaagcattttaaaaaacattgatcagacaaaaaatcctgtaccaggaaacttcgatttctcaaaggtcagagagctctttaagaatcctctagtatcaaaaaataatcaaataaaagatttgattaagtggtcaaaccccaagtatgaagaacttatggaatggcttataaaagaacaaaattttaatgaggctagagtcattagctattgcgaaagaatcaagaaaagcaaaaataagacttcacagacatgtttggatggcttttttaagtctgcatcaaacgaaagaaaaaacactcataaaactccctctaggccacctttatcagaaaaacaaaagttagaaactcgtaaagaagtagattcttccttgagttgtgataaaaaaaaagttaaaatagaagaaaagaaaattattagtgagtggggagctccagtatcaaagaacttgagtggtcaagctgaaaaagatctcactgaaaacagttcagaagctcctaatcagtcgaggaaaattcaagtgaacaagatagaagaaaacaaagattctgaatcttctactgtggagaatactccttcattacagactaaatcgcccgagcatacaatgagaccagttaaaagaaagttaaacagattaattagtgaaagcgatgaagattaa

SEQ ID NO: 3060 - DNA, 306 bp, Cryptosporidium hominis
atgaaatggatactttcgatcgacacaggtaacataagtgagcatcttgacgtggactcgattgcaagcaaggatgaagcaaattatgtggaagaatttattaactctctaatcagcaaggtaaataaccaagtatccgaaggagaatatgagtttgaaaaacaggagacgtttttaaagcaagcattgagtgtaaataaaagaattgtaatatactctatcattcagctaacattagtatcgattatttcatatttttcaattgttcatatgaggaacttccttaggaaacagagaattatttag

SEQ ID NO: 3061 - DNA, 1383 bp, Cryptosporidium hominis
atgagtaatcaagttggcttaatttatcctccatttgaattaagagctacaattgacaagactgccagctttgtggcgaagaatggggaggagtttgagtcgagaatacttagtgaatcggggagtattaagtttacatttttgaataaggataatccctttcatttgtattacaagaaacgaattgaggattttaagaatggagtttctattgacagtagtggacctacgatcccgagggcaatattggatatgaatagtaggaaagagaagcaaataattgcggaacaagaggtattgatgttaacatctttcagtggaggctttgggttcatgggaggggctgttatggagcctgaagagcctaggaaggatcaatatacaatttctcatcctataatttcaataaaggatgagtcagtaataaaaattacagcaatgtatttggccaggaatggacaatcttttttatcagatttaactgttagagagtcaaacaaccctcagtttgactttttgaaacctggccacgcattatttggatactttgcagatttagttgaggcttattcactctgtttaattccaaataagagttatttgaggggaatgaaaaatgagtcagaggatctacaggcaatttttagacgttgctataagaatagtctttggagaaagaaggaagttgaaacaaacagtggtttacttgaattagaaaacagggatcatgtagacttggaatgggtcgcaattaacatcgttgagacagttgattttgatgatttaaatttggatcttcctgaaccagttgatttttctatgctttcaaagttagttttagagtcctctttagacatgctgaatgaaaatgataggaatgatctattagaaagtgaagttcaaaatgaagagagacagattaatgttttagtgattgagaaagaacaaataaatgagaaggtttctgatgaattaaataatacaaacaatgatgatgcttttgaagaggaatttaagaatataaaaataattaagaactatgttagagtgccaaaaaagagggggcttgtaactaaatcagaacaaaaaaagaaaggaaaaatgtacagatgtccaattacaggccaattgatacctgatgaggaaatttcaaaccatatgagaattttactgctagatccaaaatggaagcaacagaaagaccagctagttcagagagcgcagcaggaatccgtcctaacagcatcttcaaatatagaagaaaacctcatcgcatttattacgaagcgtcccgatctttttggtacaattgaagaagctgtagcaggaactcatggctttgaagagaatggagaaaaaaataaaaagcaaaaatttcagtag

SEQ ID NO: 3062 - DNA, 2361 bp, Cryptosporidium hominis
atggaaagctactattactctgagattaatgaaaacgaacttttggatgatgatcgtcataatgatgagacatttgaggtaggcgaagtaggcgatgactgggttccatcaattaccctgaatcattttgatataaagcaagagtaccaggaacgggaaggggcaaatcaaatgaaaaggcttgaggagttgatgaagtcaaaaacgcccttaacagtagaggagatagaagcagcgatgatgaatcaagatttttttagggaacagggatcaactaaaacccaagaagagttacaccaacagaattatgcagattttgaggccgagcaaaatgtgagacgtaatcgagtaaactcaggctattcacacaataaaggccaacatggatcgtcattccaacaaaaacaaagaaacacgagtagccaacactcctcttcgaaaaggaatgatgatagaagctattctggaagcagaggccatagaggaagccaccaagacattttaagccatgaacaagacacctctaaggagcccgaggcagttcctgaaattccttttagtagctacatatctcctttgacaaaaactcatatatctgaaattatctcgtgtaacttatcatctccatcaaattgggattactctggtctttcaaatgatccatcaagaaacaataatctaatggcctcgagagattttgatatgattttaaggattcagcttcagcaaatggcggaaaggccagaaattcagtcatattcgtctaagtggaatagaagactacttgctcgtaagcataatcttcccttaggtaatagtgattcttcagaggataaagatcagtccaaattaaatacaaaagcaggacaagaagctgaagatagatcaaaaaataaattgaaagaggggcaaattgctgaccaagattctaacagaattcgcaaattcggaaaatccacatattcaacggtcagaggagctagggaacttattaaggttcacaacctatctaaggatgataactcagagacgagggacgaaataaacattggagaaaatagagaccaaataaagagttctataaatagagattattcattttcaacaggaaatgcccattatcaaatgctttcaaagcaagtttttgaagttcttcacagcaatatttttaattctcctgaatttgggagtcaagatgagaaaaaagttcaagcacctggaccactggtttattctattatagaagcaggaaatgaccttttgcaatacgttagttactttgatgatgaaattgaaaactgcccgactgggcacttacaggcaagacttcgtctcgatcaggaattaagagacactatagacttaatctttcagctactattcgggttttcaaagcactcttttggtgcatcaggtgtggaagatgcaaactataaaaatggagagcattttaaagtttctgagatttcttttgcagaaagaaatattgcatgcttgaatgctagacgctggcttttaaacaaaatccttaatattaggaaaggaagatacttcgtgttaagtctattccatatgcctcatattagtgagagctacatgacagttttattagagtctatcattgcctgtaatgatccaattattgagatttttagatcatcatctataattctgcctccattaatggctcttgtacccagagcttttagatatcgacaaggccaggatattttggcacctcatgatggctttggatactcgggagatattgataagcttgttgatgactggagaaatatatatggaggaaatgacccatacgatgaaaaatatgtcactagagaagacttgatggctaaggcaaagttgggggtaaaaattctggaaactacagcacttcttgcaaatagaatgatgcaatctaataattatagggatacatcttctctagtcccaagcctttcagcgcttcttaaatactataatcaggagtatattcaaagccttttaggaatttcaactggagtggtatttcttgctcttctttacaactcaatttcagttgttcccaggcaaatagatgctttaaaacaaattacaagattactagtgctagcattcacaaactatctacttgagagggactcagaaaactctccaataatgcctattaagctatcacctattgctctcaaagactctgaaccggttgtactttgtgttcttcaaaggtcaacaaatgacttaaatcttaaaaatattcttatgagctcaatttctgatgtggtcggagtggaaaacaacgatcattttatttcagaattacaagaattgatagttaagggaacatcaaaaaattag

SEQ ID NO: 3063 - DNA, 858 bp, Cryptosporidium hominis
atgtattttaacacactaaaacatacgactattcagaacttaaaatcatcagaatggatattcttttttttcaagcatttgctatccgaaaatccatgcatatttcgtgatttatatttttataaacattccgaagagtctactatcgaatgcgatgcttcacttatttacctaacaatgcaagaaccttttgttaaattatcaatgttagaaaataattatatagatatttcagatgcgaaaataacaaaagaaattattattctccaaaaactcctttcgacttctattataactgaacacgaatttaaagactttttgcttgaaatttgtgttgaaatagaaactaatcctaacttgaaacaaaatgtacagggattggttgataaaaatataatatctcaaattttctttctagatggaatctttgatacaattctttcagaattaaaagtaggagttttctatttagagcaatttattaatcttcagattgaatattggtccttaaaattgaaaaataaaaatttagtaaagttcagcatatcaaagcttggtaatattaaaggatggatttctattttaagaattagcacccctaaagatgaaagtaatattgatttctttagtaaagtcaatattagccttatagacttgctgagaatcatgctaaaatttaggagacatttaatttgtcccaatcatattatagttgaagagataaaagctacatggaaactagtcagcgaggagatctctatggcttcaattattcaagcaatttctacaatttgctatgggaacgttcaactccaaaattcattctctcaaaatcaagatggtaagttttcaatataa

SEQ ID NO: 3064 - DNA, 595 bp, Cryptosporidium hominis
  misc_feature (484)..(484): n is a, c, g, or t
atgaaggatattctagtcatttgtggcccgagcggagtggggaagggaactttgatttctcaccttatgaaagagtttcctgacaagtttgggttttcaatttcccatactagtagaagccccaggggaaaagaatctaatggggtagaatattatttttgttcaaacgaggaatttataaacatgatatctatggatgcgtctcgccccctcgcttgcgtgtctttctcctcttccgcccctcctccccgtctccctcgccccccctgccccctcctgccctccctccccggccgcggttccttcgtccttcccccggtgccgctctccgcctctcccccttcgcccccccctcccccccccctctcccccctccccccccctgccttcctctctctcttcttcgcccgcgcccggtgcgtcccccctctgctgcgccctcccctcggccgcaccctccctccctcgctcttttctgcctctnggctcggcgctgtcccggcgtgtgcttctcgtccttctttccgccctgccttttctccgctttccccctcccgtgtcctgcttgccctcgggcagtacacaaccgaaaaat

SEQ ID NO: 3065 - DNA, 594 bp, Cryptosporidium hominis
atgcgttcaatcctcttctgtttcatcctattgttttacccaatttcgacttcattggggaaagaaagcgaattattttggaagatgaaaactaatttgatacttactactgatgctagattcgaaggagcccaattatgtacatcattagaagatgaacttatggaaaatgcagaaggtagcgatataaaatatgagaatgatactttgaattgcaatttaaattcaaataatatgatagagcttgttgttacgaattcaaaaaaagaggaagttactctctttgttactgatgctgtttataatttaatttacaaaaagaaagatttaaggaaaaacccaagtacatttcatagaaaaaaaatctcagaaagcatagatgagtatcaaaataataatgcatctcaagaagtagaatcgactggaagaattgtatacattaaaaaatattattcacctgaaggtgcaaataaacatttaccagttattcaaaaatttaattattcaaatattcagttttccattaattcaagttctgtgtcagtttctgcgatgaatactttcaatttcacaaatagttctggaaatgagtaa

SEQ ID NO: 3066 - DNA, 750 bp, Cryptosporidium hominis
atgatcaccttctctccaaacaaatacatttctccgaaagcaataaaagaggctcttaatagtaatgaaaatgaaaatatgaatttagatctaaaacaaagattagagttcattgaggaaatgctcaaaaaaaaagatgctccacttccgggagactctcaacttttcaatattcatctttctaggcaattgtttccgcaattaaagtttgaagatattcctgatatcaaaggaattccagtagaagaactaattattttatcttcatcaggaatactacctaatatgggtgattttgaacatactcttaattcaatcagaaacgaactaatagaagctgaaaggattaaaggtagttttgaggatcctcttgattctagattagcaagaaggcatgtactaattaaggaacttcctcctatatctgcaaatgatgatgaattggtggaatgggaaatggaacaaagagagagaatgcttcgagaggagtatgatgaacataatcgtcgtaaatttaaacttcaactattgccattagatagatcatcagatgttctaaatttaaaattaaaatccccagataagaagattggtaagattgaggtttcagatgaagaagttcaaaagctaagaagttatgaaaagtctatgtatcctgagtttattaaaaagacagataaattggctagagaggttagttcactatttcaaaatactatcttttactttatcattttaattttaggctga

SEQ ID NO: 3067 - DNA, 330 bp, Cryptosporidium hominis
atgttcgaaacagcaggctctccatttagaaatgtaagaaaaggagttaatgacccattaaataatgaagatatggcagtattagatatgccattagggtatactcccgatggaatcagagatattgtcgaggagtacttctggggtgattttccaatttttgattatgagcacgatagagttaatcctcctgataacttagctcacttttttgaattggattcaaatactaaaaatattcggagtattttacctctacatcgctcaaatatactggaacctgaggtgagtataatcagtttattatttttcaagactaatactttttag

SEQ ID NO: 3068 - DNA, 249 bp, Cryptosporidium hominis
agtccaactttaaatttacaacaaagacaatttaaagtctttccttcaaataataaagaaacatcaaataatgttaatcaaaaaaaatatgcttccaaagcaattaattcaaatcaagatagaagatcttttaatcttgtgtcttcaacatcgagcctaggtgaagatcaaggaattcaaattactgatgagtcacgccctttagatataagacttgtaagtatacggaaatctacaatatattattaa

SEQ ID NO: 3069 - DNA, 2484 bp, Cryptosporidium hominis
atggaagaaaaattagacttgaagtccaaatatgaaaagttgagaaaaaaatacgtacagctaaagcagcaaacagtagctttaaaagagtcattagaaactaaggagggtgagtataaatgtctaaaagttagttttgaagagctagaaaatacacataaagaatgtattataagacttgatgcttcgcaatacaaagaaacgcaactaaaaagggaaatagaggaaatagtatgccaactagaacagtttaaatcacatgggaacataaagcaggaccaaccagtttgtccaaatggcaaagctgggcaggggattttaactgggttgcttccgatgaatggagtgataatgaacttccagaaaaatgaaaaattggaagagaaagttaaagttctccaagaagaactagatttaaaaattctcgaaaatgaacagctacacatcaaagaatttgatttgaaaaggcaacatcaaaaagcaattgaagaacatcttgctaataatgaaaaacttaaaaatgaaatagagaatttgaatttagagattaatgaattaaagctaaagaggggaaacgaagatggcattatagatgaaataaaacagcttaaagaaaaagataaggctaatagccaaaagattaatgaattattggagagtaattgtcagaataaaaacactattaatattaaactaaatattataagaaagttgattcccagagtcaatcttttacaactagaagaagaacattcatcttgggcaaacatttgcaagcaaaagaattgttttgcctttcttaagttagagtctttagtttctgaatttctcaaaaagatattaattgttgttgaaaactggagcaagtgcatcaattgcttcatatcaaagccctctttacaagacaaaatcaccgagcgtatttacaaacaaatacttatttttcttaaagaagggaataaagatttaacagatctttctggggtaatttttcaaaacggattcattttggaacagaatatttccgaatcagcattaagttgtatgaacaatcaagataaatttaatagcatagagatcaaggatatattagttgaaaggtcaataagtgcaatgacgtcaattaaaaatgcactaagtttacaaattattgcgtttaaaatggaatttcataaattatccggatcaaaattagcatttgaatttcaaaatgaaaacaagaaagctatagaaagattatttattattattagaaatttacgaaagtatttacccaaactcaattgcctttttaactttgctctaaatcttggaagaaaaccagacttaatgtactcacacagtttatggacaaattcattttatgttgcgttcatagaattgagaagagaaataaaaaatcaatttgataacatttgcgttgaaatagaagagaaaaaacaattttttgatttcgtgaagagaatattgatagaagatgtaactctacaagatgaaaatatatctctgagcgagtcatttatcaattctcacaaaaaaataattgaattagagtccatgaggaaaattttacactcaaaaacaaattttaagataaaaaatattattgaactcatttcaactgaattaaacgatgcctgtaagatttttgagttactttttttctcagataataccactcatccattcttcagtgaaacctcgaaagatataaaaagctccttcttcgattctatagtcgatctattttgcttactaaattccaataaagaatcatttatgaggttggtttcttcactgtatcaacatccatcaataatttgtcaaagcaccaataatctcagtgaactacagattaatatgagagaaacgaaaagcaaacttgaagctgcccctccaaaaataacacttccggaattgcatattctaaacaaaagaatagagcaacttgaggaaagtaaaaatgaacatcttaaaacaataaacaatctaatgaaccaacttaatactgtaaatgaatcttcaaacttaaatgatcataagtctgattttaaaaatgatttaacatctacaaatataattcctgttaattcaagttcagaacccagtaaaatatcagaattgaagaaacaaaaatgcggaaaccaacctcagaaatatatttatgaagtttttgaatctcaacttagagaagcaaatgaaacactcgaaaatactgtaactagattacagcatatttttaatgatctgaatgatgatattgaagtaaccaggcagtcttatgacgaacaaatttctctattaagccagcatatctgtttgctatctgaaaaacttgcgctaacagatgcatccacattatcatctttcaaccaagaaatactttgttattcctgtgaaagctggtccacactcgatttaattttgaataaaacaaaaggggcctgccaaaaatgtaaaaccaaattattaagactaaaataa

SEQ ID NO: 3070 - DNA, 1635 bp, Cryptosporidium hominis
atgagatacaactctaaattaagatttttaactccatttattggacttgtattattgttgaactttgctcatggaattccaaagacttcttccagtaatcaatttagtaacgaaacaaatgctggctgtaaagaaaattttaagcaaaaactttccgaaattttaaatagggggaaaaagccagataattatggaagcaatccattcgacacattttttggaatgttgttaaatgctgaagatttaaaatactttgaccctgaaaatccagcttcggaaagtaattctaacatacctataactagcactccaagcctaaaagctaaaagggaagctgcttctgatgttaatgccagcaacctgaggaagtcgtatagacctgaacaaagtaaaagtcaaatgtttgattggggtactcatacgaaagtctctcatagtttagcacgcgataaattaactccaagagattctcaaaaccaaataactcaaatattcctcgatttctttagcgttattaaaaaaggtggtaatgaaatttccaaaaagaaatcttatgggccaacttttaaagaaatagttgtaccaagcttgattaaaggtgtaaataacagtgaattagaaggtgcgactagaggaattttaattaacgagcttttggtagaaactgaaatgggaaaagcatcaataccgaagaatcgtccagatgggcttccatctatctcttttattggaatagagaatgaagttatgccgttacatgttatttacataaaagaagatgatcgattttcatttaaaacatttccgaactttgttcctcctgatataccgaaaattgctggtcagagacttaaggaatgggtcattttaaagtacaaacaaattcacgactttttaatggctaaatcaagagaagattttgacagtaagtccttactaaagtctttgaataattatggaatttattttgctattgaattcaaggatgatgcagtttgctatctttcagaggtgaccagaagcaattccaatttgataaagaacagcaataacaatgataaaactcttgtttcgagggtaagccgaattttattctccagactgagaccatttatttcattccaatccacctttattccccttaaaatgagtgaatttcgctcactatccttcattggttcgcctgttttaatgaacagagcggataatgaagatgatttattaactcagcaggctttattctactggtcaattgaagctgaaaagtttttaaatgattataaaagaaaagaccatgtttgtagcgaacgtgaaattttctctaatcctgaatataagcagcattgtatgatatctcctcacggaagaaacccaagaaaccctaattcttataataatggctttattaccactgtatcctgtttcggattacacccagaaggtacaattgtattattttcatataaatctctcttttcgcttagggtatgtcaaaaggacggtagttggagtgatataaaagttctttccgaccaaaatagagcaacagttatatttcacaagtgtcactccagaaataacaataaagaaagtttttattctcgagtttctactgcttcattttttgaagattaa

SEQ ID NO: 3071 - DNA, 666 bp, Cryptosporidium hominis
atggcacctcagttaatttccaagaagcgtaaatttattaatgatggagtatttgaggcagaattgaatgaattcctctcttgtactcttgcagaggatggttatgcaggcgtcgaagtaagagtaactccaattaagactgagatcatcattagagcaactcgcacacgagaagttcttggtgttaagggccgtagaatccgtgaattaacttctcttattcaaaagagattcaactttccagagggaagcgtcgaacttttcgctgaacgcattgagaatagaggactttgcgctatggctcaggctgagtccttacgctataagctactcaagggtgttgccgttagaagagcatgctatggtgtattacgccacgttatggaatcgggtgctaagggatgcgaggtcattgtttctggtaaactcagagctcagagagcaaagagcatgaaattcagagatggttatatgattgctactggtcagcctttcagagactttgtagacaaggcagttcgtaatgttatgatgaaacagggcgtattgggagtgcaggtaaagattatgcttccatatgacccagaaggtaaaactggtccatctaagccactacctgacgctgttatggttagagaacctaaagaataccccattagtcagtag

SEQ ID NO: 3072 - DNA, 1005 bp, Cryptosporidium hominis
atgattgggttacaagagctatgcgaaatttattggatggaattaatagcattctgggttctgttaattatggtgattgtactgctaagagggattaggtcaaactatgaggtcgcaattaactggtttaagtcttctcaagaatttttagagtccaattttagcagatcagcattaataagaaaatcattttggctagattcctggagtcaattcgatatttttgcaacaggaagaaaaaattgctcatttatgtatatgaatgtcatttgtaagccaaggcaagatttacttacaggaattttattccagcctttgttaagaaactatgataaggtgtatattgaaattcccattgagaaaatggagccaattatgctattggtatgtagtaagggtgaactcaaaagtactttaattgactatccagaaatagaaattcactgctctcaaaagaaaataaataatctttctaagaacaacattgtttatgctaacagcaatgcatgcgttgagtatataataacttctggttcattttcaaagttcatttcctcgcaattagcagaaaggcttgtaaattatatttatatctctgatcaaactacgtgtccaaggctaactaatagctattcaaaaattacaagcgtgttaaaggcatgcattagagtcccttctaaaaatgatattgattttatgagccataataatttaaacttgaattatctttttaaaaatattttatctctttgcgagactcttcaaactctagaacttccagagaagacaattcagcatataaacaacaatagattgcaaattgaaaaaacattctctaaaatgaataataatggggtaaatgagaaggttgaggccaaacgacgagagaaaattcgatctgaagctattaaagtaagcagaatgagcccaaaagagcaaaaaaaatatcaagagaaaaaggataagcaacaggccagatctagaattaaattgaaaaaagtataa

SEQ ID NO: 3073 - DNA, 1119 bp, Cryptosporidium hominis
atgtttattattgaaagagctttaagtatatttacattaatatacgaaatggaggctaaggttggcctggatgagtctagaattccgaaaatagggcttgaaggctcagtttcaagtctaaattctgttttagatagctctaataaaagaagtccatcatatttcaatacaggctttattccaaatcaattagttctcaatgcttctcttttaaatgaattaaggcaagagccttctggtaacaagagtatttcccaaatcaatggagataagccaaagaaatatgatggtcaatctgaaatttcacataataataaatattcacgaaaaaacagtgaaagcaaaaaccttgcgagctcatcttcaaaatctcaagataattctcgaaatgtggaatctgaagcagcaagcattgtggaaaaggggcaaattcaaagtgtccctaacttggaactttcaaaaatcgcttctccaaatgtatcaaatgtccagacaagacaacaaaactatgtttcttcaaattcatcttctttttataataaatctcaatcaaactacaagtcaaattttcaagaggtcaaaacaagctctaaagataaaaatattccggcatcttctccaagatttgtgagagttaatactaatcttgtggaaagttccataaattcatatagaatacaaaatattgctaaaagcggagcttttccagcaacttcaccacaatctagagtttacaacaatactaacgttcaaggaacatcctggagaactgtatggcctaattcaaatcttatgtcaaatggaggaattggtgatgcattagcatcccctgtatcgaccaaatcgataaacaaattcagccccgcaagtccacagaaaatgttctccccaactagctgcaaccaaataagttctagtgcaaagtacacagttactccaaatccatccgtagtaaggtatattgagcaaagatctgcggaaggacttgcgtcgccgattgggttttcacctctcgcttctccaacttacagaaaaaacgtgccacagactagatcaaataataatacaacgcttccaaattctaatctcaataatttaacattcagctataaaggttga

SEQ ID NO: 3074 - DNA, 387 bp, Cryptosporidium hominis
atgcaaatttttgtcaagactttaacaggaaagaccatcacattggaagttgaaccttccgatactattgagaatgtaaaggcaaagatccaggataaggagggcattcctcctgatcaacagcgtctgatctttgctggaaagcaattggaagatggtagaactctatctgactacaatatccagaaggagtccactttgcatttagtattgagacttagaggcggtgtaattgagccttcacttgcaaacttagcccgtcaatacaattgtgaaaagatgatttgcaggaagtgttatgcaaggttaccaccaagagcaacaaattgtcgtaagcgtaaatgtggaagaactagccaaatccgtccaaagaagaagctcaaataa

SEQ ID NO: 3075 - DNA, 330 bp, Cryptosporidium hominis
atggattgcctcgtagctaagtgtatcccttgcattactgattgtgtaataggggaactcgaaaagatgggtcaccgttataacttggctttgaaactagctagagatcccagattcaaacgtctgcactgtctgcataaagggacttatgcggatgattgcatagtgcaaagagtaactgaacataaatgttacatagtgggaacgaatgataccgaactaaagaggcgcatacgtagaataccaggcgtcccaataatgtatgttaccaaccataaatattcgattgagagactaccggaatcactagtctctgttccgctgaaaaag

SEQ ID NO: 3076 - DNA, 483 bp, Cryptosporidium hominis
atgtctgaagacgagcagcagttcgactccgttgatgcaggagcttcccactgctacccaatggctgctggttcaatcaagaagaatggatactgtatgttgaaaggaaagccttgcaaggttgtagatatgtctacctccaaaaccggtaaacatggccacgcaaaagcccacattgttggtttagacatatttacaaataagaaatacgaagatgtttgtccaacatcccataatatggcagttccattcgtgaagagaagcgagtaccagttgatagatatccatgataactttacatcacttttaaccgaaaatggatctaccaaggatgatttagcactaccaactgatgctgaaggtaaccccgacgaagtagctcttcaaattcagcaaatgtacgcagatggcaaggcaattcttgttggagtgcttgctgcctgcggaatagagaagattgtttctgctaaagagttggcatag

SEQ ID NO: 3077 - DNA, 1653 bp, Cryptosporidium hominis
atgtctacaaaaaagaaaagatgtaggtttcatgatgattctggagatgaagaagctagcaaaaatttgggttttggagatgattatatgccggatgaattttttacaaaaaaaatattaaaaagcttaaaatcagagcctcctagtaattgggaattcttgggtagagcaaatgaatttaaagaaatttcagaatatattaggagctgtatcttatgcagtatttcagggattatctatatttctggctcacctggaacaggaaaaacgtgcacaataaaccgtattttaaatattctagaaagtgattcatcaaagttaggatttgtaaagccttcaagttacaagataattcgcactaatgcatcaaaggttgtttcatattttaataaaaactcaggtttgccaaatggaatttccctttttgttcacttattagatcttatgaagtttcaaactcgtataattgaagaatttaaaagaatcagcaggagtgaaggatttcaagaatgcataatgtatttcatgaaacaaatttcaaataaaagagctaaatttattgtgttcattgatgaaatagatttagctcggagtaaccggaatcatggagatgctgtttttgaattattcaaagcaataatcaactttccaaattcaggatttgtgcttatagtagcttctaatacggtgcagatagggaatgagattgtaaaaaaaatcggagttaatcttaagaacaaaggaagaattaaacttatggttttctcaccatatagtcacaatacattaagggatatagttttgcaaagaattgaacgagcaagcaactttaaaaatgattcacttctcaacaaggctggtattgaattatgcgttagaaaagttgcaagcatttatggagattgtaggagaacattagatgcttgctatttaactttaggaaagtttgtatttgaaagacaaagccaaatccaaaaggagaaaatagccagtgatgaaagtgaagatggcaattcaattcaaatggaggatttaagtaatgtatctacaagagaaagtagccctaaatataataggagcccacttgattcacaggaagtcaataatctacatagattgagaactagatcaatgcctgcaaatatgtcagtacctattgctagctttcaaaatgttattgggagaatacaccaaacaaatcagggaagactaaacttaattaaaactcttcctctccatcaacaatacgtcataatgggaattatactggcaattattgatgagcaaattcaaactaaaggctataatagtcttaaaacagaaaaagatgggtttttagcttccgaagtaactaacagcagagcatcaatatgccattcaaaaagaaaataccaacaaatttgcgcagaactcattactcctcctgaagaatacaaagatatgcttgatgcccttgaatcaaacaacgtaatatccgtctccaatggagccaaggccacaaagaaaagtagttcttttcatagaggcgctattagagctaacggcaataaagaatctaagatagaactcatgttcccagcggagaacgtaattaacgccctcgtatctctaccaaagcttggaccaatattctcaagtctgttgccttactaa

SEQ ID NO: 3078 - DNA, 1020 bp, Cryptosporidium hominis
atgtcaaaatcagatttcgataaatggtttccatcatacagcaaagttaattctcatctcatcaatcttggaagtaggaaccaaccaatttgtaggttattatgtattcatggtgcaggaggttcagatcaaatatttgtgaagaaggatttgaatactgctagggaatcctcaaatatactgttggattatgctcaagaaaatgggatagagttgcttgtgctacagcttccaggaagagcaggaagatctcaggaagcctgttataaagatattgcaacattaataaatgatttctatcctgtttttaagagtcacttctttggaaaagcaaatctaacagaatatatagaattaactccatgggttatcgttggccattcaatgggaggactaataggcttcgaactattgaaaagaattaagttcgaacaattaaaagatttttctgctaaatttggagtaacagatcaattaggattcgaaaataagattgtcaaacttttgagagagaaaagaatatttccagagctatttattattatgtctacatttcctccaaatatcccggaatatgaccgtccatggagaaaaaatgaagaactaaatgatgaagagtttaaacaagaatgcagagagtgggggataaatgaaaatgtattcaaaaaaggtatttgggaggaatttgaaaaacaactaagatgtgatttcacaatgtttgatagttttgaaatgaatttggtagataaaatattctattgtagcaatcagtcgctttataactttatgtatccactaggagttgaggcccaattatggagcgcctcccaagacagcaaagtcacgaaagatatcatgaataaatggaaagagctgctgacttccaatgggaactcattagttaccagggaaatcgatgctcaacataacttcctgcacgatccaaaagcaaggaaagaatggatgcaagacctatctacatcactagacaaaataatattagacctagaatactattaa

SEQ ID NO: 3079 - DNA, 582 bp, Cryptosporidium hominis
atgtttgtattttcatggtttcgcgatattctgagctggtttggactctcaaataagtctgcaaagattttgtttttgggacttgataatgcaggtaagacaacgctattacacatgcttaaggatgacagaatagcaactcacgtgcccactctacatcctcactctgaagagctcgttattgggaagataaaattcaaaacttttgatttgggaggtcacgaaactgcaaggagaatttggaaagactactttgcaacggttgatgccatcgtatttcttgttgatgcttctgacagatcaaggtttggcgaaacacgtgaagaacttagtaatctacttgagacacctgaactacagaacgttccatttgtgatacttggaaacaaaattgatattccaatggctgcatctgaggacgaacttagacaaagtcttggtcttttcgagcacttaacatatggtaggggagaaaaaaggggggataatggaataagaccagttgaagtttttatgtgtagcgttgtcaggagaatgggatactcagaggcttttagatggttatctcaatttttgagttag

SEQ ID NO: 3080 - DNA, 1884 bp, Cryptosporidium hominis
atggatacatttaataaaatttatttcaaatgggcagaatcaaataatcgcgaattaggtattgatgaggaaaagattaaaaaagaaatgttcagcacaaaatttaatttgtttatgttcataacatatgataaatacattgatttgttgctagaaagcggacaggagcttgaaaatgctgaaattaaatttgaaagaaagaaccaagaaattgatagattttctaaatttgatttcaagagctattcttcaaaagaaaatttgtacactaatcaccgaaatggaaaaaaaggatttttcaaagaaaagacctataatgaagaaaagttttcaagtttttggggatataaaccaagcccatataaaaaagatttaagaaaatctcatatggggtccaatatagatgatatatttgaatcattatcgcttctattatattccactaattcttataaagagttaataaaaacaacttttacttcttcactttctctaattaacaaaatttgcgaattggaacgtgatataattaggaactctaaaactaataatgcatatatacatgtagaaggagttgatcaagagatggtattatttgtcttttcaatatgcaataaaatgaagtcttcaagggagagaatgagacaaaaaatgcaatgcgcaagaaacctagaaaattgcaaaccagaaaatattgatcaagattatgagatgcatcatttggaaatatttgaagtaatgcagtttatttataaaattccaatcatggtcttcgaaatgaatcaagatcagactattattcgtgatactgaattaaatagaagaatatatagcttaaatgatacaaataaattgctgtcttcaattagaatagcgaaaatatttgatagtgactcgaaatattttagatatataccaatgatacctaaagttactgtttgcgattttgaagatctaaagaatggagtggggccaattccaattcaagcaattttgaaaggaatgacctctatgtcaaaatcaacatacaatagagaaagtttcaagtttaggaaaagaactgcatttgatgatgcatcggataacttctttaagagaaagcaaatctcagtaccttttccatgtgctaattatccaaaaaatttgcaatcctccacagatttggtgccaatacttagaagatatattccatatgttcctggagatgttgaaggtaaaagattactacaatttattaaaatttcaacagcagttattgacctgagaagaagacctataaaggaacttccagacagaagcatggaaaaaacatttaggtctatactattggataataaagaccttaatggatctagagaatatttaatgaagatctatggccttgatattaatgaaataatcgaaaaaaattatctctttgagaagagattaattgataataaatattataaaaccgatttaaatatgttttataacgatctttatatgaacaataaaaaaaatatttatgaatataatcaatataaatttcttattgaatattttaatattgttagacataaaaggataaatccagaagtaatacattcatttattgatttagaggaaacaaggaacagaggtgaaaaacaaagtaggatgttaagtattggggagaggatgaatgacatgctaaaatacgctgccttatcaatattttcagagttttactactactggtctaaatttaaatacaatataaggaaattttcttatgaaaatcccatcaaggtggaaatcattccttccgatgaagttaaggaggaaaaattaaagaaaaaacaaatatcactgtacattgaggataaactagacgaaattaaattgaacagaaatcatgactag

SEQ ID NO: 3081 - DNA, 3276 bp, Cryptosporidium hominis
atgcaccataaaagacttatttatttattaaatttggtgtatatttcttcaatattcattgcttttctttctttaattaattctgtagagacaacaactttgctcaaaattaatgcggacaaaactagtaaaagtacaactagccattttcaaagaacaacaaggaatagaaatagaaaagctccaagagagttcagaaatggaaataaactatatcctgttcaaaatttaagaaataattcgagtaaaagaaacgatatacccgttaaatctaggaaaaatgcaccaacattttatggaaatatttatttaagaaataatgaatataataatacattaaattctaaatattataaagaaaatattgctagtagggctaatcgagcagattactattcttttttaggtggtagatataatttaatgaatgctctgtggagtgataagattgaagtattcgttccagaaaaatccaaagaaagtaagacaaaatataaatggatgaatgacaaatatttgggatcaaataaatatacttcattttaccctaataacaattatcaacaaattaatcatttattaaataaagcagtttcagtttctctgccaaaaaatacaacaatggatgatgaatttcaagagttcgtgatttcaaatattggaaagagtaacagaactcagttatttgataacaatcttacaggattgtatcaaaacaatgattccttaaaatatttaggatttggaaatgaaggaagtttaaaaaatgaaatctccaaaaataaaatttcacaaaaactacaagtaaagaatattaccctatctaattctgacccagttaacttaatacaagaaaaggataacttaatgccaaatatgaaatggacccaggatgttttgtctgaaatcccttcaagtattccagaaaatatggttaattttgagtatcagcacattaacgaacaagaaacaaatgaactagacggaaaagagggaacccttctcaaagagtttgtgaagttagctgttgacttttcattcctctcaggttcaagtttaaatggagccgtttgtatgtttaaagctgtattaccattaatgaaaattagatggaaaacattaaacttgataaatacctctaaaatggatacaatagtcaaaattatgcttggaattccgttttttaaatactttgaagaaaaagagagtatgattagttcatgcataaatatgtttttctcaatggacatggattctggagaaggtttatgccttaataaatcagggtatgaaggctccataatgggcgtttcggtcgcagactttattgtgaaacaatatcacgataataaaataaaattaatcaaagaaaaggaaacaaaaagagaaagtaatgaattcaagccacatgattcagccaatttgcttgagatgatttatgatgatatttgtaactatttttatgaatgcatggatgaagatatttctgatgaagtaaatgaatatttatttcaaaattcacgcatttttggtgtaatggagaaccagaggatgaacttttttaagtctaaccacacggttttatttccagacacatcagaaagaaaatctagtatagacgctctaccctctgattggtttcttgctgcgcttcaacagttgtctcaaatgaatgctgaactaccagaattggaattccccggtcttaatattcgtgatcttggaaggttatatttttattcaggaagattaggagtacaactaccaataaggctcactctaaaaatgatttatgagcttagtgtctttgcaaaccattcatcactactaaggagagcattttgcacagagtcacttaagaaaataataaatttcaaaatagcgaatgtactttgtaaggtttctttctccccaattccattgaagtttgatcctaatgagctttacataagtttgaaaaatatattaaaaatgatttcttttactccgacatcgtggaaaaaaaggccagatcctatttgttccgaagctgaaatagtttcagagaaatatcccaacgctatttcccccccaaattttattcaatattacgctgtgcgagacaaatggtctctatatagatctttggctattcagttatatggaaatcttgctgtagaggatggagaaactactttaagtattgtatcaatgttgcattcactaattattggatatatcaaacttaattgggacgaatttagagaactttatcttaatattgggattattgatccagaaagatactactcacttttacttagccaacgtagagggcctgcactcattgaacttatagcattttcacgaatttacaattttaaggtaatggtttataaaaaaattatgagaaattctagaagagaggttcattttgaattagatgaagagataactgggattgttgaagaattcagtaatatatattatcattctgatgaaatatataataaaactttatcatgtaaacttgtacggcttcttgtagaaagggaactccctcctgggttttatcaaggcgttttcaagacgaatatttctgattttaatgaaattattaatgaaaatgttaaagatggctcaagttggatctgggatgcaatacttccggtttatgattcaatcactaacaaaaaaatattatcaaacgaaattggtgttcaaattaagtataaatccattataaaagaagatgttgatgcagattatgaaatttttgacagaaaaaatgaagggaatgacacatttcctttatttaaaataattcaagatgaaaaaaaatattacgttgatacgaaaaattggaggagaccatcaaacaactcttttgggcaaatactcaatagtggttcgaaaacaattaatcaagcagatacattaaatgataaacaaagtgggtttcagaatataaccaaagtaaataatagcatttttcaattagataatgaacaaaaatcgttttcagaaaaatattatcaatataatattgtcattcaacccttaatttcttttcaacaggcaggagtatatgaaagcaagatgtttattaacaaagttttcaaatttaacccacaaattaactgggaagatctaccacatagattggatttggaatatttacaaagtataatttacgttggagacatttacaaggagaaaaaaaacttggaaattgatacttggaaacctgaggagcaaaagaataatataattaatattttccagaaaataagttaa

SEQ ID NO: 3082 - DNA, 300 bp, Cryptosporidium hominis
atgatggctgtcgaaaatattaatgataagaaagaacattctttgattaataatacgaaaaaatataaacgaaaaattgataaatcaaaactcaataacattgatattgtgtttttagacgattttgataagattggatgcagagaaaatatagaagctcgagaggaaaaaaaattaaaagaaaatttatctgttagtcagcgtatacaagtatcttttttagttattcttgcaataactaacttattagtttatacaatagcattttgtacaggaaagaaattaaccaaatctaagtaa

SEQ ID NO: 3083 - DNA, 270 bp, Cryptosporidium hominis
atggaactcagtacttggagaagttatccatataaagagtactcacttccaaaaatgatattgaagtcaaagtctgcctcttccttaaatgaagtagttctttcctctcccttcctgaatggaacattcaaaaaagttagccataaaaggtatgattatcctatttatgaacttaatcaagtgggaaatggctgtaaacactatattaattatgatgttactattccaccaggtaagttgcacacattcttgaaagattttatatgttaa

SEQ ID NO: 3084 - DNA, 1398 bp, Cryptosporidium hominis
atggagccaataaaggatgaaatattttttaaaaaagatgaatgctggaaagaaagtgaaaaaaaatttcttgaaaatgagtggcgaaattcaaaaggatctttggaatcaattgtttcctccaattcacctaataattcggcagttacagtacgttcaaaactatctcaagattctcattctgatgaatattccgtcatgattgatgatgatgcccctgtagacgaagaaatatattttcagttttcagacatatcaattatcaatcgagttttttgcgatatctcatcagttaaatacacaacttactcagaaataaaacatatcttttatttcttgagctttttcttttttgtactttccatatttttattcgaaaggagttggaatggagttacaaaggttaaagtatactatgataattttggaaactttccactattatttaagaataatgaatactcttcgaatttaagtgaaatcgaatacgaaaatatttctgaaaacagcaaactttatgagtttactgttgaccgtactttacaagaaccgatttttgtgttttatgggattaatgggttttttagcaatacaaaagaatttgtgggttctaaacctcctgaaatatttgggtatggctacaagtgcacccatatactatccattgatgatattttaaggtatagacccgattttaggattcatcttgcagagttttttagagtacccattaatttcaacttcactcaaattgacagtattttttccaataataaaaaatcaagaattttcaaaatgagtaaaaaaaataattctattaatagaaatattctatgtggacttccgatttattctctctttacagatgaattcgagttaacaaaaaaaggctcaagtaaggaaaaaatacaaattagggccatcgattttccagaagatcaatggaaatataaaatgctccacagttttaggcaatttatttctggagcaattagtagcaaattcttaaatcagtcacataaatatgagaaaaaatcaaatgacaagattccgaaattatctatgatgttgtcaagatggtggagtcaaagtatttctccaaacttcattaagccatatggtataattagctcttcatatgaatatagcagtatggaagatatgattttgtatcctggctcgtatgaacttcattttatttcaaatttatttccaaacaatgcatggggggctgaaaagtatgtattatttatgaatttatcagtgtttggaggagagcaatacttagcagctgtaatttgtctgtttatagcaatagtctatgctcttattatttattttaatccaaaccgtgctcaaataataattatcaaaaatagaattgatcaaaatatctaa

SEQ ID NO: 3085 - DNA, 858 bp, Cryptosporidium hominis
atgacttctgcatatgattctattggaggaatgggcatgatggataaatgctactttacaggaaagagcgatcttcttaattggctaaattcatatttcaatttaaatgtttctagaattgaagactgtgcaagtggagcaatttattgccaaattgcagatgcagtatattattaccaagtcccaatgaaaaatgtaaattggggtgtcaaacatgattttcaatatttacataattataaattactgcagcaagtttttggaaaagttaatcagccaaaatatattgatattaataagcttattaagggaaaatatcaagataatctagagtttttgcagtggatgaagggattatttgatgaatctggagcaattgatcgtgactatgacgctataggaagaaggagccttggaaaagggccttttccacaatattctgggcaagtaattcctattgccagtattcagaatactttggctgattcctcatcaaatacagcaattaataattttaatctgggagcaaactccagaaattctaacactaaaaatatgttgccatcaaaaaatactgaaatagaaaaattaaaaaagtcgcttagcaaagaaatagaagagaaggaaatcgtagataaggaaaggatgttttatttcaataaactcagagcaattgaaatattatatgaagagttaaatgagaaaaaaattcctttcatgtctttgaaagatatctctgaaatattgtacgatagcaacgatatagacttagaaagcttctctaggaaagttatcgattcagcaaaaattaatagtaatgggttaacaagtactacttctggggtggaagagcaataa

SEQ ID NO: 3086 - DNA, 1227 bp, Cryptosporidium hominis
atggatactttcatcgtttctgtccgtgaatacggtcttaggcttgatggtaggacaatgaatgaatacagaaacgtaaagattaatttaaacaagaactacggcgaagtagaagttaatataggtcgaactcatgtattaagtgtagtaaaaagtgagcttgtagctcctagccaagaaagatcttctgaaggatttatttcatttacagtggatataggtcctttaagtataaaccctacaagccacgcatttcgtcataacagaacaactttggggactgaaatagccaattatattgagagaacactgaaagaaactggagcgattgatactgagattctatgtatattatcaggagtttgtgtttggtcagtaaaatgtgagatacatgtgctttttgacgatggtaatttgtttgatgcatgtttaatggctacattatcgggactaaagcactatagatataatgaaatagatgtagatagttttctgaaaaaatcaaaatgcgaaggattagaagaaagggattatcaaaggttggaaaatacaattcgaaagttagaaatgattcctttcaatgttcatcattttcccctctctatttccatagggtacattaatggcaaggaagggctctcatatattgtcgatccaaattcggatgaagaaagcatttcagatacaataattcatatatctattaacgataaacaagaagtctgtggaatcagtaaattcggaggtgccaagttaagtttgaatcaaatcaattttgcaattcagattgcaacaatacacagtgaaaaacttcatcaggaatttaaaaaagcttttgatggagaatatctaaaaagattaaaatgttctgataataaagggaaaattgttatagatcaatttaaaacaaattcgaaaagaaccgaaactgaatttgacacaaatccgcctttaattatgcaaattttatctaataatgaaccagataaatcagatgataaagtatcaagttccatttctttttcaagtcccagcaatatggaaattaaaaataccgagtttgatgagtatgagactcaacatgaatctaaattagaaaaagcctctttttcggatcgtatttgcgagagcctggaacaagtgcagcttgatcaaagtgttgaaccaattgaactattaagtgcagttaaatcgaatattaagattaagaagagaaagaagggttaa

SEQ ID NO: 3087 - DNA, 1536 bp, Cryptosporidium hominis
atggctactaatgaaaaatttgatgtattgagatctccaaattttaaaaaaccaaagtttggctacgatgtcattgagatctcatctgactcttctattgaatctaaattaggggatatttcttcaaataattatcttagattagaaacaccaatttatttaaataaactcaactttgaaaaaaaaaatttgaaaggcttatcgtttaaatctttgtttgtagtaagtgattgcacacctattgagaaatcagtttggagaattaaacatattttattttcaagttatttggcagatgttaactgggtaattaatgaaataggggattctgagttaatttgtgaaaatattgaatccatactttttgtttctcatggttttgacaatccacaaaattataaattaaaaaattgcaataaaatgaaaaacaaaaagatttcaacatattctccatatctaaaagttccctatggcgtatttcacccaaaatttattttattagtgtttgaacatctagttcagcctaaaaagaactttgttaggttcgttgttacatcagccaatcttattcaacaggactgggagctaaagatacaatcaatatgggtacaggattttttccataatattgaaaggaaagattgtgaattcttagattacttacaagaattcctaaaaaatattcttaatggatctaaactgaaagatttttggctgagcaaagttcaagaattcaacttcgaggatgcaaccgtaaaattagttgctagcgttcccggctatttttttggtgatgagatgttcatgtgggggcatcttagagttagatctttgataaagagatttgtttcaaaagaccaaggtaaatcagatgaattaggagaaaagcgagaaagaattatccttcagttttcgagtcttggaagaatatctgagaaatggttatacactgagttagcttcatcgctttcagaaatacctggaactaagcttgaaattattttccctacagttgaacaagttgttaactcgatagaaggaattaatggcggtggatctttacctgtaaagaaagaatatatttgtaaaccttggataaaaaagttactccataaatggggcacaggaactatggaaaagaatgccacagatgagaaagtaatacctcacataaaaacttttcttaaatataaaatatttgataatgctattaaaattatttggctagtccagggaagttataatttaagtaatgcagcttggggacaaatacaaaaagatggatctcaattctgcattaggaattatgagcttggaatatttattcataaggatcagtttgaatttgaaaggtattttaagcttaatgaagaatttccaaagtttttttggaaaagaaaaagtaatttttcattcatttcggaaataaatgccaataaacccattagacttttgaattttcctcttcctttcaagttacctccgaaaagatactcgaatagtgaccacccttggaatatagagctattaatgtaa

SEQ ID NO: 3088 - DNA, 621 bp, Cryptosporidium hominis
atgaatttgaatcaagagcaaattgatataaggttcggtaaactgatattggaacagtacaaaataaggaaagagctaggtttgctttttaatcagaatttttcaaatgttgatttgatttgctctaaatataaggaaaaatattggatacctgatgaatttttagagataaagttccaggaaaacaatgatgatcatatagccaaagagtttgaaagagttctacaagaacttcaaagacgtgaagaactaatacacgaattattagcaaagatagagaagtatgagtcaacacccaaagagtctaggtcttccagtgcaagttacttttcagaattagccgatacaaactcgggatttgctaaaacatctgaaaaaatcgaattagaaagtatggttgttctggaaaacagcaaagacagacgtttatttcaatggaggtctataataaatgaaatgattaactccaaatacactaaatactctgaatgccctagtaataaagataatggcgtaaatatcaaatgcaggcatgagagattagtaagcttatataagaatgagctggctactctgtacaaggaagttgaaaaacttaaaattggctctaagttacattaa

SEQ ID NO: 3089 - DNA, 231 bp, Cryptosporidium hominis
atggcaaaggtattgtcaactggaactgggaaaataaatcagtttacaggtgaatataataaatgtctcttgaaacccggagatacagtgattgttccagaatatggtggaattcatattcaacagttttacgaagaagttaatcatgggacttcattagatttaatggtttataaagaagaagatattttgggtatttttgaaaacgatagtaagaataatttcaattaa

SEQ ID NO: 3090 - DNA, 1239 bp, Cryptosporidium hominis
atgaaaacactgtatttgcttcaccttagaagcatttctatcttagttttgtatcagctaatactttttaatattttaaactcatcaagccaaacttcaaacaaagttacagaaagcaatgaaaataccgaagtcctgcccacttttgatggatgcaaaaatgtgttaatatgcgaaagagtagacacccatctcttttttaatttagaacttgggatctgtgaaaaatgcaaagataggctattggatgtagaatgctcttcaattccaacaattaataatgtataccaactgcttagctttacaaacggcttcgataaagagtttcacagagcaaatggatataataaaacaacttcaatgatagaaagaggcgcaactaatgaaagttctattttgttatcgggaaagtttgttaatttaagtggggttgaatattgcgctttggatgaaaacaaccaaattgagttgtttcaagaaatatacttgatttacaatcaaaataaaaataatgaggatttgacccttgatataaagttaataaatccatttcaagctgctgaaaataagacgtttgaaataatttctaattgggagattaataataaaaagagtaaccatgcaatgtacgcgtacaaaaaaattaaggaaaaaatgtttgataaaaaattcaaatctaatttagatataaattctcgaatctttaataacattttctcatccataaatgttatttttaattcaactaatgaacaaatatttgataatgttaaaccatgtataagaatttcttgccgtaagcaaaaaaagaaaggatctaataataaaaatggtgagaaaaacaaagtagcagtatatgatattgttacgtcagtcaatctactgaaaagcaaagtaaagtcagaaaacgactatttgttttatgtaaatgtactgattaaaacattattgaaatcattagaaaggaaaactaaaagaaagaagatatctattggatgtacaatcaagatcatttcctgggttaaagagctatgtgaaatactaggaattcaaactgatgaaaattcaaatatgggtagatatatttcagaatttttaaaaaatacaaaaaaagagccgaactttagtaaaaaaaccataaatgttaccaatattgtggaatcaaaacaaaatatcagatttatcgaggctgaattagaagattataaaaaacttgaagaagaattgaaagaattctag

SEQ ID NO: 3091 - DNA, 348 bp, Cryptosporidium hominis
atggctcctataacaaaggttcataaaactcaacgtttcattgttgactgcactgctcctatgcaagataatatcatcgatgcatctggactcgagaaattcttccatgatcgcataaaagtggatggtaagtgcggacagctaggcacgaagattcagatttcttgccaaaagggtcgtattactgtattgagcgaggttccaatgtcaaagagatacctaaagtacctaactaagaaataccttaagaaacaacaaattagagactttctacgtgtagttgcaacaagcaaaggttcctatgaagttaggtacttcaatattagtaacgaagcaggtgaagagtga

SEQ ID NO: 3092 - DNA, 1383 bp, Cryptosporidium hominis
atgttaaacattccaagtacggttgatgaccctaactatcgttacaagatgcctaaattggtatcaaaaattgaaggccgtggaaatggtattagaacgaaaattgttaatatggcagatattgctagatcgcttaaaagaccacctgcataccctacgaagttttttggatgcgaacttggtgcattaagcaaatgggaggataaggaggaaaaaagcatcgtaaacggagcgcatcaacagaatgatctccaacggttaatggacaagtttattcaaatgtacgtactatgcccaaattgtgagctgcctgagattgacataatcgttaagaaggagcgtgttagttgcaaatgtaatgcttgtggatatattggagcattggataacaatcataaaatcaccacatatatttcaaaaaaccctcctggtggcgttgaaagtacaatgggaagtaaaaacaaaaaggaaaggagggagagagataaggatcgtagttctgagggctgtaataatagcaatggctctacagcagctgataatgagaaaccgtctaaacataaatctaaaaaggcgagtaagaagagcagcaaaaaatctccccatgaattagatatatttgagaaggatgtcttgacatttgaaagtccagagatagttgatgttattgaacgcctaactaatttcatgcaaaagaatgaggaggtaagtcccgaagactttttttccgagttgcgggtcttgcaagtatcacaggactttgatgaatttatgaggttttctgtattattaactgtgctatttggattaaaagatccaattgatccaaaagtatttaaattaaggattccttatatttcaaaagccgtagagggttcgttaaggtcaaatgcaattatttctatatttgaatcatattgtgttgaaaagaatccaagcacattagcaacatatccatatttaatacaacagctgtatgatgcagatattttatccgagaaagtgatcttgaaatattatcaaaaagatgctccaacatcttgggtatctggatgttctactcaagacacatttgaaaaggctaaaaaatcttgtgagccgtttgtcgattggttgctcgatggtagcaacgatgaatctgatctgagcgatgaaaataatgatgattgtgatacaaataactccgatattgatgaagacgattctcattcgcctgttaggagctctcgtgtaaaggtcaaaagcttgaatatttcagaaaaacttgatagttataagtttgaaagttgctctggttctgaggatgacggatctctaactaaaaacgtggagaattctcagtctcagaatagtgactctgaccttgatattgacaatatctga

SEQ ID NO: 3093 - DNA, 249 bp, Cryptosporidium hominis
atgtctatctcaccaaatatggagtttttcaacatttcaggaattgaaggacttttgggtaggagtgaaatcgcagggaagataatgcatgatgaaacttcaaacaatagttcagatggacatttgtatccatttattgagctcaattcttttgactcaaataattcagaaagtttcccattgttaaattctttgacaaaaaccaagtgtagctcaagaaaaatgggaatgcagcttggatgtttttga

SEQ ID NO: 3094 - DNA, 537 bp, Cryptosporidium hominis
atgatttccttatcccttggattaggactattatcagaaagatcaccagaagacctccctgaatgggcccatacattaagcagcgtttggatgttatcaagattttacgaatcatttcctatatcagcaataacaggtgaatatttactaaaagagctaccaaacatccttgaatatgcaacaaaaagacactggaatgatttgaatttatcaattacatcattaattttgaaattaaaacaatgcagcccaaattggataagaaaaagagatctaaaagacaaaaactcaaaacaaaatgaatccgctcttactttaaaagtagccatagaatctacaaagaagaataattttatttcatctaatttgtacccaataactcccagttcaaagaatcaagatgaaaaaattaaaaacaattcatcacggtcagaatttaaaagacaaagactgaatgttgacgaatactgcttaaacaaaactagccactctaactccgcaaattctatcaaaagagaagaacataggaaaaaataa

SEQ ID NO: 3095 - DNA, 699 bp, Cryptosporidium hominis
atgaattttcgattattaatcagagacttgttaaataaggacaaaacattttggtcaccactaattggatgtgcattgattcactggtctttaggctttgcaaacacatttggaaatactgtccccattattgcaagttatatttcactgaaaggaaaacacaaattacgagcaggaatgatttgttggatcgaatgtttttttgtattgttccagggaggagcaaactatttgtatccaagtattgaacgcatgattggaattccttcttgtttggttattggattttttttttgtaattttgggctattaatatcatatttatttttggaaagttatttgctttacttattcggttattccattctatacgccattgggaatgggctactttttgcatccacaattgaatttttggctagcaattattctaaaaattctcgttcaaaaataattggggtgctttggctatttagaggagcatcaatgtcaataattccttcttttcagtcttcatttgttaatccaatcaattcaaataattattatgtttatagtggtaacaaattttttaatagtttaatagttttggaaaaagttccaaaattgttaaaattaacttttattttttctgcgatactccaaattactggaattgcaaatctagcaataataggaaggaaaggacccaagaattaa

SEQ ID NO: 3096 - DNA, 1140 bp, Cryptosporidium hominis
atgaatgatagcagaaggtttgtttggtgcatattattaaaaattagtatagaagacattaatagaaagatttcaataagcaatctagtacagaacgctgataaaactcttattaaccaagtaaattgtgacgtagaccgttgtgacttgcaaagcgatatcgataaattaaatttaaagcgtttgcttatttcagtcttttcttatcgaagggaaaattattcttatattcaaggtattcacgaaattggaaaagtatttctaacattattccatgaatataagaaatctaatttggcaaatattaaaaaaaaattgtctaaattaattgtattttctgaaagatttgaagctattattctatgtaaacttttaataaagaagttcaattcagaaaaaggtagagtggatatttgttttaaggcttttgatcgatttcttatactttactcaactccatatatttacaaatcagatagtttagctcaaataaatcttgaatacattctttcgaatatttctcgggatcttctttacttgttaaataagagatcacctattttgtataattttttcgttaaattaaaagcaaaagatgataaagaatcaagcgtctgcatgtttattttgccttggataataacttatttttcacataatatttcagttaaacaaaaaaaactaacatattacatttttgatcacattatttcaagccatcctctttatatcgtttttcttattgtagaaataataatacaatcagaaacaaagctttttgattatcttgagcaaaattttggattagatatatcgcttaacttcgaagaaaacgaaatatatccttttgttcatttttttttccaaaatttggacatttcaaatctcaaatggaaagtaatagtaagtagctcgcgcaaatatttatcgagcacaagacttaatatattaaatagctattttttgtgggaagctggaaaaagatctaaacacaatttaagaatcggtaaaactcttttttctaagattaatgtaaaggtgctaatatattcaatattcttagtattgatttcgagtttattattttccatttatattggcaaattcaattttctgaaaattattaaaaaaaaaaattag

SEQ ID NO: 3097 - DNA, 699 bp, Cryptosporidium hominis
atgagccttttatttgaagaaatggatgaaagattattacaaaagtatagagcacaggtctttgagtggggaggatgcttcgataaaatgtttgaagcattaaagtcattaatttacctttcagaatttgaaaactctgaatttgatgatgaggaaaggcacctgttgacattatgcattaaacataaaatttcagattatagaaccatgaccagtcaagtattgcaggaacaaacgaaacaattgaataatgatgagcttgtaaaaatatgcagtgagtatgttttttcacttagaaaagatattaaggcgtttttacaatcgtttgaagatggtgtagatcgcttggttgagaaatcattttttagtaaattctttaagttaaaggtaaaatctgatatttcaagatataaacttgaatttggactttgtagtctagaagattctaaaaaaattcatcaagatgcatttactctattatgcgaacacccagataaaatagagcaattaccattgggatttatacagaatctcgcatacattctttcggagaaatacggagaaaaaaaacaagtatttaacatgctaaattctgtgggaaagatactcgagcttcaaattaaagagcaagagaacatggatagaaaggctcaaataacagtttatttgcaagggattaaggattatattgaaaaatga

SEQ ID NO: 3098 - DNA, 723 bp, Cryptosporidium hominis
atgcagcaaaataaacaaaccgtaggtggaatcgggcattttcattcgtcacccaaggacgtcgaagcgcagagccagatttcatgcgcagcatataaacaacaatggattgcaaaggtagcgagggttccgcctagaaaagttcacacaacaaatatctctaggataaaaaataggctatttgcctttaatcaaaggagctgtgcgttatccattggaacaatggttggaaattttagatatatttgttcttgggctaaacttcttgggttaactatttcgtcatttctttttatatgggtattatattgtttttcaattataaaatatttaaaaggagaccagcatatcgaatatttttatacaaatgttctatgcttagtaatatcactaatatcttttaccatgctatctacctcactaattattccaaatttgacagcaataaacttaaattcaatggaaagctcattgttggcaggttcaggagtagcgactcgaaatttaatttcatgcaaaactttgtcaacgctttatttagtcatttcacttttatcaattttcacagcattgcttccccaaatggaatcgtatcattttacaattacaatgctttcaatgatacttgccacacatcttgcgccttcagttttgttctatattgcttatttgcgtggcgaagatggctgtattgatgacagaagtcatcatacgctaatatag

SEQ ID NO: 3099 - DNA, 1161 bp, Cryptosporidium hominis
atgcttcttggtgctatgacaagattaattagtaacttgacgcaatttgaaggtaatgaaaaaaattttaatgaaaatatctcaggtgaatttgaatataaaaacgacaaagtacctattcttaagagtcgtttaagttatagtaaaaatagtggaacaatactgtggaaatattggaataaaccatctgaagcatcaactaggaataattccaatgatgaattatcacttctagttaatcaaaacgaactatctgaaagtctaacatcaaaatcatcattattcgactcaggaaatcttgataaagaaaagaatagtgttggtcactctgtgatagaaattaaaagattcaatgaaagtaatattaaacaagaactgagaaatgcaatatccagaaaatctgcaaattatgggaaagatagaaatcaacttcatgaaaacaataatagtatgcaatttaattatagaagttaccctctttcaaattcacaaatttcaaattggatgaataactcctggtcagaatatgaaacagtagaaaaagatataaaaaaatgcgtaataatggaaattgataaaatcaacaataaaactgaagaaaataagaaaattattactccatttcattcactcgcaactccaaaaatatctataggggattacttcattagtagaatcgtgaaatttgtgtccctaacacctgtcgatttttgtgtaatggttattttaataagaagagctgttgagaaatccaaaggtagattgagcgttacgtccctaactgcgcacagactcgttttggccgctgcactattaacatacaaacttatgtacgatgtacaatatggaataaaattttgggcacatattgggggtgtgccacaatgggagatgttaatgttagaatatcatattttgaaaatattaaattgggatttatcaataaattaccacgagtttaaaaaaacatatcttgaaattttatcaaataaagaagtgagaaagataatgatatcaagtaaagcaagtagcagtaagatcgataggactgaataccaaaataaagctgactactctcaagttaattctgatagaaataaacgaaccaagttgcaactgaatgtgtcgaaactaagctcaaatcgcaagaaatgtgtgtga

SEQ ID NO: 3100 - DNA, 735 bp, Cryptosporidium hominis
atgacatcttcaatcatggaaacatttggatctctcaactatgaagaggcgttttctaagcgtggtataataagtacaattgtggggatattattaggcctagtagtttcaactactgtcaatgcaactctggttgaaataagtttatcgccttttttctcaacatattttggcctcttatttgtaataattggaggattgatattttggaaggtatatgtaacaattattccagatgaaaagaacgctttaaataagcgaacatctctattaacatttgctgcgctgatcatattttccggttttatctgctttattcttgagaatgattggttccttggaatgacaccaattattagagtaccaatttataccattctcggcctctctatttcatttgctattgcattttctcttgtagatgctgttaattatatttctggctttattaccagtaatgacagtccattgttggttaattcaaaagctcaaataatatttgtcatttgctcttcattatttattggaattatttttgggtttctatttgggcttattgaagacacacacgagcaaattcactatgtaaacatctcgttaatgaagcaaaaacattattgctatacaattggagttatagtaggtgcgttatgcggatttggtaatgaagtaattagattatcagatagatcttatatgatcgtcgggaaaaccgtgtatgactcagatgtttag

SEQ ID NO: 3101 - DNA, 618 bp, Cryptosporidium hominis
atgaatcgggtaaaacatcgaatttgttgcgaaattttggaaagagaattacccttattattttataaaaatgctttatcatttgagagtcggcccactgagaaaagttctccagtccagttgtgctatcctgatctgagcatgactcttggatttcacccctataactttaacatatatcaattaaatgctgatgctgaagatgaagatgttttcgaccgtccttcaataataatttccactgaatgtaaagagtttaataatattagagaagatgtctatcgttggggagttttatacttaatatgcacagtcttattgcttgtttatattttgaaaattattatggagagccagcttaatattaatcacttcatcggtattaaaactaataaaacagcattccacattatatgctgtttgctttcgttttctccgctattagcagttactgaagggtgcccatttttcatgattatctataaagctttattcccatcgatgcttaccattacatttgtttattttttaaatgaggtgtgggacatattatttgtatttctattttcaatagctagattatctatctcgactattcaatataaaatggtaagttaa

SEQ ID NO: 3102 - DNA, 774 bp, Cryptosporidium hominis
atggctccaagaagtagtgaattatctacacaaataaaaaatgaaattgtaagtaattattataatcaagattcaatgtacatattaccaaagattaacaaaactacctttattattcaaatgcaatttaaatcttcaagaaaattacaaaggttcataccagttcactttcatccaattttgatggaaccactaagttctcgactcttttcaaacaaatcaacatttattcatggttgggtggatgatacacatcatattgaaattatagttcctttaaattccaaagactattttgaattcccgatacaaattttattttggttcggatatgaagatactagacttatcgcctataaaattaaaagccaagtattagatgaatatatggttaattttactgcaaatcattttcagggggaaataaaaattatgaagaccaccagagacaccagagcttctattgcggatttgaatacaattttaccattctttattttgttagaatttaactccaatggacaaaaacacctaattaatataattttcaaagatagagacattagtaatacaatagaatctcaagggaacacattatcaaaatattttatattttcaagaccaatgagagttaaccaacatttatgttcaatattaatttccctagctattctctcaatttctcttttctacttcctgtataaaaagaaagaagtaatttctagggagaacaattcatcaccatttaggaaattaaacactcaaaagtggtag

SEQ ID NO: 3103 - DNA, 363 bp, Cryptosporidium hominis
atgaaatctcaaataaagaaaaagagctttaataacaagacaactgaacccgtaagactatactctaaagcaattgttacgggttacaaaaggtcaaaggtcaatcaaactccaaacgtttctctacttaaaatagaaggtgttaaaaccaaagaagacgcaaagttctatttgggaaagagatgtgcatatatctacaaggccaagacaataaagaatggcacaaaattcagagtgatacaaggattgattagaagaagctacggtaacagtggtgcagtatgtgccaagttcagaaaagcattaccacccagcagctttggaggcagagtacgagttttcctttttccaagcaatatctaa

SEQ ID NO: 3104 - DNA, 582 bp, Cryptosporidium hominis
atgtctaatgaaaactcaagcttatatccgaagcaattttcaatttgtacgagcgatggagtaaaattaagttgcagaagctttggtaatattccatcaaaagttccgataactgagatcgaaagtatagtttttgtgctagttcatccatatgggataatgggtggtagtagttctaatatgcttggcttagctttgagtttggcagataagggatatggtagcattatttttgatcataggggaattggtaaatcaacgggatataagtcaatttttggaaataacgaagtttatgatgtagtctctgtatgtaatgatataaaaggaaagaatagtggtattaaggttgttttaattgggtcttctgcaggtgccccaattgctggttcagctgttgatgaatgtgaaaatgttataggatatatcggaataggatacgtatttgggttttggccatccttgttatttaaacaacattacaacaatattcttagatcgaagaaacacaaattatttattatgggagattccgatggattcacttccattgatgttctaaaaaataaaatggacaagtaa

SEQ ID NO: 3105 - DNA, 2217 bp, Cryptosporidium hominis
atgaaatttttaaacatcaaggatgaaaatgatgaggatattatccttctagagaaaaaacttggaataattaaaaaagaaggggtttctgaaacaagtattgaaaaaaaacgtaaagctctatacaagaaaatagagagagaagagggaattggagattttatggacttaatagatggaatattgacagacgttaacaaaaaaaaaaagattgaaagtgaatcaaaacctaataaaaaaaatataagaaataaaagctgtgataaatctttcaagtccaaaaactttcctaaattaatctgcgaatcaataataaattggcaaaatgaatttaggcaaagagctcaagggtttttaaatagattaagtgaagggaatatgactttaattttggaaaagttaattgaattaattaagtatacaataagactagcttacaataatcataatttttgtgacaacgacctgcttaaattaagaagtgaatcaattaaaattgtattaggctattttgatagcgactactatgtagtgcatcggctaatcgcaattaatgacattattgaaagtgagttaataatgttatttatacaaaattgcattattcaaccacaaaatactgtttcgttaaatacagtatattctgcgttgatttcttctattggaattaaattagaaggcagttttaatcggagattaataataattttgaataaaatatataacgaaactttgaataaaattttacggaatttgggttcaaatatagaaaaatataataataagataattttgagacatattataatctccttgataactatttacaggtgtggtttcgcatcttcaatagtaattcaaaattttatcgatacaggaataaatggatataaatattcaaaatcaaatataatttactgggagtgcttttttgataatgtgttaactatcattaggggatctgcattttatataaaagatgagagtaattctgtatttgagaacataatcgaaaacattgggtcagaaatttcaaaagattattattttgagcctcagttaaaaaatgagattgaatcaagcaacctaaacattttcgtaagcccattaaaatttaaattcattattgaagagttgaacgagtggagagaaagttcgaaaaatcaagtattaagccaaaaattgagaagaagagaaggcataattgagagacagttaaatgctatgcatagttggtcgcttaattgtatcttattgaaacatatgcaaatgatacgaaatggaaaaaaaaaagctccaacccaatctaaactcgagatagtgtcatatcctaaaactttaattgaatatatatggcaagaagaaaataaaaatttacttttatggtatttaaacaaaaatcaggaaaataatttagttaatcaattaattggcttttataatttaggaataaaacaattgaacccaaaacgtattatacatgaaaaaattgacgctaccaataatgttattaccaacaataagttacttgatctggcttcaaagatgagatttacctctgatttacaaaagagtatttttgttgcattactaggcgcaatcgatgaatttgacgcaataaatagattgacttcattaaatcttacgcaatcaaagacttacttaaactcagcaatcaatgtcattgttatttcttcattatttgaacatgtttataatccatattattacaaagtattgaaaggtttaactgtgcttcctgcagttatttcgaaaaaaataaacaatgaaatcattaattgtttttctcaacaaatgggaatattagataaatttaatataagaaaaattatgatttttagtcaattagtcaaggactgcatttttggtcggatttttgatttgaggattattaggtttatcaaaattaatgacattcatgcattgacagggtctattggtttgtttctaaaagagttaattatattaatattgagggaagaaaatgaagctgatgaagatgcatttatttttgagttattctctgctgtttcaaaaatgtcagaactaaaagagacaatcttattcgttctacaagcattagcggttcccgcaattgaaaataacaatgaatctaataatagttatgagatcttaaaaataagaatagcaagaattacaaaattattaggtgataatattactttcttaaaatag

SEQ ID NO: 3106 - DNA, 1842 bp, Cryptosporidium hominis
atggatatcgagctaaatttagcgcaaatccttccaaaagaaagactacccaaaaatatttctccaaaatggtttatctggtcaaaagatgatattgcttatcagagacttgtagatagacttaaatcgcaagcatatatgttcgagtctgaaaatttttttaaaaaagttcaagatttcacatgcgtatctctacaaatgtctccttattgcgatgaagatttaattcaaagattttgtgagactataactgctattaattctccaatcaaaaaaataacttttggtattgatacttgtgttcataatgaattgtttgataataagctaagatggacaacaattccgtttgatgcatctaaattattggatcaaaaggaaaatactaatttaatttattcaagcattcctggaaatgaatttgaaatgaactttacacaagatagcatattaaatgctaatataatcgatgatttacctttatattgccaaattcctgcgaatattcatattctaagtttatttgaaataattagagaattaaaactatcagaatgtaatgctcaatctacaatgagtgaatatttgggcaaaattaataagtatgcagaaatttataatggtgtggcatatcgtgaagttctagaagaccattgtaaatttccattaacattcttactaaatataaattcaaaatctcctaagcaaggtacaataatccttcttacaaacgaagaaactgatgaattatacaaagataaaaataaaactaaattcaatatatgcaataatttaacctttatcgatattagtaaggaatttaaatactgcaatcaatataaacaaataataaatgcaataactgaagactacaatgttaagaagaatgaatatgacctgatttatattgactcttattgccatttagtccctacattttcattaggccaatttgaagttgaggaaagttttaaccttgtgacaaatattatgattgcattgaatttgataaagtttggtggaaatataattatttcattgaagacagccttaaccagattcacagctggaataataattgttttaagctctgtatttgataaaattgctttaagtaagccgtactcttcctcttcgccttgctattcaaatttttatttaatttgttccggatttaacgatcattcaaatacactttctaggcactttttccaatttttatgggatgttttttcaaataatattaaagaaaatacttcaatagtacaatgcgtccccccgactctattcgcttcagataatttccttcattggctgaaggaatttaataatgaagcaatgctatatgatatagagatgttagaagcagtaattgaacagcaagaatcttctgatcatcttgggctgtatatttcaaattgtggaaaaagacaaaaaaatacagattctaattgggaagattttaccaacagagtcagtatccaacgtgagatcttgagatatatattaattggagcgaatagtttaagttcggatgaggctttcttgaagctctatgggcaaactagagaaagctacgatacttttaaattggaaaaaatgaaaggaaaccataagactttaagtgaaggagaccagaatctaatagatatagatattcttcaaaatgatggccaatatcccaattttttagagcaaatgaatgctcgccaactcgaagaatctcaaagtgacaaaaatatagatccatttgaagaccaagcagatttaaataaagaaatagatgttttttgtatctcacccgaaattgaatataatgatccatttgcccaaaataattga

SEQ ID NO: 3107 - DNA, 1197 bp, Cryptosporidium hominis
atgcgaaaatatactcgaatctcagacaatttcttcgtccagggtgaaataatgatgtcaatattgaaatacacaattggaaatgtagaaaatgggatagtctttggtatagcagaccacgagaataaaggagatgcaggaattaattggagccaatatctagtatttaagcgtctgaatattaaaataatttattattgtacttcaaattattctcacaagccttgtgatattaaaagagcattaaatattgcaaatactctccctcgaaagccaacaatatttttaactggtggaggaaatttaggagacgtatggccaaagtatgaatatgaaagaaaaaaaattcttgaggaatttcgtgaattcaatacaattatttttccgcagtcaatatcattaaaaagcaaagacactataatagattttgattatttaaaaatgcataagaatttaacaatttttgttagagacatttattcctttggttttttacatagtatattattcaataatcaaagtacaactaatacaaaattgcttttgacacctgatattgttacatcaatagtgaccacgaaggagaaaaaaagtcccaacactacagcgcatttagtatttaataaaacctatgatatattatggattaatagaaatgatagagagacaagtaaaagacaatggaacaaaaattatgacgcaaatttaaatataaaagttgacgattggattaaatttatgcctactacttattcgaaaggtattttatatggaaataaatatattctaaaaagtggagaggagattgcactaccccaatttgtctcaaataatgtctttaactccacttatgaatatgacgaaccaaattttgatgtattttcaattggaatttcgcttcagagattttgtgccgggcttaattttattctccaaggaaaggtgataattactaacagactacatggacatatattttcttcacttctcaataaaaatcaaatattactagatactaagtttaaaaagatattaaactactataaaacatggagtttttcaatcaatgaagattatattaagcttgcaaactcggagaaagatgcattggaatcggcggaagaaatgtcaagaagatttccaagtgacaaccgtactgaattattctttatatattgtagtaagttatatttataa

SEQ ID NO: 3108 - DNA, 1626 bp, Cryptosporidium hominis
atgaaaaaatttgcaataaatgcaaatagaaaaagagtcatcaaaggtataattatagaaactcttactatcttaggatggaccgttggttctgcactacactcaattttcacgaagaaatcgtttaacaaactgtcaaaggatgaacctattagttcaagaataatttttggttcgtttttaaccattgttcagttattattggcatcagttactggaatcctcatatgtggaattattggtattattcatagaagggaaattaaacaagattctttagaactagcaagtaatagaatagctatcaatggaaacgattcaaatattgaaggcagcataacagaaagcacatgcgaaaatagatttgagcaaactgattttacgcaaatatctaagtctagcagttatatcattgatggagataatattgaaataagtaaagaaaaggccgaattcaatgagttcgatactaatttcaatatggatgaaaatgtaaatattagttatttaatactaaataaggattataatttgaatactttcaacagaaatattaattttccggaggcatcatttgaaataggatctaattacgaaaacgaaccaaaaaaagataaactaattacttcggcctcaaatagaagccaaaaaaactcatacaacaaacatatttcgaaagaacgatggtgggggagtaacaagatgttattttctgcagccttgtacgctattgctaatatctgcgcaaatacggcacttggcggaggaaaagtcatgctagtccaaataataaagtgcagcgaattaatattgacagcaatactagcgttttttgttttaaaacggaaagtaactgttagagaagtaatcgcattttcaattagcacagttggcataatacttgtcgtcacttcaacattaagtaacggaaatgcaggttcaaaagtaatagtatatagcgttatacttgcaggtgttggggctttcacaatatctcttagaaatgttattgtttcttcagcaaataaaaatgagaaggcagttggtacctttactatattatcattttggggaatgatcacttcattggcaatattttccataatgagtattgcatttggaggatttcacattaatgtttccgtaatgccattactcatcagtggatgttttcatgctacttataatttttcttccttggcatttttaaagctagttggaagtcctatagtgcacgcatatttcaatttagcaaaaagagcaatcattgtattaacagcagagttaatcaactgtacagctccccccattgtacagatatttggcagtattctcgcgattttaggtattcacttctcaaaaaagagaaaactatcatttaaaagtaaaaagaagattatgcccagttatgaaaatgaaatccaaaataaaaacactgattgtaatggcaaaattggaaaagttattaaagaacagcataaagaagcaaagattgcgaataaagataaatacccgtacgctgcttcaattgcaatttctagtctatttattattattggatggataacatcctatacatgttcatgcgtactgccaaaaaaaagcttaacgcccatggtaggttga

SEQ ID NO: 3109 - DNA, 4416 bp, Cryptosporidium hominis
atggaaatactaactcacgatgatactgagtccatcaaatttatacatgggcctagattcagattatgcaataataatcctccaagaatactaatttgtaatcctctcaaatacttaattcttgaaagagactcgcaaataatcatttttgacttaaacattgtattatctaatccagatggtttggcttattttgaaagtaactttgatcaactctatcaagctcaattaggaaaatatgatattggccatgaatctactattattcacatggtttttgactgctcatcaactattttgactattgttactgagaggaagattctactttttgatttgctaaacatcaatagaaaaagtgaatggatgagtatcaatcatgatggaattcaatcattaacttggactcgaaatcatgatataatagcaattgaaactgatagttcttgctctatttaccactttattccctctgaaaggaattttcataaaacaaagctaatattagatggaatttctgatgggtttaagctagtagaggctcttaagagtagtttttatgaaattgaatttatattaattacagaaaatgaaaaaaacattgttattgtaacaaatgaattatactatcaaatcatttcttgcagatccaaattattcactattcctcaatcatttgttagagcattttccattttaattgagcctatattaggtttatttcaagagcacaactccgaagcaaatttaatttgtcagctaaatatcgtatctgcaaaatttatagacggggatgatttatatctttcaatctcacttataagattttcagagtatgtggatgggtatgttttgttcttcaagatttgtgatgatatgaaaattgagttgagctcatattcaattaatgacttatgttttgataatgttgattctaatgacatagatcaaatcaagaaaattcgttgtgtttctttttgggtcaaagaatggggaattttatttgtaggctctactgtattttcacaaatggtcgttttcacatgcaatcattcatatattaacaaagaaaattttagtgatttcataccgcataaatgggtgaggcttgcaatgtgtgaaggatacgatatcaactgcactgattttgatattggtatttttgactcttgtctctgtacatgtaattcgggatcaatcagagaccctaaatcaacagttgacgctccagaaattcttcaaccacctgccatttttattgctgagaccaacggcgacattattacccattatatcggaggaaacccgaagctaatcaaaccaattgaatcagaagaagtagtatctttgatcacaaatagtgacctccaaaatattaactcaaatgaccaggatcttaaaacccaatcttcgccacccaaacatctatacaattcaattaattttcctccaacacactttaatatttcaaagattgatgatggcaaatcttcaggggtttttgaacaaatgttcaccactccagaacgcgagttattaagtcaagaaatttttacggtaaataaatcaggaaaaaagctattcgattctattatgaagatcgattatcaagtgtcacaattagaaaaaaaatttattgaaattaatgaccaatttttcaaaattttaaactctcaagaaattcgaggattattaaatttgtgtggaacatcgggtaagattgaaccaaatttcagtgagagtgttgatctttatcaattgatatcaaaatctaatgaaatatcaaatgttgaaattcagcttagaagaatccatttacacattatgaaaaagatttcagacgaagtttataaaaataccaatattgagatactaaaagaaaaattgaggaagaatgaactaacttcaagtcaaatatcgattttatttcaatataatatggaattatttgacgcttatacaaataatggctttaatgacaaccaaacaattttgaattcactaatcactattgaaagactttctcttaaattggcttctagaatttctcaagtttcgatattttgtgaaaggttgaattccagaaggagttgtgagctcgaatttatctcacttccgccgcctgaatatagctataacattttgaactttaatgatcaaggtttttcgactccaaataagattcattttgattcacaattaaatgctcatttacacaagaatatctcttcttctgtcaatatatcaaaaaaaaagaactttgttatacatccagattcaaaaggaaaacatcactcatattcatcaaagagaagcatcaacctatctgatatcattaataatatttcgaactcagtaacagatgatgattcgtgcaaattgtcatttactcaaaatgatgaatctaatattataaaatcccaaaaattaaaaattaacaatttaatgaaccagactaatactcccggaaggtatattcaactcagatctaaatttactggatattcctatgacgaaattcagtcagacaatttaggtgtaattgataaatccgcattacaaaagaatacccctttttttgaattatcatggattccaggattagcagaagataagactggccaagttaaattaacaggaaatccgaattttaaatttgggactaaaaataaatatattaagccgggaattcttaattcagcgctcgcaaactgtattgagaggctggagagaattatcgatcattgcgaaattgctaagggatcaatttcattcattgaaagagaagaattaattccagcgctcagcaacaaaaaaggagattcagcccagtcaatggaaggttcaagcaataatttacaaaatgggagcagagttgttgcttctcaattgttattatcaaggaattcgtttttgcagaaaaatatgatgtataggcaaaagctatctttgatcatatctggatttataagtaaactatcagacaagagaaaactgtctagctttcaaaaaattacaaactcttcaatgattaatttcaagtcaaacatttctagtaagtttaacgataaaaatcgaatccaggatggctttaaagaagaatgcactcaacctcaccctttcatgttaccagggaaattccaaaactcaatacactcatattataaagctcctcttttagaacgccgatcacaaattgatgcaaataatctatttggttgcattaagaatactctagaaaaaacaggcttaaaagatcatggcaatgcgctagaaactgtttctgaaacaaacaatcttaattttggtaattgctctgaattgaaagcaattgaaaaagatatcgaaataaacgcaaatggttggcaagaaattactcaagagcctacaaaacttcgacttagtttggaagaatccaattttagtaacaaattattttcattgagcaataatttagatgaaaaaacttctgattctgccttgaatgaaaaatttactgatatagattctaatgatcaaaaaaatgaaacaaaaaaagatttatgtgaaaacgggaaatcaatgcatgaggaagatataaaatcctctctttttccattaagcttaaccaataacgatacaccaaattcaaaaagggcatccgaaggattatttacattttcaacagaaatgaatatttcattaaaccttaaaagtccaatatcagaaaaaaaatatacacaggatatagtttctaatgaatcaaatatcttttctttcagttctgatagcaatccattgaaacctattaataatatctgttctaaccctaaaaaaatctcagagaataatttatcgtacgttcatataaaaagtgaattaaatagattcgatgagtcaactgttccagaagtgcaagagtctgttattgacagtaacactagttctaatgttggaaatggtggtccaagttgtaatattaaagatattaatgatgaaaggattagacaaacgcctgaaggtaattctacatctccagctaatcttggcggcttgcttggatttcctaattttatggcaaatttaagtgctcctaaagtttctggctttggttcatctcaattcttaatcaatggtccatttggttcgaataaaagtgataatttatgcgctaattctaacaattgttgcaacattgaagaacagcaatcgtttgggtttcacacaactaatttgaacctttcaactcctttcaaaacccatccagtatcggacaattcaatgggaggatttgccacattttcttctgaatttcgtggtttttctcaaataagtgagcaaaattcaacaagcaattctttttcaaataactcaagcagtaatatctttaactttgctccgcctcaaaaaccgaggcaagtaaacaagcttgattaa

SEQ ID NO: 3110 - DNA, 1740 bp, Cryptosporidium hominis
atggatgtaactagggataggattactgagtcttctctttacaatgatttattaatcagttccgttttgctagatgatgactcattagacactctaatcaaaggatttgattccatgacacacgaattacgcgaatcatttaataattacttaagtaaagttcgaaaaaaaatcattaatgagtttgagagtctaaagtatgaaaagttatcttttgaacaggaaaaaaagcggataattagagaaatagaatgtaataggaaagctgaagttgagaggatgcaaaaactacgcaatacattggaagaagaaactgaaatagcaaagaaattaattataaaagaaaagcatgataatgccaaaaagctgctaaatgaaaaagaatcgttttataaaaaacaacaggaattagcaaatcattggcagatgattgaaaacaaactgaaccaagaaagattagaattagagaaaattaaagataaaataacagaaataaatttctctgcaagatctactgttgaaattaatgttgggggaactatgtttgaggtttcaaggagcatattaactgaaggaaaggcaaagggaagtttgctaagtagaatattttcagataaaacgcttgatattgaaattgaaacggataaaaatggaaatatattttttgatagagatccggaaatttttaaaataattataaactatcttagagatagtgcaaagtgtcttccatctccttcaacaacccaaatgagtcttaatattttaaaagaatttaattactttgggattaaattttatgataactctttgatatatgttttcgggggttgtaatggtgaaaagattcttgatacttctgagctgttcattactccaattcatctggaggatgacttttcggaagaaataaataaaaatattggttggagcaaagtaaaaactatgccaacacccagagctcatggttcgagtactaatcttgacaattcgaactgtgccttgtttggaggatacaataattcaagtaaggcgttagatagtctggaaatatatgatcctctaatagattcatggagagtagggccttccatgcttattggaagacggaatttggcatcaataacccttgaagatggaagaatatttgcgataggtggatttaacggggaaagtatcatttcatcaactgagttctatgattctagaaccaaattttggtcggtttcaccacagctaaatattcctagatcttctgcatcatgcgttaaactggaccaatttagtattgcaattattggtggaacatgtggaaacaagagattaaaatctatcgaagttttcgatactagaagaaaccaatgggaactaattcaatcaaaagagttactagaagtgagatctggatccatagcttatgcatcatttggtaaggtatgtatttggggtggaatagacgaaaaaaatgatgttttatgctcgggagaactttttaacatttcaccttcatcgattgagaatacctcaacttatataaaacctctatgtaaaggaattcttgattcaaaaattcatccaatttcaatggggaaatactcggctattatctgcggtggacaaacagctgaagaaacaataaaaactacgcaattctactgcttccaggaagataagtgggacaaaggcccagatctcatatttccaagatatggacatgcgatcacaaagttagatatttaa

SEQ ID NO: 3111 - DNA, 3792 bp, Cryptosporidium hominis
atgaatactcccaaatttaatttcatcaagtgttttctattaatattattttttaaccttgcaactttttttttggtacatgcagtcgtctcggaaagcaccagtagcgttgaccaattaagagatgaatactctataagtgaatttttgaatggaaatcagactaatgaagatcattatgccagcattgatcgaaatgaattagaaacacggccatcatttgattcaaatagagaatctttgaatgcacatttagagaacaaattaactggggttaataaacaatcctttgtagaatttcaaaagggaaaactttctaaaaatgacgtcgatatcgaagagctgatttttgaaattgttaaattggctttagatggaaacggcagccgtgttttgccctctctggaattaattgactttttacagaaaattatcgaaactagcaaatataatacagtaactacactagattatatattggcattcatttcgaaagaaaagtttgacacaagtattactcatgatataaataggcttaggaattttacagaatatctttcatatttattaaaatataatgataacggaccaaataggatgctaaactctggtaaggaaacactttcgttaataaagacaagaatacattcatcgatttggggaatggaagagcttataaggacaaacaaaattatggattacgaaattcaaaacttaggtggtaagacaacatattcatctcaacctgtaattggtgagatcactaatgaaattaattcaaatcaaccaagagcagtatttagttataagctagttaaacagacaataattgaaatgttaggtacaaatatcaacaaagtatacagcaagctaaaaagaatttatggaaaaattacatattcaggatcaagtaaaagtaataaatcaatctctctcaatttattatatgcaatatatttatctgcaataatgattaatgatttatataatcaaggattatcatcgaatttactttctccagggtttatttttatggttttgttaagagatgatattgaacatcttccgaataactgggaggaaaggctaataaaacgtagcataagctatgggataaacgaaatagatattaaaattcaagattctaaatattctaatcttgaatccataattaccaaaggtttcacacatagcgaatgtaatgcttcagttcttagaagcaacatccaggtagtcttcagaaagtatggaattgaatattttaaatttatgaacgaagctctgaaaaaatacaaaacattctttgttccgtcaacagatggtcgaattaatagtatttcgtggtttaataactattctgttaatggttatactaacaaattgaataaaaaatggtttgttgatattaatgaacttgtaattgaaaatggagttacaaaggccgttgattttatggatgaattccatctacttgaaatatctctttctagaagtggcttgtcttccgcgattatagtaagtgagtcgaaattattaaaaggtactttggtagagtatttggcttatagaataattaatggtaattcttctattgatcttagaggctatagaataattagtattcaccttgaatcattactagaaagctgtaaaaatacaaaaaaaagcttgacagagcagataaaaattaaattcgatgagcttatgggagcatatgatggtaagattattgtttttacagataatttgttttctagtttcgaaacttccactggttctaagagattatacgatattatgaaacattacattgttcttggaactttgaaagtgattgctacgttgtctaatgagaattataagatattgactgaaaaggaaattgaggttaagtcaatattttacacaattgagatgaaagaattgaatggaatagtttctgaggtattcatttctggattaaggtaccaacttgaactttctactggaatatttattaataatgatgtaattcgggtttctgttttgatgtgccataaatatattgaaaattgtgtccttccagatgatgcagttgaattgattaattttgctatttcaatggcaaagaatgagcaatttttagagatcccatcggcaatccatggaattgaagattttatctcacattctaggattggggctcaagtttcaaagatgagagattatgaatccaactctattataagttcaaatcgttcgcgtctatctgaagtattagcaatgcatctaaggatgagaaacagaatcgtatcgctcgcactaaagataaggccctatctcactaattttaggtatctaaaaacccagctttatttcatgatgcttattaatcttaattatcaaacttcatgtgttaacaagccagtagaagatgaattcaaactacttgaaaatagggaaaaaataatcccaaacttttctgaagaattaagtgttacacaacttactagtttatataggaaaaaccttcttaaatataagcaaattaataataaatcttacaatgaatctataaatgatgaagttagcgctattacagagtcgcagcttgaccccatgttttttgatgacattcaccaagttgttaaagacaagcaaaaggaagttgccgatatgaagtctctcatacttgaaatggctttcaactacaactctttatattcacctcttggcatgggtgaaattgatgcttctcatatagcatttattatttcagaaaagtatgggaaaagtattactaaactattagatgaaattgaatatagaaaattaccggaaagaatgaaagaccgactttcagaaattctttcgaagtatgtaattggtcaaaagtctgcgatagactatgtttcatttcatctaggagtggaattgttgagaaataataaaaataatccaagatgccttctttttgtaggcccatcaggatcaggtaaaaagacatttgcccttgcattgcagaccaccttggccgaaagctcagtattattttatgacttctcatatgacataacaatgtattctcattttaaaattctaaaatccagcgattttgcagatgcagatgcagcaaagaggctattgggggataatcctaaaactggaataatttcagaagagctaaagcaaacagggaaaactgtgtttttctttgaacatattgaaaatatgcatccagatgtgattaaactcattttagatattctacataataaagataatattaatcataaaattggaaatttgggctcgagtacatttattctcacaaccaaagttgggtctgaaattattcttaaaaatcctgatcaaattgatagaatcaagattcgagttgatataattaaaaaacttcgagaaactttcagtagtgatctagtccgtttaattcaaaacgttgttttattcagaccattcacaaaggaagaagctttgaaaattcttgaattaaatttctcagaattctccgtgctgattaagaaaaattacagtacaatattcattcagccatctttgttagtattaaacaaaattgttgataagaagtattctccagagttaggatataagtcagttctagatttttttgagaaagaagtcaaggaaaaagttttacaactaattaaaaagggcatacttgtaccatacacaacatttaaaattacgattcgggacatctcgtctgtagaagacccaaatggatttaaaattgactttgcaattgttaaaaagtcgattaattctcgctaa

SEQ ID NO: 3112 - DNA, 1458 bp, Cryptosporidium hominis
atgataagtgagagagagaagctctcaagaatagatggaaaagacttattgtgtaacgaaagcgctaaagtaccggtatcttcagcaaatagtgacaaacagaagtcttggagtatgaaatttgggatttacagcaagaagacaattagcgatgcccaaagcaactatttaaatcaagatttggatagtgcgatggaatccaataataaaccaagaaactttaatacaagttctgatttaaatactccaaataataatggaaattattctttctggccaaattcttttgaggatatccagaaaggaggctcagcagtgtttaataggttggcgtcaaggatagaagaaggaattcaagacttacagtcacaaattaggccagatttccctaaacttcctgatagtttagaaggaaaaattccactgggattttcatttagtgtaagcgctatgttaatcccctatcatcttggggttatactagagttgcaagaacagggatacattacagaatcaacgccattgtctggagcatctggtggttcaatagctgcaatttgctgtgctctggatataagtatgtatgaagcaatggaagcctgcatttcgctctatgaggattgcagaaagaatggcacagctgggagactaaacgaagtacttgaacgcgagcttaggaaaaagctccctgataatgtaattgaactcttgaataatagatcggaaaaaggagggcaaatcataatttcttttacgcaactccttcctgttcctaaggctcattttgtctccgattttaattctaaagatgatttaatagagtgcattttagcaagttcaacaattccatttctttcagtcccttggcctacattcaaatgtagaggaaagccatgcgtagatggatattttgctgtaggaagaggtgaattgggatgccttccaactaatgctattaggacagtaaaagtctgtcctttaccttcagctggttcttctatgaaatcaaatagatctgatgttatctcgccccatattcaatcttatgactggatactatttagtcctgattctaataataataatgcagacttcacaagaacaagaaaatggataagaagtcttaggccagccggagtaaatctaaaagattttgagccaagcttagtagacagtatgaacgccaaagaaagtaaaataaacactagaaaagaagaagaaagtttcgaactgaaagaaacattcaactcatgttatataaataataacccaaattttaacgctcccccacttatgaagtattccaacaatgagcttttacgcattgcagtagatcctccgtcatctcaagtagcatgggaactattttacattggcagaggtgatgcattgagatggataatgatggacagaattagggaaagttcgtataagcttatggaacctacatacaattag

SEQ ID NO: 3113 - DNA, 960 bp, Cryptosporidium hominis
atgaagacattggaattattatcaaaggcccaggcacttatcaataaatttcctccagaatacgacaatgccaatgctctttttactcaggctatcaaatcagacccattaaacagcaatgttctttctgcatatggcgaatttatgtgctcaatcggtaattttgaaagtgccagggaattattagaaaagagtataaaagttaatccacatgacgactatgttaagtattttagccttgctcagattttagatggagaagagtctctttcttattggaataatggcatagaagtactccaggaaagtataaaaatagtagagaaaaagggaaatgacaagtcttgtattgagaggcttgacttaatgaaaaatcagctctgtagcgcttattgcgctatttcagaattattcatgactgatttatgttatagtgatgaagcagaaagccaagtaaaagagaatttagcaaaggcgtccgaaattaatgacgagcacttcgaaactttatgttgtaaattggcctattttaagacaatcgatgattttgaagagtgtaaaaagtatgttttcaaaataaagtatatattagcaaacaagtataatctttctgttgaattcaatgattttgctgatgaattaagaaataaagacataattttacctgagtactctgtaagattgaacctctctagaacactgattgatttaaatgaaactgagttggcagagctagttctgagcacattattaaaagaagatgaagaagattggcaaatttggtatttgctatcttggtgcagtcttgtttctgaagatgtaagcggcgcaatcgaatgttttgaaatgtttgagaaatatggtaataaacacattcaagatagtgaatttaaacaacagtttatgtcagaccttgaaaatttaaagttaaatattgaaaaaataaaaacatgtaagtag

SEQ ID NO: 3114 - DNA, 1221 bp, Cryptosporidium hominis
atggattcttcgaggcttagtggaaataaatccacttacactgacttacaaactacttctgagcaatttttattttcttcagagtcagtttgtagtggccacccagataaattatgtgatcagatttcggatgcaatccttgatgcgtgcttggaacaagatccagaaagctttgtagcgtgtgaaacatgcacaaaaacagggttcattatggtttttggtgaaataactacaaaggctaatgtaaattacgaaagagttgtaagagaaacagtgaaagaaattggatatgactctgaagaaaaagggttagattacaaaactatggacgtgattattaagctagaacaacaaagtaatcaaattgctgggtgtgtacatgtagataaaaatgtagaagatattggagcgggtgatcaaggaatgatgtttggttatgctacgaatgaaacaaaagaactcatgcctctgacgcacgtattagctacatctattacaagagagctggattatatcagaatgaaaggagtatcttctcgggtgggttggctgcgccctgatggaaaggcgcaagtgacagtagaatataactgcaaacatggcgtactcattccaaaaagaattcacactattttagtttcggttcaacatgatgaaaacatagaaaacgaggaaattagagaatttgttctggagaatgtaattaaaaaagtatgcccttcagatttgatggacaaagaaactagaatattaattaatccatctggcagatttacaattggggggccagcagcagatgctggattaacagggcgcaagataattgtagatacatacggaggatggggtgctcatgggggtggtgcatttagcgggaaagatgcaactaaagtagatagatcaggtgcatatatggcaagacttgttgcaaagtcaatcgtcttttctggcttgtgtagcagatgtttggtacaggtttcatatggaattggaatagcaaggcctttatcactatatattaatacatttggcacagcgaaagatgggtataatgacacaaaactactggagatagttaataaggtatttgattttaggccaggaatcttaattaagcagctaaatcttaaatctcctatttttaaaaagacatcaagtggcggacattttggacgatcagaaaaagagtttctttgggaaaagccaattattttacaatag

SEQ ID NO: 3115 - DNA, 2106 bp, Cryptosporidium hominis
atgtctctttgggctaataaatttgagccaaaaacggcacaggagctgttagtgaacaaacacaaaataatagaggtaaaaagttttttagaaaattcatttatatcagccaactcaattaatggttcaaaaaaaaatattttgatcattttcggtccgaatggtgcagggaaaacaacaattttgcgttgcctgtgtaataataatattaaaatcctcgaatgggaccctccaacgatacttaatgaaggacttggagcaagcttttatcgttttatttttaattctgtatttttttctaagtcaaatttgaatgaaaaggttttagtactaattaaggatcttccatttacattgttacaacataatacacaagtattgattgaaataagacattttttatcaaaaattattcttaatgactcttctatcataccaattgtatttatagcaggcgaggatagaaatagtaggcaattcttgaaatcaatactccctggagagcttgatatttatactgaaaattctacagacaaaaagcttgctaagcaaatcaagattgtaagggtaaatccatttccatcaactgtagtaaaatctaggttgaagcatattttaaacgttaaaaaaatattcgttgggatgggtgaaggtaatttaatagaaggaattgttcaaacttcgaatggtgacttatttcatgcaatctcacagcttcaattctactttgaaggaaaccaagatatttttgtgaaaaataacctaagggacttgacagccaatgcagaatttttcttatctgggaaaaaacgtagtaatcacctgaattatcgtgacaagccttaccaaactccaaattcaactcttagtaattttggtaaagaacctgtatacaatatatttagaacaatagggaaaatattgtataacaagcgtgaagaaaacacaaacaaacttaaactagaatccttacaaaacacatgtacaaaacgtacaaaaattgattcagaatttttgaatgcctttaataatagatctggattagtagaatatattaataatgagaataatttacattgtgcgtattattgtgaaggctttaaagatataaatgagcgttttttaaatattcatattactcaacaagatttcttaaaaggaaagctaacatttgacatagaagaactattgctttattcaggattagaggatagctcattaattttattgcttcaggagaattacattccatttattggtaactgcgctgatatcattatgtgctccgatatttttacttggtcagatgcttatactagtgatttaaattccgaaaacttcctctcatcaatttcagcatcttgcattgcgagaaccatattatttttcaattcaaagccattaaatccatgctcaccagattgccaaatacaaagcgatttaaaagtaggtttttcaaagaataacttttcgctttggaagaaacaggaagatttacaaaataaaagattaaaaattagcaatttagccgaaaaaccaaagaaaactacatttaaatggcatccaaagaaacctgctttaaaatcattcatttccaatttagagcacttgaaagaagattataaaattttaataggaaaatacttgcctttttttacggcaagagataattacatgaatttgtttttcagcaacaccatatttacggaagtatttccatatttgagttgcttttttgcagtaaaacataatagcttttctcagaacaatactataaataatgaactaattaattttataataaattggaataaatacagcaagtatattcctatgccacaaataaactcaataaacagcgcaggcgtaggtttggagaatggctcaaagttatatcgctatgatagtagttttaatacatcttattgtgaatatttaagcgatgaacaattagtaagtattttagaaacatttgatgtagaaaatctccaaagtaatccaacaataaacaactgctttgaatctagaaattcaaactatagcaataacaacacaattaatttagtcagctcttctgatgagtcaatagacgatcattctgaataa

SEQ ID NO: 3116 - DNA, 963 bp, Cryptosporidium hominis
atgacaccacaaccttcatctactacaatatcaggaactacgaatggttctaataatgatattgacgtagactcaataatagcaaagctattagaggtgcgaggttctcgtccggggaagcctgttcaacttacagagaaagagatacgcggaatatgtattaaatctcgtgagatatttatgagccagcctactttacttgaattagatgcacctattaaaatatgtggagacatacatggacaatactatgacttacttagactttttgagtacggtggtttcccaccagacactaattatttgtttcttggagattatgtagatagaggtaaacagagcttggaaactatatgccttttgtttgcatacaaaataaaatatccggagaatttttttttattgagaggaaatcatgagtgtgcatctatcaatcgaatttatggattctacgatgaatgtaaaagaaggtataatgtaaagctttggaagacttttacggattgttttaattgcttacccgttgctgccataattgatgagaagattctttgtatgcatggcggactttctcctgaattacataaattggatcaaataagaaagattgaaaggcctacagatgttccagacacgggcttgctttgcgatttgttgtggtctgatcctgaaaaggatgtaagaggatggggagaaaatgataggggtgtatcattcacatttggccacgatgtggttgagaaatttctgagagatcatgatatggatcttatctgcagagctcatcaagtggtagaggatggatatgaattttttgccaaacgacagttggtcacccttttttctgcccctaattactgtggagaatttgataatgcaggtgcaatgatgtctgttgatgaaacgttaatgtgttctttccagattttaaagcctgtagagaaaaagaaacttaaaccgtaa

SEQ ID NO: 3117 - DNA, 1362 bp, Cryptosporidium hominis
atgtgtggagtttcagcaatttttattttagatataaatgggaagccaataataggaagaaactataaaggcgatatttcagaaagtggagttttagatgcttttcaacaacatgttatagaacaagaagaatcttgcattaaaccaattttctcttcaaaaatgattacatattgttggattaaatacaacaacttgtatttggtattactttcaagaaaaaattcaaatgcaatcatgatgataacatttctatataagttaattgaaattttaaaagattatttcaaggttttggaggaagaaagtataagagataacttcgtagtaatatatgaattattggatgagataatggataacggctttcctcagataacagaagtcaaagttttgcgtgaatatataaaaaacgaagcacatgaactctccgcagcatccgtattggtgcaaagtagaaatagctcttcatctataaaaccaccttctgcattatcgaatgtaatttcttggagaccagaaggaataaaacataaaaagaatgaaatatttctagatgtaattgagaaagtaaatatgataattggttctagtggggatgtaataaatagtgagattgttggaacattaacaatgaaaagctacctttctggtatgccagaacttaagctcggattaaatgatagactcggcgatgcttccatttctactagcaatgccaatcgtaattcagcctctagttcaaatagaaactccatattgaaaaataaatcagttgagatagaggatatcaagtttcatcaatgcgtaagacttgcaagatttgagagcgataggacgatttcttttatccctcctgatggacaatttgaattaatgagctacagattaactccatcatctaatttaaagccactatttaaggttgatgtaaatattgaaaatatcagtactactcgtatgaagtatgttatcaaagttaaaggccaatataaagcaagaagtgttgcaaagaatacagaaattcaaatcccagttccgagtgatgttataatacctacttttaaaacatcaatgggtacagtcaaatactctcctgagcgtgatttaatagtatggaatattaagacattttctgggcagaaggaatttacaatgaccgcaattttcgatattccatccatcatcaatgagacaaatacaagcaaacgtccagtaacagttggcttcgaaattccgtatttcacaatttcaggtcttactataagatacctgaaaatcacagagaagagcggatatcaggctcttccatgggtgagatacataacgcagaatggaaattacgaaataagaatgccataa

SEQ ID NO: 3118 - DNA, 840 bp, Cryptosporidium hominis
atgaaaaatgatttatttacggataaaaataggtttttattaactttaggtttaattggagtggtaattggaggggtatggtatattacaaaaaataataagaaagaactttcgaatcgaaagttggataacgaagaaataaaaaatttgttagtatccatttccaatgaaattcacccaattttgatggaatttagtaacttggtatcatcaataaatattccaattgatgataattctattgagttttcaaattattttgaaatcattttttcaaacggtggttttaaagataaaattgtaagagcgcaaaaagaagtcattgacaacttagcgattgaccaagaaaattttgaaaaattactatattctgcatgtaaagttgatgaggaagttctaatgcttaaattgggaattgatagaatgtaccaagattcatttaaaggagtttacccacttctaccttattttgggttgaaagctgattttagtaaaaaatatccaaattttacgcaagatcatgttttaagaagattaagggagctaaacgatgaaaaagagaagggattcaaggccatagttaaagaggtcggtgacctatctaggcatgttaaagaacaccccatttcaggtgtaatcccttctgaaaaactctctataagattagaagaaataaacaaacaaagcgaaaacaccgtttttgaatcaatagaaagcaaaaggttattttctcatgcaattgcattgtattcaagagaggttgaatttgcagagaagaaaagaattttagaaagggagcattgcgataatatattaaatataatattaaactataaatag

SEQ ID NO: 3119 - DNA, 1959 bp, Cryptosporidium hominis
atgattgatattattcaattcgatgaaagagtgaggccagtaatcgagcagatatttggaaattatgtcattgttgagagcttagataatgcgaagtatttggttgacaaatataatgtgaattgcataactttagatggagatgaatgggataacaaaggctgcgtcagaggaggatatcgcaatataaatcttccaggagctcaacaaaacagcattattatttgctcaagacaactgaaaaatctgattcatgagaattcaatattgcgttcagaaatttataacattaaaagtaagataaaagaaatagaagatcgagtattggagttaggccatgatagagaagaatatcttagtactcgggagagatttatatcacaaatttcaaaatcaaaggaaatgattcatttatccgagagcaaaaaaagaaatattcaatcagttattattaaagttaaagaagaagaagaaaaagcagttagaagtactgacactgttcaaaattatattgttgcgttgaaaagcgaactttcatgcgaatccctttctaatggactgactctagatgaggaaaatttgctgaaagaaataatttcgaaaatacgaacacttgaatattacgaaattccaaaagtggaaagggagatttctgatctttgtaatgatattgataagcatgaagtccacttgaacacactttttgaagagttataccgtattcaggaagaaaaacaggaagaggataatatgaagttaaattgtgataactttgagacaaatgggttgctaatggagtataataagttacttgaagaatcaaaagaattctttaatgaaatagtaaataaggttgaatctacaaaaaaaaagtcaatagaaattgaagagcttaagcgttcaagaatgcacgaagaaagtttagctctaaattctagaaatgaattgatttctcttgtttcaagtctacaaaaaaagtacgataaatttcgacaggctaaagaaatcgctttacatgagaggaccaagtactcagactctcaaaatgttatttctgagataaatattcccaaggaaaaaagtaaggtttatcaagaacttcaaatagtacaaaagaaattatcggaagactacagatctattaacagaaaggttatatcagagttggatcaattcattcaagagtacacagatctatcggatcgtcacaaggaactaaactccgctatgagttccattcagctattaattgaaactctagacattcaaaaagaaaaaaccttactaaaaacttttgaagaaatcaacttttatttcaaccaggtatttagggaactaattcccaacggagatgcgaagcttattctaagactatcaaatgatgccagaagcatagcagatgaaaacgatgataacacaaataagaaaccatcttataaaaaaaataactcaattgacaataagtatttaaataataccatggctaaagaaagtgattcaactcttttgggaataggaattagagttacttttcatgtggggagcaactctcaaattaattcaacaaatacacagaaaaaagctaatggccaagctggaaattactattctcttaaccaacttagcggaggccagaaaactttagttgcattagcattcttattcgcactgcacagggcagatcccgcgcccatgtatcttttggatgaagtagatgctgcacttgatgaccagtatcgttggtcagtcgcaaacttgatcaaaaaacaatccatttcaacacaatttattgttacaacattcaggccccagattcttcagattgcggataaatattttcaggtatctcaagtaaatagatctagctatgtgagcgaaatttctaagcaacaagctctggaattacaacaagagcaatatcaacaaaagaagtcacatgagttgatatctgatgactga

SEQ ID NO: 3120 - DNA, 1956 bp, Cryptosporidium hominis
atggatcaacttatagagagcctctctcatatagtaacacaaaatggcagttttggctcaataaattgtctaagttctcgaagtggaaatgctggtagagataccacacattcttctgaatcaggatacattattgatataaagggtaaatgcaatcaaattaataatttgagagatgacaatttagtgcaatccagtatttttaatagcagcatgaacaaaatctgttctaatcgactaaatgattgctttctgaaaaacgaagatgaggcaaacaactctggccaaaaaataggagataggattgaaatctcaggaggatttcaagaaacattaggatcaaatattcttaaaaaatttttaattgatcgcgatagatcccataatttgaatattttaccaccaaatttaacaagagaaagtgtaatgaacaattttgaacaatcggcacaacttgacgaaaaaaagacagcttcagatattgctatgaaatattcacccgaagatattattttatctaaggtaaggggaatttttatgaatcgctatagtcgagattcaataccacaagaacaaatagatacgcttaaaactactacaaaaaagaaaaacaaagtaaacggaccgatggaaagactaatcagcaattttgatatggaggccgcatataaagatatggaggctgccttttcagaggcaatagatgattgttacgcaagattttttacaaatcttcccgtaaatttacttgaggatgcaattcatttatactttcaaatacaagctgcttattggtggtacgaggatatgtggtacgacaaatattcacatgttctaccaaagctttctttgcgagtatttgggcaatttgttgctgaagattgtccaattttacgacacttcgtttcatctcctgaagagcatgacaaatttcttttaaattggaagcgatattgcaagacaatacctctaagaggagtaattttaattaacaaagagtttactaagtgtgtgttagtaaaaccgtggaatggtaacaggtttatgtttcctagagggaaaatggatgaaatggaggaggatagtttgtgcgcaatccgcgaggcatacgaagagcttggaatagacgtgactaaacacctcaacgattcaatttatattgagaaacaagtagaagagcaaacaataaagttgtttcttatacccggaattgatgaaaatactccattagaaccaaaaaaaagaaaggaaatttcagaaataagatggtttagttttacatcactcccaaactggcatgctaatcaatcacttagacatagaaaacccaagaattctgacaatttttcgcatgctgatggaaatctaaattgcatctcgaatgactatattccttgtattgataggcaagatattcataatagtgaagacgaagatttgattgggagtaacgaaaaagttcatgaaaacttggaatcaattattgaaaagccggactcgaaccaattttttagagtttcacatttcacgcgtaatttgcgtggctggattgaagttttaaagagaataccgctttataatccaagtaatcccggtggaataattccaaatttgccaaagaatctaaacccagcagtgattagaagactacagaatgcggaccttgggggaccacccttatctagccttcctttgttcgtaagagttaaatttaatgctaatgagggaagaggccaaccttcatctacatctcaaatttactctcaaaataagaagaaaccaaaaccatatttttccgataccacaaaagataaaagaacgtttggcacaaaagcaggttccggctgggatgttgaatctatgtttgcactgaatgagcaaaagtttggggtaaaatcaacgttttcactggaagaatacacaattcctctcccgaaaataaggcagaagaaatag

SEQ ID NO: 3121 - DNA, 5265 bp, Cryptosporidium hominis
atggagctgtcgaacagctgtaaatatttctttaataaatgcgctcacaacattaatttaaaatttgatgatgctaaagaaattattaatggaagtagcgaaatatttcttgaaagtgaaactgaatttcctaataaaatttttattcaaaccccatctttactctattgcaatattatatctgttgaaattaatgggaatgattttgaaggatggtcaattaatcctgtaccaactcttgaagattcaaacaaaatagtcggtcacaacgtatttgatatagcaactcttcaaatggcgtacggatttatctcatcaaactatggtgaaattaaccctgatcagtctaatgtgattgaaaatcgattattgattttaatatcagatgaaaaaatgcttaatacagctacggatactacgaatgagaacgaatacaagtattcgataataatcaaagttaactttgaactgctgataaatgtcccaaaatcaccaattacttatgttattgagaatgacaattcaatcaatatatccataataccaaattcccattctaaattaccatggttcccaactctctcatcagccctatatcttactgaagacgcttcaccattttggaactctccgtggagttttaaatgtaatgtgccaaatggctattcagcaatcatgcctggtattttaaatacgaattgttttgtcaatgggaccaatacaattaatgaaaatactttcgagtataactatgactcaggaacgtcttttcctcacatttatccaaataatattgcacttttgattggaaaatatataagagaagataaaactattgggaaaaatactgtaacaatttttagacctataaatgtatctcaaatagtcaatattgcaaactttgttgtagaaattatggaaggatatgaaaaactactaaataacattcttccaatgaaatcaatcattattgtttttttaaattatcatatttttaatcagcattcacattttttcaattgccatgggagagtttccgacacactaggtaaagtagagatgctttctaatgcatcatcaccgctgctttatcaagagaataattactactctcacttaagcgaaacagacattggcaatacaattggtaacataattattgtcccattagatatgtttccccataaggtgacatctaatatctcatcagcaattgataataaaaagagtaattttcaagaaaattttagaatgcaaataagaactcttacaatgccaataataatattattggatcgcttggccagcctttggtttggatcttatattcatataacaaatttaaaacggcttccaacagatggctggatgctgttaggcatgaaaagatatttaatgcgtcaaatggcaaagaagctttgcggagaagacttagttaaatgtagaatgaaggaagcactagagaggtgtttactactcatagaaaatggaaatgattatatcccattatctgtaaaagacttttacatcaatctgcaacaaaatggcataccaagttttcctctagttcattggagtcagagagaatgtcaaaccctgtttagattaaaatcagacattgtatttcatagtttgcaatgttacgttaatcagatgataaaaagcaaagcgcgcaaggttggttttggcttttctgattttgatacttctattaaacaaaattcacaatcaaaatttttcaacatatttattcaatccttcattaataaacattgtattaaaaaaaatcacaggaatttcacgacccaacatttttttctgcatattgcgttttgtatttcacagcagtttattcatagatccaaaaaggaaattgcagcagctcagcttcctcaacatgaacaatatctacttaatgagatccaagacgaactacttgcatttagatctgcttggatagaaggagttggatgcccaaatcttacaattacgtctacttttcaattttctaataaaaatatttctcttgaccatgcattatttacggtagaccaaacaccactgcagcctccacatttaacatctaaggaaggaatttcttcattcataccattggtatcgatatttaaagttaaaagaaatataacccctagatgcgatattgaaaagttaatttttaattgcctttcatttattgatggtttttataatattggtgcctccagaagtcaactttctaattctataacaaaattgcttccatcctttctttggccacatgatccgaataatataatattgaaggaatcaaatataacaatacttggattaggaaatacaggaagaattcctataccaataaaatttggttttggtccattatttgattctgtattccaagatgaattacaagaaagtactaagagacgtgttggccatctaaataataaaattaacattgaaaggtcagctcttgataataatttgaataatttaaatcaacttgatgccccaaataaaaaaaagaattattcagcttcctcgaatggatgtatttcttcatggcaatttggatatatgaacatactttgtcaaattctcctaaattatcacgagaacatgtcagagccagtaaatgatattgaatggctatgcactgaattagcatctcacatacctatttcgggtggaacaggcaaattttggccagggcacaccttaatttatatagttcaaaacgaagaaaataaaaattgtgaattagaaactatagaaccgcaactacctgttcttcaagaaataaaatttgaaactcaaaaaattaaatcaggttatagacgcgattctgtacccgtatcaaacgcctctattgcatcttcagtatgtacccaaggagttacgaacaatcaaaattctattactcatgcaaacattaaagtgaatgaagttcctagactatctctccttcacgatttgcaacaaagaaaacattttgtagggaagttatcaaatagcgataatatttggttgcagccacttcaattttctagaaattacaaagaaatcatttctagtgaaaatgaacaaatctcaatgaatcgcacggcaaatacagttaattttaattctcatatattgtggataattgcagactcgtcacaatactggctcgcgaaaatttcaagatatcagacctggagtatgtgggatcaacagtttttgaatgaaactgatgttataggacaatttgaggcagcataccagctggggatggaaagatacatttttggtgattgtagcgctcataacttaactattttggaaagagcattccagtcaattaatgtactaatgagcgcactatatcattttgactggaatatttttgtaagaaaaaaagcgctattatcaataattaaaattcataataaactttcttctcaagtttcaataaaaagtggtattcaatcaatcaaaactgctgttttttcattaataaaaaagtttatttttgagttgatttcattgatagagtatcaaaaaaacaaagagctaagtaacttaacttcaaatgtttttttctttaatgaattagagattttgctatttacaattaaatctttatcttatttgtggaattttgaagtggattctagcagttttgaatcagttcatttcctaacagagttattggataaatactcaaacccatcacatgataaatttaattatgaaatattatgcagcatttttgaggcaatagaaagaatagtattgcccccttcaaatgaccagtattcgtccttaattaacaaagttacttctgcaatcagtaagttgttagttggcttgctgaagggttgcaactatatatttgaggatgctaaaatatttgtaatattgtttaaaatattatcaaaacattctattaatattcttataccagtaagtaatgagtttagaaatgaattcggtatttatttcgatccactatggttcattgatcttccatttatgtataataacgcttggtgggatagttactcatctatacatggttctatttcaatgcctttgtataaacttagtgagcctataattcaacttagtgcattaaaatgttatttcagcttgtcgcttcaaggatttacagaaacaatggctgtttttagtgagaacgatatagaaaataatattaaattcaaatctatttctcctgaagttatttatggcttgattcttgagtcattttctgaatgcaataagcaaacaaattcacaacaaaacatcacttcaacttgtgggagtaaaaaacctgaagcaataaatattattggaatattcaatgtttggaattttaagaaaaatagcccagaaaatgtcacttctgctcgaatatttccaaaaaatttattaaaaactttatgtgcatgtgcgctaatccatgtcatattatggaatgggattaaagagagtttcaaacataaaaaaaacaattcaaactattggaaaataatcaatagtttgtggagcatttttatctgcgcacttgatgacataatccgagattttcctcaccttcttgatgagtttatcttattacaggcccatgcagaatttgaaccgcttattaattcattaactaataaacaacacaagaatagagaaacatttgatgatattaaacaatgttgtatatttatttcccaaattatattaaatagtccaatctcactctcatcatacccatttgatccactaatatttcaaaatatttcaaatatgtatatatctttatttggtcatggagtccctgtttgtatgagtcaaactccatttatttctcaagacgttaaatgtaatcagttagtatttaatccttctaatggatatattttatctgcaataccagaagtacccatgaaagagtcattacgaaaacgccaaaaattcattaggagaggatgcgatttatcagattccattcaaattagaaggctgtgcgatgatgaaagttatattatttctagaggatggaaacacatatgcaaaaaaataacgcaatgtctaattgagtctccatatggggcaccttttattcacccggttgatgaaaatgatgctcctgactattataatcttattgagcagccgattgacttatcaacaataatgaataaagtaaaacaggatttgtatgaatctatcgaacactatcgttccgatgttgacctaatctattgcaaattgcaaaaagtacaatga

SEQ ID NO: 3122 - DNA, 447 bp, Cryptosporidium hominis
atggcaatgaaagcagaatgggagttagagacacttaaggttagaaaaaccgaccattttgtagatttgaacattgcaaatatggagaaacattatacatgctgtttggattggataccataccacgtgagtagtggtattgggattacagttgcaattagtaatcatatttatatattcaaaaaaaaatctattttttggaattgtgttgaaactatagctgttaacaatgcaggaataattaaagacatttcttggtcaaaacttgcattattttcagacttttacaagcttgcaagcttacacgaggacaatactttgataatttggaaatcaacagattctcctaatataaatgaattaggcaggaataaaactatttcacaattaaataagtttgaaagtataggctcgatagtaagttttgcattcttttttttccattga

SEQ ID NO: 3123 - DNA, 2544 bp, Cryptosporidium hominis
atgtcaaaaggccatgaattgagttttttcaaatatattccaaatgttttttcaaaaaaaccaaattgtaagaaatattttagttcttttgaaattaaaaaagtacttttaacggagaaagatggaattaaattaaaacctgaagataaaaatcataatttaattgaactaattactaaatataactcattttgcagttattattttaacataattaataatatagaatataagaatgacgcatgcataaaattgtttccaaaacattcaattaaaatgttcaaagttctaggagtgaatttaacaggggaagagattactgagtttttttgcaactttttcctaattactaagaaaaaatgttttatccattcaacttcaaatgcagaatttaccgttgaaaacatgttaatttggaattttttaactaatttgatttatcaaaatactaggggagtagatttaataaatttaaaaagcttatttaagaacaatttgtgtaatatgcattttaatgctatgaaatcgattataatagtagatcaaaaattctcatcagctttctctccttgctcctacagtgtttactttcctccaataatggatgaagttattccaatttgtacttcaattgtagatttggcttgcaaatctttaaataattccaatcctgcagaatggtcaactcaaatattggtgtggatatctagtttattaagaattagtgattttaacggggtattaaagatactaattacaatgaattcaattctaaataataatcacaataataatcttaagtcatcaatttcttatggcgtgtttccttatctttgggaaggactattggagatgtttttgttgatcaatcagagtgtttcgaggtccttaataaatattgtcaaaactattccagtttgcggaatagttaacaaatcacaaattttaagaaagatttttattgaagaaagagtgaatttatctattgaattccaaaaagaattatcaagtaagctcagagatgtagaaaacactattagcaagtcacttaatgcatttatctttcgaaatttattcttgaaaaataataaatttgataaatttcgacatcaaagatataatttgttagaaaattacagaaatctggataaaagcatttataattcaaaattaccatactccttaaaacatgaaaaagctcattttgaatcaataaataataactttgaaggtaaacacaacctgtttcagaattgtaataaacttaagctgaattctggactaaatttagataatttggaattcaaagtgatcaggtatgagaattctgttttgactgtctgtgcaatttgcaatagccgaatttttcgaaaaggcgatgtaacacttatacaaccatttaacaaacaacttacattaaatggaaaacaaatcatgtcatttagacaactagctattgttttgaatgttatttttattaagcaatcacttaagtttcaaggaaatactttgaaactaaaattaaaaataactgatcctggaatagatccaagtatttataagcattgcattattatttgtttattgaattattataaatatattaaaaaaacaacattaataagacgtttttcattaaagtttccccaaccatacttatctttgatagaaaatattaatagagaaatatttgaaaacttgatttataatttatcaaatgaaaataaaaatccgaacgacaaattagttattattttttctagaaggctaaagcacgtatatttatgccatagagtagaaataaaatgcatattatttagacaagaaatattcaattttaaaaatgacagtttttttaataataagagacaagatttattcagttatttgttaagctttccaaaaatagattgcaatattataaagaaaataatatatttgacaaaattacaaaagaatatagttttcttggctttaaactcgattgcaatgattatcaataatatgagctacactaacagaataaatattataagtatgatagcttttttgcagaaagctatcattccgaacgcaaaaatattaattcttgcaagtaggtttgaatatgcaaaaatgattaagcatgctctatgtactttaaatatctctgcaaagatattagaagaagagtatatattatacaaagcagagtacatcaaacttagaacagaaaagaatagttttagagggctcccaagatatgaaaattggttatatagagaaatggttgtagaagaacatgacataatcattatcaataatattgaacttaactttaattttgttaaaaaaagtcttaacgttgaaagaaagtcgaatgaaagttcatgttttggtcatttacttatagaagatgttggagtattatctagattagatattttattacttttcatattaccatttaataatataacactttttaatagcggatttatgatcaatgatttttttacaaaaggagacgcgaaaaaatgggtagatattgcattaggaaattaa

SEQ ID NO: 3124 - DNA, 972 bp, Cryptosporidium hominis
atgaccaatttttctaaagacaagaataatagaatttacattattttaaaggaatcgcttgatttattgtacagttatttaggatttaataaaggttatagtgatcaaagttttcatgaattactttccatagaatattggaaaaataagcagctacaaataaactatgatttaattttagacgaagacttggattgtttaaaaaatatcgaaagcgataaatctttaaatgagtttgaagacattcctatacctattaacaaaaagttaagtaattctaaacataatgaaaaaaataaactatgtaagcttgaagaaagcaaccacacaaaatcaattcaaaatactaagacctttgtaaagtttgaaatatgtgaaccaataaataaaggtcaagaggtttatttgagctttattcatgaaattggtttaattgagcttgaaattttatttaacagtgtttacgaaataaaagagttaatttttcttcaagatttagatctgaaattgttaaaagagttatttaatgctgttttatatctatttaatccatgttggacatttaccttgtcttccaaaactgatatatttgacaaagagaagatatctaaaaagatgtatatttctttgagtgagtttgtaagcaatttgaagctatcattaagaagcactgaacagagggaaatgctaattattaatatcgggttatttatttctaatgttctttattactcagctcagattactaataaagagacatattatttaaacaaatctactccaagatggatggatattgcaaaaacctacacggatggcttgatatttttaattgaaagtaaatatttgttaacaagcgattttcttgatacaaagtcattaactccattttctggtatagaaagtttattaaatttaaatgtactaaaaatagagcatattgaaacactaaatgatgcttttcatatttag

SEQ ID NO: 3125 - DNA, 1677 bp, Cryptosporidium hominis
atgaaagttttatgttatccagatacaagttggaatgccattttttgttcttttatcaattctttaacccctatttctctactaaatgactattcattttcaattatacagtcaattagaaaaattcaaagggaatttgaacattttaaatttatatataagaacaataactcagtttttgatagtaattctcagtcaagtttacttaaatttttcctggaacataaaaataacgaatttcccacttggcgatggggagaggaagtatctattaaggaaattggagataatatctcaatggtttatttccgactttcaacattcttcgctagctctacgtatagaaattcaaatgattgtaaatattcactattgcagatcactagagatttttccttgaataaatacttaaatagagaagtttttataaataatcaattaatgctaagttcatcaaagttaactttgctctatttcattgaaaataatcagacaaatgaactattggaagagtttgataatattcaacgtatgaatacagaaagtataattaaaattgatattaacactaattctagtgaacaaacaaggaaatggtggaatagaagaatatatattgaatctaggttaaatagttggctaaataagttctcaaatcaaatattaaagggatggacgtcgaaactattttatggatggcgtaaagagttaaattctgagaaaaatattaaacaagtagcggaatttataaaaacctatttgattgatattgatcaatcattgattggaattattatattttccttaacaaataatatacctcaaatccttaatttattaaaatctgacaatatactcaattttaatctaaaagatatttgtgtaaaattcaaaaaaataaagttccaatcaattaaaaataaagttgaaaatttccctgcagtcatttttttagataaaatattaattagcttgccaatagaaagtatttgcgatttgaaatttcaaccaatcactagagggattaacagaagaatgtgtaaaaataacatcgatcatctatttaatcagcttcagaaatctaaagaaagcaaccttcgtttgcttgccaacttctgtaatatatattattgcataaatccaactggagatttagaagaaactgaaaagactgttattgaattcattaaacaaaaatttggttcaaaatgttcaggaatatcgaattcaattcctcaagcaacagaaattatgaatactatgagttttaatcgatctaatctctatttattttgcggtcaccaggctggagaaaagtttatccaaggagagttgtttgaaagaggaataatcactgagaattttgagtcagaaaattatcacttctatatgcctccttcgttgttaattggttgtagctcttccaaaataagatcatatgggtcaaaccatgtattttttacgccaattcactacttaattggtggaagtcctttaattctcggagcgctttgggacgttactgaccaagatatagaccgctttactatgtcaatttttgacaattgggttggatcaaaactctcattggttgaatcaattacactcgcaaaacaagaatgtaagcttccattactgaatgggtcatcttgtgtttgctttggctaccctatttaa

SEQ ID NO: 3126 - DNA, 513 bp, Cryptosporidium hominis
atgaataagagtcttcatgaaatggatagcacaatacattttgaaaatttaaatataaaaactactgactattttagtgtttattatgaagccaatgttaaaaatgataatttaaacgctttggataatggcaatcagactgaaaatgaatttttggttcctctctcattatcattcatgtcaaattgggcagaaaataaaaataaagattgccttccactgttcttttcttcaaatactccaataaggaaaggttatgaagtaaaagaaattcgctccaacactccaactgaatcccaaagtaattggataaatcaatttaacaatattgaagatctagttgataataatgcttgcccaattgaatcaaatgatgatttcgcatctcaaactgataaaacaacgacatttcaaaaaactattgatgaatctgaaaacgatcatcctggtaattcgaccaaccattattctccaatactttgcccaattatacctgttaacttacattattga

SEQ ID NO: 3127 - DNA, 2457 bp, Cryptosporidium hominis
atgagtgaacaccaaaggttaactaggaagcttaacccttcatctaaaagtgttaaactacttaacagacctttaaaaggaaaaggaagcaatcaagatgaatttgatcctggaagaattgaagagtttaactccccaaacaaatcaatcaatccaataaaagggttgctcagaccaagacaaaaaaatatcacaaatattcaagattcaaatgtaaagccaccaccttcagatattggaatatttaatagtacacaaataacaggaaatgctaccgttaattcaaacacaaatttaccagaggcactattggcagaagcaataaaaaataaccgtgtaaagttacctggttatttagatctaccagggagacttagtaaaaacttagataaaggaattgctgggctaacacctggagtttcaacagattcaggaagaattcatgataatttagataggttaaaaaatgaattttgtagatttattgatttcaaatatcatgctagtacaattggaaatactgatttagaacaaagagttttcttaagaaattcttttgagaagctaaaggaagtagattatccaacaattaaaatgcaacagtggaatgaatatcagaatttacttttagaacagaaaaagaacttgttattgtttcagaaaagccgagggggagaccaacaattagatgatgcctggtgccaaacagatgaacaatcatttgatgagtttgtaaacagcaatataaaattaaagtttgataagttaaaagaaattaaaatgaagaggttatcactgaaaagaaggctttatttaaaaggttactttgatattactgattttgatgatattgaacaaatatacgatgataaaatgcttagtagattgggtttaaataatcaatttgttaatgattcatcagaggatgaactagatgaaatgatggattttgttgaaaagatagattctgatggaagaatagaatataataattatcaaattaggcaaattttaagcgtattcgatagaaaatttgaacgaagatgtaaaccagattattatcaattcttcttcggatatttagattatgaaaaagaaaagaaagataaaataagtggtttgaataagctacgcgaatctgagagaactcctaaggaattgaaacttaagcttattgatttccttgacaaaaaattaaattggaccgagatcgaaactccatgggaatgggagcgtgacttcacaattgatgaaatggatccattaaaaagaggttcgcctaaaataagattgagcgatatggactcaacgctagttaaaaaaggcattccaaacgaatttttgcaagagttaactgaaattagaaaagaatacagacgagaattgttagataattccttaagaaagtttgaaatggatgggatatcaaccaatatttcagataatttgtctattaatagagagattatgaagaaggaaatatatggaagcgataagaaaaatcattatactgagcttatcaataaggcaaaagcagaaagtgattatgatgaagccaatttgctatcaaaattaaaaaagggtcattttgcaaaaagcaaagtgatcaataaggttaggtttagaaatgagccggaaatatttaaccaaaaaaactttgacgagcaaaaatataaaataataattgaagaggaaaatagctctgattgtaatgcaattgaaatcggcttatctaattcatctgataataaactcgatattcatcaatcaaatatgtgccaagatcttacttcaaaacttgaagatgatattgtagtcagtttaaataagcttattttaaccaagggaatttcagatgaattgaaaaatgatctggttaagcatctagataaaatattgctgcaaacaaatagaaatccacctgatcctcaaccctccattgtaaaagatttaacaaatcaaagtaaaagtgtattgggaaataatgcagctataactaagagtaaatatataagccattctaaacaattaagcatacttgtgaatggtagtgctttgggaattcaagaaaagaataaaaatttcgacgaattaatcgatggaaaagatacaaaactgactaataaaagtgttaagcaatcagaacaacaaaaaagagcggaattaaacatggatattgatagttttgaaaaaaatttaaatacactacgtactgctgctggggtattggaagtattgggcgaaatagaggaggagtcaaatttaataaataaccacaacaaactaaagaaaataatatctgaaaaggttgaaaataatggatttgatttagagactaatgaaataaaaacaattgaagatggagttgaagcgttaataaaagaaattttggataaaaggaaaataggaaagcaaaaaccaaaatcagaacctaaattagtaggtcagaccgaatag

SEQ ID NO: 3128 - DNA, 501 bp, Cryptosporidium hominis
atggtttggcataatccaagatctgattttccttctaggccacttgaaaagttgacttacacttcgtttttcgataagctggctctggacactttattttttattttttattttcaacaagggacatttcaacagttcttatcaattcaagagcttaaaagaaaaaaatggcaatttcataaaaagtgttttgcttggttttataaaagatctgattcaaaaattactacagaagatgcagaagttgcagactatatatattttgattttgagaaagattggtgccaaaagataaaaaatgactttgcatttgaatatattcacctggatgatacacctattattattaacaaaagtaatgagtctaatgcttgctacaacagcaaggcttgtgctgacaaagatcaaataagttttaattcagatatttctgaaaatattatcaatgctgatggcgcaattaatgatcattgcacaattaataacccttcaaataaatag

SEQ ID NO: 3129 - DNA, 792 bp, Cryptosporidium hominis
atgccaaaagctgaagtcggaacagttaagtggttatctaagcaaataaagtccaaaggattgcagaaattgagatggtattgccagctatgtgaaaaacaatgtagagatgaaaacggctttaaatgccacaggatgtcggacgcacatttgagacagatggaagtttttgagcaaaattctaaaaaaatattgaatgactatagcaaacaatttgaacttgcttttatgagattgatgaaaacaagatattcaaaggcaaaagtacttgcaaatacagtttataatgacttaattcatgatagaaaccatatacacatgaactcgacaatttggacaactctcacagaattcattcactacttgagcaatactaataaatgcgaaattgaatattctgataaaggatggtatatccagtatattggtcatgaaggcgaaaaaaagaataaggacttggattcaaaaaataaattcagatttacagaagacaacagaagagaacgacgaattggaatggtagtcaaatcaaactcttcatctaaccaaagagcgtctatcattcaaagatgcccaactgtgtttttaagaaatacaactaatttagaagatgacgaaaagattttaattcaaataaataatagaaataatatttctgaacacaattctgttcaaaatttgtttaattttcaagaacaagactttacttgcaatggaaactttgaattccaaaattgttgccgggaaaaatataaagttagaagtagtagcctgtctagagagggatattag

SEQ ID NO: 3130 - DNA, 2652 bp, Cryptosporidium hominis
atgcaattttcaaaatttcaaagtcttcgtagctcaatttcgacagctgaaaatgaacaacaattatttaatgacaatattagatcaacatttggcgaccgtttatacttttcaaactatgacgatgaattgaaagatgaattaaacctgtcactcaattctagagagaaaaaaactctcgaaaatgatgagtacattgaaacttgggaaggaaacgatgaaggtcttttatgggggaaaaaagaagcaagggacaaaagttggaaagaagaatggattgaacagagaaatattcctaaagattcaaatatttcccaagtgccttatagcgaagacgaatcaccaaataaggtcaattttcagtgtttaaaaaatgaattaagagaaaatagcagtgaacagagtttgtctctatgtgaaaagtttgaaaattgcaatagagcatcacttggccaattaattggtgtagattataaaaaaaacagaagatggaaagaaaagtggtttagaagaggaagaaagctgtttgttagaaagtttgttcaacaactttgtgaaaataattcgcgagtattaaaggtatggtttgaggattctgagtttatttttgattcaataaatattcacccgaatccgaataagctcagctggaaattagttaggaataataaatatggaaaaataatatcagatcaaaaagaatggaaagaatcaaatgatttctatgatgattataatataatcttatacgaggaaaggggaatttctaatgggtctaacaaatacccctatttttattctaaaagaaaaaaagttttcaaagacaattcagaaattatatattccaagtattacaaaggatatagtggaaaaaatgaaacttttgatattgaaacaatctcttctggacactgctcaagcaatctaacttttgatggattatgtcctactaattcagttgatgatatcaaatattcggagtcttggagtgaatgcattgaaatagatagccatgggaataaaaaaggcagaaaatatggcgataaagataacactgaattacatgaagtttggtttgaagaaattgatggatcaaaagagtgtgatatttggtatgaaaatgatgaaatgcaatggggagaaaaaaaaggttattctaaatcaaataatgaaagctttaaagttaaatgggaaaataaaaaggaacaaggaggattgaaacgagaaaaatacattgagaaaaattgggagaaagttggagaacagaattcttggggagaaaagtttatagaagtcgttgatcaaacttcattaggaaagaaaattcagatagtaaaagaaaattggtataataatggggctgaagtttttagagaagaatgtaatgaagagtcacaatttaatgatttagatgaagataaattgcccgatttaattactaggagaggagaaaaaagaggcgaaagatttgcaacaggagagacatggtctgaagattggaatgaaagcctcgaaagaagcgaaataaataagaaaataataagaacaaggctgtttacagataaatggtggacaaaaaaaaatggcgaaaaatggggggaaaagaaaacaataaagttaaaacgggaatctaactatgataggaattcgaaaatattagatgaaaaagttttagattcaataccagaaaatgagcacttatacattgaaaatactgagtcatggtatttatctgagtttgaggaatactctgacacttgggaaactgatggtttgaatcaacatggttataaaaaaggaatagataggaagcatgataacaataggttcgtaaaatgggaagaaaaatggaacaaagatcatttaaaaaaactaaaaaagaaatgcacttgggaattaatggatgatagtggattaattgaggtttggacagaagatcaatttcaagatcagtcaggaaattttatagttaataagagaggtagaaaatataatcttgataatcggactgaagtaattgaagaatgggaagaaacctgcaatgatgatggaaatggaaatttgtacacaaaaaaacaagggaaaggtagagagaactggtatttagatgaatttggtaaatcagactatacaggagaacagtgggcagtaaaacaaggttttgataatgagggaagttggtcagaaaggtggtcggaaaggtcaggatataaagaggcatggaagaagggagaaaatcgctatggggataaatgggaggaagaatggaaggaagatttcgaaaataaatggaagtgggcaaggaagagcggggaaaataatgttggagatctatggaaagaagaatggagggaagagattgacacgacaaatcatatcagtaagaaaagtgcatcgaagaaggggaaaaaaatgattagtggcgaggaatggagtgaagaatggggagaattatattatggtataggaaatgagtccatgggagatgggggaatacatgctgagtacatggaaaaatgggctaataaatatgcaacagatggaagcggtaatgaatggggaaactcatggggagatatgtggaattggtctacaaaggtaaaatcttggggtgagaagtgggagaataacaatataacagaaaaatggtaa

SEQ ID NO: 3131 - DNA, 633 bp, Cryptosporidium hominis
atgagtcaaggagaaatctatagtttaaaagattttgtttcaaattttgaagatgagaaagaatatttcgaatctaaattttgtataagaaaaaccaagttaattgatcttattttcccaattattcatggaattgagagaaaaattattttaaacagttttttaaaaacaaaaatcaattgtcagacgggtaaagcccaagacttgcaagtaatagtttcaaaacttgatacatatttgtctttattattaggagaattaccaatgaacggctgtttgttcagttgtaaggggattagctcagaaacaattgctttgattattgctgaaagagaatttgtaagacaaagcgtaccaaaattattttggctctcaatttactatcttgtaaattcaatgaaatttatttcaagagaacaccaacgtgtattttatataataagcactggtaaagattttgagccatctattcacttaaaaattcctaattctaaaagtgataatttttttctgcttgataaatccaatgattatgctgctagaattagttattttgacaaagcactatcaaaaattgataaaaatagtatattcagttcaactaaccactccaagaagtttaacttcgaataa

SEQ ID NO: 3132 - DNA, 1284 bp, Cryptosporidium hominis
atgatgatagggaatgaagtccacattgtacaataccaccccccaataaactgggtacttcttgaaagcgatttaatctcaggaagaatcaataatcaaactctcgaaagatactcgcataaccttatatatccatttgtttcttgcaatgacagaacaattgatagtttatctagagtattctctcgaataatttccaatgaatttcaaattaacacttttttgcggaagcttggcttttttgtctccagtagattaaacgaaaaattgtataaaattgatcaatgcttaagttccagacaaatttaccagtctataattgatatctggttaaagtcggataaggaattcgaaaaaatttcttccaatatgactaaaaatgaaataaaaaaaaattcccatcaaaacactgaacaaatatttaatagccaactgaatgtcaactttgtaagtattttacgaaacatcataaagaaatgcggtgacgaaaataaaaacattactatttggagtataattccggaaaataatatggagtttaactcatcttttgaatcaactgaagatgatgcaatgtcaattaaaattattgaagggttactgaatatatgctttaatgacttacagagagaatttttcaacctaagaaatataaaaatcaatttgattttaataattaaatattctaaggtacttctttccataagtagtgataaaagaccaactattattacgaatcaaagcaatcatcaaattaaaatatcttgtgtagattcaagatgtttactgagctattctgatgtaataattgcaaattcgctgaacttattaactttaaggttagatttttcaaacctattctgcggtggaaatactatattaacactatttgcagaaaaaaacaattatttattgaaatatgttgacaaaaatgcttgcaacgagtatatcgatagaaagattgacacttcagatttatctgactcagaggaaggagaggtggtagaacaggagaatattatcgcaattatggaaaatgagtttcaaaaaaaaggatgggataagttagttgataacatttctatgaaaattataggttttgtgccttctcactggagtccaactgctattaagttatttcctctggcatctcctgtcggaaggaatagttttaagccattacaagaagtatatcattctttaaatgctggcagtgctttattgggaatcaatgatatacgcttactggctattatcataaacttgtccataatgaccacgtag

SEQ ID NO: 3133 - DNA, 2022 bp, Cryptosporidium hominis
atgcaaattgggttcccagagaaaagcctgcaaattccaaataagtcatgtggaagaaaatggaataagttcattatatttatcaattttattagttttttctcaattatcacaaaaataaatggtaacttattacataatggaaactactccgtgaacggtaatgaatccggtgtgagtcgtgcgttgaagcaagaaaaagatgaccactccatattaattggaaaaaaaaacgaaacaaatactgaaatattttctccaagtaactattctagtcaaagctccactaaaccagtagatcatcgcactgaaaatttcatagaaaaagatttccagaaaaataatagtttagttgaagaagataatttgacttctaaatttttcgatccatttgtattcaatttttccattgatgttcatcaatgtataagcaaatacgagaagctcaacaaatatcttcaaaagatctctttgattttttacttatttaataagactcgtgagcttgaaaatgagggtttaaataacaattctactagcatcttgaaatctgagaatgagagagttgtaaatactacaattaaaatcaatattgcaactaattctggaaaaatggacaatcaccttgatataattattcaatctgatgtgttttttaactctgtttatagaacaaataccacttggatagacagattgttggatattccaaatattaattcaagtcctatgaatctgttaaatttgacgaataatcaagataatagtcaatcaattatagattgtatctgtatatttgtttctgaagttcaatcaaatttaggactgaacagatcttccttagaaatgtgtaatataaaaattcaggagattattttggcaatcaagtcaaatccagaagcgagatttgaattgactcaattatcgcttgatcgccccccttccaaattaattattccaaagaatttaggggataaagtaaccggatatagctggaaagaatctattgcggaaggagaagagatacaatctgaaaatctgttaggtagatctgtacaaaagcttgagcccacgcatagcagtggaaatgaactcttaaaggagttgaatacagaaaattcgaacgctagtaacggagttaatgaaactggcgaggtaacaaataaagatatatattttgattcgcgcgatgtaaatggaggttcctgtgtatatatacctttcgatcagggtaaatgcggtggatgttatgcatttgttgttagcgcatcaataagtatttcaaattgtatacaaaagctggtactgcctgcaccactatctcctcaacaaataattgattgcagcatgagttttgggaatttaggatgcgatggcggattttattcgaacggttggagttacttgcttgaacaaaacgtcccgaaaaattacatttgttcttggaatgaatacccttatatcgactcaattagtagttgcaaggcgagtgcttgcaatggttgtttaactattagcaaatataacgtttttactggccttgcattaaatggcgatgatggctgggattttgtgacaacaatacttccgaaagtcgggtcaatttcactaagtattaattctaatttagccggttttagcagctattcagatggaatttataaggcaccaaaatgcacaactcactctgaactgaaccatgcagtaattatgatcgggtatggaataaatgacaatggggataaatattatgtaatacaaaatagttggggagtgtcatggggaattggtggttttatgaatgtttcggcagattcgtgtgacatgttttggtaccctggtattatccgtcaactttcatcagaatctttgcctgacaaatgcacaggaaataaattgttacttactggtccaggagaaataaataaaccgcaaaaaaaatctactgaatacaatatttttgtgaaaaaaacatattatggaatatgctttataattaatatcctattattagtgtattag

SEQ ID NO: 3134 - DNA, 993 bp, Cryptosporidium hominis
atggacattttgctattaattaatgatttattcaataatattaaactagtttttagtgagaagagtgatttacatgataaatcaaaaagcaataatagccctatttctgaaatttcctctatttttattactaatgttggatcaaattccgcagcttcaagacaaactttctggggcacaaataatgccaggatagtgtcaatctgcgatggaatcggcgaatataatgatagacaaggaattaaagaccataataagaaaattccgggaatcctgcactcagtaatatatcaaatatatcaaaatattaatcattcctcattatttaattggaagttgagtgcggacgtattaatacaaaaatcaactaatattcatgaggatattgaaaatatgtctaatcaggtagatttcggaacacaacaatcatttaatcgcgagaaactattaaattttgacggagggttatcaggctatatttccacagaacaaaacttaagtcttgaaaattatgcttttgtgaataatcattcaaaatccaactatactgatactctttcaggacttaattttcgtaatacaactattggtaagtcaaaaaccataagcaactgtgagtacaaaagttccgaagaatttatatctcaaatatacagagaaatacagactttatctccaaattttttgagctcgatcaacgcctatcgctttaaggaagaactactcagcttatccaaagaatccccaaactctcacttaattataattctgaaaatagaagcaatcatttcaaattcctcaatttcttcaaatatagtcctcactgatttcttcatagatgaagatggcactgccgacaataacattgtcgactatttttccactgtaaaaggcaatcctgttaacaaccaatttatggaaattttctcacacctaagaaagaatagtcagactgagcctttaatttatacccttgttcattcaattatttga

SEQ ID NO: 3135 - DNA, 2400 bp, Cryptosporidium hominis
atggacgatcacaatgtagacaaaaatgaaattttctatagaaaaacagacaaggaggaacagaaggaaattcggaataaaatgctggattcaatcatgaggaaaataaatatcgagtttcaaactctagaaaatactgaaaatggcaatgagaaaaaaaaatcattaaattttggagcaaagaaattagtagataaacttagaggtgaaagagaaaatggaactaatgacccaagattaaatacacccgaatttacaatagaagttaatcatcctgaattcgttgagaaaattgttgattttagtgaaattaagccttacaaaaatgtaacaaatcatgaaaattctgaaatcaagagagaatattcaacaagtccttgttattattatcttccaacaggatacgaaaggataggtaattgttttaatgaaatccggtttaggagaaaacttaattttttaaaagatagtgtacgagataatcgaaacattgatacaaataatagttcaaatccaaaggtaaaatcaaattcatttataaacaaagaatttaatacgaagaacagttctttatgtttagatgaaaagccagttggcttaatcgaagataaaaaaatgtcgaaaatttctaataaatcagtaaaaattgatccatcatctctaaaagatttaaataaaattgttggtgctggccaaagtaaaaatgttgaagttgaaagcttaggaggattcacaaaaaataatggtttagatcaacacttgctccttaaaagcccatcaaaaaatgagacgaacataattgggtctcatgcaaatgatgaaagtgattttcaaaaaggaagtattttagctgccaaatttaagaaagaattagatgtttcaattaaaacaaagaatagtttaaaggtttcatcaaagatagattcctcaatacatctaataaaaaaagaagctgatacttcaattcaggcaaagagcaaccttaaaattccaccaaagaaagatttgtcaatacctccaataaataaagaagctgatgctttaattcaaacaaagaacaaccttaaaattccgccaaagaaagatttgtcaacaactccaataaagaaagaagctgatacttcaatcccaataaagaataatttaaaaattccatcaaaaataaatccctcaatggctccaataaagagagaagttgttacctcgactcaagcaatgaactgccttaaaattccaccaatggaagcagaatcagtacctccaattaagaaagaagttgatactttaattttatcaaagaaaagccttattccaccaaagaaagatttctcaacgcctccaataaagaaagaagctgatacttcaattcaaacaaagaacaaccttaaaattgtactaaagaaagatttctcagtaactgtaatgaaaaaagaagctgatacttcaactcaagcaaagaaaaaccttcaaattacactaaagaaagatttgccaacacctccaataaagaaagaggctgatacttcaattcaaataaagagcaaccttaaaattcctccaaagaaagatttgtcaatacctccaataaagaaagaagctgatacttcaattcaaacaaagagcaaccttaaaattcctccaaagaaagatttgtcaatacctccaataaagaaagaagctgatacttcaattcaaacaaagaacaatctcaaaatttcgccaaagaaagatttgtcaacacctccaataaagaaagaagctgatacttcaattcaaacaaagaacaaccttcaaattctatcaaaagaagattcctcaattcttacaatgaagaaagaggttgatacttcaattcaagcaaagaaaaaccttcaaattccaccaaagaaaaatttgtcaatacctccaataaagaaagaagctgatacttcaattcaaacaaagatcaaccttaaaattccgccaaagaaagatttgtcaatacctccaataaagaaagaagctgatacttcaattcaaacaaagatcaaccttaaaattccgccaaagaaagatttgtcaatacctccaataaagaaagaagctgatacttcaattcaaacaaagatcaaccttaaaattccgccaaagaaagatttgtcaatacctccaataaataaagaagctgatacttcaattcaaacaaagagcaaccttaaaattcctccaaagaaagatttgtcaatacctccaataaagaaagaggctgatacttcaattcaaacaaagaacaatcttaaagctgcactaaagaaaacacctatacttccaatgaagaaagaaattgaaatttcaattttattaaagaaaaacattaaaattccaccaaagaaagatggtttagtaacatcattaaattag

SEQ ID NO: 3136 - DNA, 447 bp, Cryptosporidium hominis
atgcaggatgaatttgttgatcacaagttggagacggaattattttctattctatctcctgaactattaaatgaaataatgattgaggaatttcctcacataagactaggaccttctgtttcacaggttttaacgactttgacaaacggatttattcaagacgttgttaagaactcatacataatttcgaaacacaaaaatcactccgaagtccaagctgatgatatactagtttatttaagaatgaaataccctgatactaagctagaagagttttgtgaaactatttcacaaaggaaagaaggaaggagcggagctggcactttagaaagtgaggagggcaacgctgtaagtaatagtggattactatcgattaaattatttaatacagagagatttaaaagtaattcaaaaataatgaacaatttgcggaatagttcaatttaa

SEQ ID NO: 3137 - DNA, 489 bp, Cryptosporidium hominis
atggatcgtgagaaaagtcatgaaattatgaaatatatcactcttttcattccggataattacaaaggcatactaatatggaaatcaactaattttatacgtcattgcgatattatccttacagcaaacaaacaccgtctgaaaatcttaaagcatggtttatctctattcgaatttaacaagaggtataatatcgatgtttctgggctagcacagaactcaaatagttttctgaaagatattcaaattagtatatccgatattgagaacaattctaataaattatgcaaattaagtgataagccatataaaaacatttgtactctaataaatcaccaaaaaatgatcatccatttttcaaaaaaagtggttttgactcaaaacaagttatttggtttcagagagcaagacgtattcaagctgtcttttgcctatcacccttcctctatcatttattacaagatcatagaaaagctacataagagttaa

SEQ ID NO: 3138 - DNA, 942 bp, Cryptosporidium hominis
atgtgtctaagcggagaacattcaggtgctgcattctacaacgtaaattccagtttaagtaatcgaaaaaatattattattcacccaattgtgcttttatcaattgtagatcattataataggattgcaaagggtacttcaaaaagggtagttggcacattgctaggggaacttcatgatgaagatggaattcacgttacaaatagttacgctttaccttttgaggaggattcaagagacccaacggtttggtatctagatcacaattatcatgaacaaatgtatttaatgtttaaaaagatcaatacaaaagagaaaattgttggttggtacagcactggccccaaaaccaaggttgttgatatcgacatacatgaactatttagaagatattgccctgacccattatatttaattgctgacgtaactgcggatgattttgaatatttgtcaagtccaattagcgcttatttttcaatggatgaacccaatagtgtcttaaagaaaaagtttgcgcatgttccatgtacgattggcgcattcgaagcagaggaagttggtgtggaacacctattgagagaccttaaaaatacatcaacctctactcttattacgcaaatttcagatacaattaactcttgtaaaatacttgtctctaaattaaaagaatcgaaaaactatttgaatgatatagttgaaggtaggatacctccaaatcacaggattatttctgtccttcaagatatttttaacttgcttccagacttgagagagccagaagcgatttatgcattttcaaataggtatgcggatatgattctaacaatatatgggatgagttgcttacgttctgtgctttctatgcatgacctagtcaataatgtttccgagaataggacagcctttgaagcgagtatgaaaacttgcaactctgatttatag

SEQ ID NO: 3139 - DNA, 2007 bp, Cryptosporidium hominis
atgtctagagaaacaagtaagatcaggtttttatcgctctcaaggaggtcatgtttgaatgatgtagtaaaaaatttcatcattcaatgcagcagccacagtgaccacgagatagttgcaaagtttggagaaataaaggggtattattccagaatgagcataaatttaccagttgcatgtgactgtattcttgagcatggttcaagcgattacaaatttgaagaaaaaattggaagaaaacagcaaagctatttgattgaaagaattattcgagcaaacagagaatcgtggttggttgcagaaaaagtaggcattgatttattctttgaggaaaaatattcgaatgggacagtttcaattgataaaaatggagataagtcttcattttgtgaactgaaccttggcgaagtcgttgtttataaaccaaaatccaaagttcattttactattactggtatttcaaagtcaaagattgatcaacctaaatcagatattccattatctagatataaaaaaagtatcattagctggaactttcaaagaaagtctggtagtgcatatcctttttgggatttaaagataattaacgtaataagctcttctgaaagaaagcgcagaagggaagagcattatgatatgcggaatgacttgactgaaggaagttcgccggatagttattcgaaggatgaaaatgacgacgaagacgacgagtattggatggttgtattttcaggtaataaacaactgatatccaaacatgttgatttatataataaaggacaaataaatggactagatagaattacaaatgagcttatatataattcatcgctcatagcaaaatatttagatgaagcaatttctagtaattcctgtaatctttatcctataagctattattacccaaatttttttggtgatattactacttcaattagagcacactataatatgaaaaaaatacaaaatgctgattattcaatcatagggggtttgagaaagtataataatgaggtaaaaagagcattaatagatcaatatttcgagagacaattgaaatatagacaaaataggcatttaagcgtattagatttagcgtgtgggcatgggcaagacatacttaaatttaaagggaagaaaataagtcgtcttatcgggatagatatttctgcagaagaaatttctgaagcaaggcaccgtttaaagagatacgaaaattctttaaacttctccgttgagtatcatgttgggaatctgctttcgagaacaacatattcaaaaattttgaaaaactatacatttgaaattatttcgatacaactatcaatgcattatatgcttatcaatgaggaaacatcattagaatttttgaggaacatatcaaactatctaaaacctggtggcttttttattggttctacaatttcatgcgaccatatattttattctatgaaacaaaactcagttaagataaaccttaatgaaaaccccgaagatgttaacgattcaaatggaaacttaaatagcacaaaatatgtgtgtggaaactcaatttataaaatttcatttaattgtgatgattgggataaatatttttcagacaatgttgatttggaaagaggaatcaaacttttcagaactgagtggggtattaagtacgacttctggctaattgagcatatcaatcaatacgaatatgttgtgccttgggagtcattttgcggccttgcaagcaaagttggcctagagcttgtccagtattcagattttccaagtttcactgaatttacacaaaaaaactttccaaatattagattctctaactggttaaacaaccccaagaattctgggttaattacccaacctgaaaacgaagtatttagcctttattgtgtattcgcattcaagaaaattgaagatagtaatattaatttagatgaacaagggattacatgtgactttcagttatctaaaaatttaacatccggctttaaaattaagagatag

SEQ ID NO: 3140 - DNA, 2382 bp, Cryptosporidium hominis
atgcaaaattcaataggaacaatttattatagccatcctactcgagatttagaaaagggcgattggaataatgacgcagtaaatagttcagtaggtctactctcattagaagaatgtagaagtaaatttagtaatttcatcaaaaactttaatcaaggtggagaatatatttacagagagatgctaataaacaatatttctattggcgaatatacacttagactcgaacttcaccatttgagtattgatgaggtttcttgctcagaaataggggaaaacactgagaatgcaagttatgatgggaaccttatagatgggcaagaaaatgactctgataattttgttaatggcgtaaggacgagcaatgaattatgttgtttaattcaatgtttcaagaatgcaccactaaaatacattccaatttgtgaaggcgtattaaaagaagtatatttagaacttgtgggaaaacataaaaaagaaatatctgaggaagagattaacgaaattgttccagatatacagttacaaattgtctcaaatcaagaaccaaccttaattagggatctcagaagtaatgttatggaaaaactggtcaccgttcctggaatagttatccaatcttcaaagcctcaaaagaaagcctctaagcttaaaattttatgtcgccaatgtaagggtaccagaaacataaatatcccaatttggcgtcaaggtacaatgcttccaagagtttgcaacacaactccaataggagatgcaccaaagtgcccattagatccatattttactctttgcgatgagtctgaatacattgatatacaaagcatgaaattccaggaacttccagaacacgttcctactggagacattcctcgtaatatttcactacatatgacacgcggacttatagacaaagtgattccaggaaataggctctatgttgtaggcgtgctttcttccacagataaggaatcatcgaaagctcattctagcagtagaaatggctctctcagaacatcctatttgcacgttattggcgtaatgaactatgggagtagttggtcaaataaaaatacaaatactttgataaaaaactcatcaattagcaaccaatacaatgaaatagaagagtttcgtcgtatttcgtctttaccaaatattcatgagctaattgttaacagtatcgcccctgcaatttatgggaatgaaacaattaaacaagcaatagcatgcttactttttagcgggagttcaaagtgtctacctgatggtaatagaattagaggtgatttaaatgttttattgttaggagacccttcaacagctaagtctcagcttttgaagtttgtagaacaggttgccccaatatgcatttatacgtcaggtaaaggaagtagcgccgctggtcttactgccgcaatagttaaggatcatgcgaatggtgtgtatgcactggagggtggagctatggtacttgctgacggaggggtcgtatgcattgatgagtttgataaaatgcgtgatgatgatcgtgtagctattcatgaagctatggaacaacaaacaataagtattgcaaaagcaggaattacgactattttaaaagcaaggtgttctatattggccgctgcaaaccccacttttggatcttatgatgatagcaaggacttaacacaacaacatgattttgaatcgacaattctatcaagatttgaccttatatttttattaaaagatgaaaaaaatgttgaaagagataagctaatagcctcacatattgtggagctgcattctggtattaaaggcaagatgagcggcgactgctcagaatctactaactctctccagttcgagcaactgcagaagtacattaattactgtcgagagtttattcatccacgtttatctctggatgctgctgcgatactagaaaatttttatgtcaaaataagagaagataaccgtgaagatacgaacaaagcaagcaaagatagaataccaataccaataacagttagacagttagaggcaatcacaagaattgcagagagcttcgcaaaaatggaaatgcagaatattgcaagcgagaaacatgtcgagatggctatcaaattattcaaaaatgcaacaatagaagcaattaaatcaaatattctattacttgacaatctgtcaccaacagagcaatctgctattattgatgcagaggtcgctataaaaaataggattccagtaaaagcaagggcaggaaaagcgacaataatcaaggatttggcgttaattggatatgacccatattatttatcaaaggccatgaaaatccttatccaaaagggtgacttaatcgaaagatcagatttttctatattcagggttaagtaa

SEQ ID NO: 3141 - DNA, 663 bp, Cryptosporidium hominis
atgaatagccagtatccaggatatgctgatgaatttaatagcaatttagctgaatcttttgaattagatacagaccgtaatcaactagcactacaaagaggggaagttcgtgaaaaaaacaatgtatctatagaaaactcctcatcggactacactgcgcagaatgcgaatggctccttggcaaacaaaattaaaataaatagatcaaggaatccaaagaagagcatttcaaatcagagttcagggataatcagctcatttaagtcgtggactcactcattgattactcattcgtctagacaaaattgccaaggcaggcgccagcgatcaagaaacatagatgctacggttaatatggagactgctaatactgaaggccatggaagtatatcgcagactgaaaatcgtgagtcaaacatcctacgcacagaaatctcggatgaagagcttgcaagaagaatacagatagaagagttaaatggcattggatcatttcatataatggaagatagctcaaatcttcctctatattcacttggaagttttcgagatgctaattattatccgaatgtaacagtttcttcatctgaaagcatagcaattagtccttttcaaggcgtttcttacaaatttgaatttcgatcttcagacgatgaacaataa

SEQ ID NO: 3142 - DNA, 1608 bp, Cryptosporidium hominis
atggtagttttttctgcatcaattgttagtaatagaaaaattctcttatcaagacaatttgttgaaatgacaagaggcgatgttgaagcttacttgaatagatttattaaaaaaattgaacaattctgcttaagcaatgaatatacttatatggagatcgataacattaggtttatatatcaagcaatcgataatatttatcttatcttgatgacacccattaattctaatataattgaagatatggacactttgcaattattttgtcaagtactatacgattgttgtaataacccccctccaataacggaagatttaattgcaaataattgctttgatgtcattttcgcctttgatgaaattgtttcttttggctatagagaatcgataaatttgagtcaaataaaaacgtgccttgaaatggaatctcaagaagaaaagctgcataagttgataaggcagaacaaggaaaatgaagaaaaagagcgtagaaggcatattgcaaataggcttgataaagagagggtaacaaatgaggcatttaaccaatcgaactatgcatcgacaaattcaaataacaatattgtaaaatcctcattatctgggattgcagcgttcgcagaatcggttggagtcggtaaaatagctcagtctgtaggaattggcccaataaaaaatatttcgaggaacgataataatctagttagcaattcagatccagcaggcgacagccgaaactttgggatttttgtaaacgaatcaacagctattcaatctatgaacgctccaggaaaagggatgcttattgggaaaaagaaaccaatcgcagaatcgaaaccaaatattagtctttcatcaaaagttacggataatcattcagattttaaattaaaagaaaatccatgcaacaccctggatattaagtatactgaagatgattgctcattgattgaggagaagattgaattctcacttagtgttgatggaaagattcaatctagagttgaaattcaaggaacttttcaagttgctttgccttccgaagcctttcctgagtattcaataactgaagaccccagatttcaattcaagactcacccaaaccttaataaggaaaaattccaagattgcggtatcttggaattaaaggatggcataaattgcacgttgccagtaaacactctgatgccacttgttaaatggaggccatcatcccacttccagaataatcaaatcgagcttccgttttctttttcttactggcctctcgacgcaggaaatgggtatacaaatgttactattgaaattgaaccctcccaatcaatagctaattttaaattaaacattcctttgacatctatatctacatataacacaaatcttggcgcattcgaatcaaataaaaacagttattcttgggacattcctcaactatctccttcagaaacagctgtacttgaatttagtactaaccaatctaactttttacctatagatctatatgtatccacgtcaacatctgtttgtaaagtaggaataatgaaggacaaaaattatgtaaatccaaagcgctgcatcactaaatataatatagctattaaccaataa

SEQ ID NO: 3143 - DNA, 1203 bp, Cryptosporidium hominis
atgaataccaaaaactcgaataactcaagaatctttgttgacggtgtatttgacctaatgcatgctggccactttaatgcgttaaggaaagcaaagcaattcggaaatgaattggtagttggtataaattctgatcttgattgcttcaatttaaagggatgttatcctatttataaccaggacgaacgtggagagcttatgaaaggctgtaaatgggctgatgaaattgttatcggaactccgtacatagttgaggggagcttactaaatcaattaaactgcgaatttgttgcgcatggcgatgaccttgtattatgttcagatgggactgatccatataatgagccaagaatattgggtaggttaaaaatatttcaaagaactgaaggtgtaagcacaacttcagttatgactcgtatttttcgtgctttgggcctagaacttgaagatattctgccgttgaatgaatttgataattctggtatgaatggaaaagaaaactttattgcatcaaaaattgacaaattccttgatggagattattctccttgccaaagtttgatctctgcaagcagagttttaagttttgcctgtggaatagcatctgcaaagcaagtgtataactcaaatcccaatgttacgtatattgatggaagcttcgatatctttcatatcggtcatttgagatttcttgaaaaagtgaaaaaaatttttggtggagtcttaataattggaatttatgatgactcaacaactcaattgatttatggagatgggtttccaatacttaaaatgatggaaagagcactaacattattatctatgcgtgttgtagatgatgtaatatttggagctccaataaagattacaaaaaaacttatagaaacttacaaaattaataatgttgtctcttgcaagattatagaaaactatttcagttctgaacatctaaaaaaaaacaattttgattcagaagattcagcagaatacgcatcaaagctggaagaattttgctatgaaattccaaaaaagatgggaatattttgcaatactactattcttaaaaaagaagaaatttgtactaaccgtgatatattttcacgcattatggataaaagagactctatcttgtatgttatcaaaaaaaggtgggcaaaagaactaagtttttatgaaaacgaggtaaatagtaagctacattaa

SEQ ID NO: 3144 - DNA, 1038 bp, Cryptosporidium hominis
atgatgactatggacaagaaacacaattcttttttttctaatcttaaagacaaatacaaagtattctcaatgaacaatgccaaacataggatttttagtcgaaagaaagccggctcaaagaaatgtgaaaatgagaaaattaaagggataaatgtttctttcgaaaatacttactcggattcaattgtaaattcaagtaacgaacatatttcttctaattgcatgagttcttcgtccgacaacatgagccatgactcaaataattgtattagtcaagaaagacaaggatcaaagttcgagtacaaacttagcaaatctacaacgaagattgagaataacacagctattaattccaattctagcccttcattgaatgaaatattctcagataattcatcaaccagtttgtttagcgattcgagcacaagtttaaattctaaatataaaagcaaatattccagcgatactcaaagttcgacatatcgttcaaatatccaggattacaatcaaaataccgattataactgctctgatacttcgcgtaaagagaacatctcacaggggcaagggataccgattaaaaaaagaatagaaaatacggttgaaggcaaagaaaaaactaagcctcaactttataaaagaaacaatagcggagagaataacaattacagggaaagtaagccttatctgaataaagagatactggatatcttgaacagtaaaaatcttaatagagaagagaagagaactacacagcaggttgttgcgattgaagatctcggcgttgatgataaaaatattgaaataaatgcgacatctcgctctgagaacaactcttaccgccaagaagttgaaagatgctcattcaaagacttgaatgtttattttggctgggaaacacctttagtaattccaataataactgaaccagattgctgctatcaaagcagttattcgaactacgatgtattgattgattatgcttgtatagatggtgataaataccatttatgtagctttatagagggcattcactag

SEQ ID NO: 3145 - DNA, 501 bp, Cryptosporidium hominis
atgcaagaaaataagaatctagcctcacttatttgtcaggaatcgaatatttctggaaacgttgagttagatgaaggatgtatagtccacccttctgcgttaatcgatggtggagttggcggaattataataggaaagaataatataatagaagaatctgtaaaaattgttaacaagactattaacagaatgtcaattggtaataacaactggttccatgtaagatgtgaagttgacagtgccttatctataggtaataataatagttttgaagtaggatccagagtaaataagaacgtaaaaataggtaacaattgtataatttcattaaagtcaagccttcccccgaatttggagatttgtaatgatatgtgcgtttcaaaggttggcgattctttaatatatacacttattaactcctctccaaataaacatttgtgcgaacaagtaaattttctgaacaatattctgcgtggaagttcaatggaaaagaaaaggtaa

SEQ ID NO: 3146 - DNA, 1332 bp, Cryptosporidium hominis
atggaggaattaattaatgacattgaaaacatttcaataaatagtaataatgctgatgaatctaatactagggatcccgaaaaaaatgataatttttttgattatgaaattttattaccaactaagagccaattagaagattattctattctttcattaacaccagttaaggacaatgataaggaaatatttaaaaattgtattctttgtagggattattcaagcccaatttgtaaagaatgttcaaaacataattcaaaaacttcaaggaaaagcaaactcaaaaaaaataaaattatcccagatggtaaagttaaagcactcgcaatgcaatttgaaaatattctgccagaagtaacaaatagtagcccaagcttttctattgtaaatgataatttcatgttagggaagagcgaacctgctcattttcaagctgatatttcattaaattcaataattgagcatacaaatgtagataatagagattattcgaacactagtttacttggggaccaaactaatattcctagtatagattccgaaaacgatcatgcaaagtctaaaatagcaaaaaatcaattgactccaattatagacccaaatttgtgcgaaaaaattgatccaataaaagcaattattacatcttcagatagttatatcgatatcgttgaaaatacagaaattggaaattgtacatctgctgatacccaagttagatcaattgcgacagaaattaaccatttatttgaatgtggttttccagaaaacgacttaatatttgatcaatttgaatcattgaacccactagagcagagggctctactgctgaaatggattaccgaaattctgaaaacatcggaagcaagctccaaattatcagataatgaattcaaagagataataaaaattttaaaaggtattgtggatgagttagaacgtaatgaaacgtataaaatatccaaaagttccccaaataacaactcaacagagtatcaatcaattctcagccatgtttttgatgaaaaggatgaaagattaatcattaaaagaaattacatacaaatccctaatactaagaactcaataaaactggtgaattccaagttacaaataaatattagtattcctgaagacgaagagatagaagaggaacgcatcaatgaactaatattaaataagtatatttactcaagtagcaacttcgaatcaaattcaataattattgacgaaaatagcctgagcccaaaatctgaaatagttttagatgacgaggaaatagttggaaactcaatcaaagaaattgggaataacttttttgggtttttcaaataa

SEQ ID NO: 3147 - DNA, 201 bp, Cryptosporidium hominis
atgttttgttcaagcataaatagttttgagctctttccttttcaggttctttccactgaaaaaaatgaaagatttatgggatcaactctattattaactactaaagataacaagtatatttataaaatattaaagaatgataatagcaatgagttggatttttacagttccattaacaaaaaacacctcctcaaacgtcac

SEQ ID NO: 3148 - DNA, 657 bp, Cryptosporidium hominis
atgcgtttcttagagcattcaggattaaaccgattgtcagtactattaagtaacttagatgtaggtgatcgaattttgaatggaaggattgagttatttacttgctctgaaaaagttgttgaagagtgtgatttaagtgaaagagttgatcgagaagtgtgtgtatcacctcaatggatttcaaactctcctattgggcctgtccaacgtcaagatgttcgtgagttactggtgaacttgatcagtacaatgaatcaatgttttccagattatgaatttagcttaataaaaccggataatttattcaaagagaagagcttttctattgtatacaataatattaactatcacctttcaagtattgtagaaagaatttatcctagttttcttttagaattgtgggaaaacattagagatgccgtcgaaattaaatatacggaaatatactcgtatagattaatgggaaatgacgaactaagtccatttttggatgatggatctttgttttcatttgattactttttttatgacactaagtcccaaaagatcttatttttcgcctgtactacaaaatctaaattgaacattggtttcaaagacaacggtttagacagttcagaagaaagtatcgaggacaatgaaattggatctgaataa

SEQ ID NO: 3149 - DNA, 615 bp, Cryptosporidium hominis
atgccttcaaataatatttgctccccgataacaaattcaaatgatgaaaattcaaatgcgttaatttcatctgggtgtaagtcaactgattgtcattgcgaaggtaatggggtcgtaaccactcatactacatcaccaaacatcacccagaaatgctacattactaattcaggctgtcatgaagcaattgtaacaacaacaacacaagaagtaaaaaggcacaaatgtccaccaaaaatccaaaagattcacgaacatattagccaacctataaactataattgttcatctcaattaggaaacgtgccgtgcaatgtaatgatgaacccatgcgcgtgtagtttttcaagaagctcatgccacaggactaatcattgtaactgtagtaatggaagtgttcagtttatgtgctgcaataagtacgcaaatagtggatgtggttgttcatgttgctgttgttctacatcgagcgttcagactacgttatatcctgtatatatgtcattcccatataatcagggcagaaatatcaatgttccctacacagtttattcaacaccattaagccatacatacaatccactcacagataatcaatactcttatcaatattaa

SEQ ID NO: 3150 - DNA, 1395 bp, Cryptosporidium hominis
atgtctggcagaaagatttttgatattcagtctttaaatagtcatacagagttaatggaccaacagatgcccttacgtgaagatagttcgttagtgctatctaaagaaggtaatagtaaggagttggatataaccacagaatcatttaaatttgatgaaagtgatagttccgaaaatcatgttgtacaaccaaaatcagaagaaaatattgaaggtaaaagttcactaaaaaatgaaagaatgatcgaaattaaacgtggcaaacacacacctaggaattcactctttttaacgatgttttgttgtattggtggtgactcaagtgtaacaaggcttaaagtttcatatttggctacaaccttttttgcatctagtattatttttgtttttatacaagagctagtaattagtcagcttacgaacgggtattccatgataaaaatacctgatggatatttgtttggacctcctcctcaggtagtttttgatatgggagcattagatacgaatctcgttagaaatgggcagttggctcgactcttttggtcattttggcttcacactggatttatccatctcttcattaatctttcatgtcaaataatacttggcattattctagagactcgctgggttatatggagatatgcgatactttacttattgggtggtatttctggtaatttagcctctgcagtcttggatccatgcacaatttctgccggctcatcagcttgcttctttgcgcttttggcagggattattgtattactattagaaaattggagaaattctcggtggcaatttttatacgttctattagttattattgcctctttaataggaatttccttaagtttcatgtcaaacacagataattgggcccatatcggtggatttgttgcaggactattatggtcttttgcaagcatggagtcattttcaagaaaatccaaaactttacgtaaatcaataaaatcttcaggaaaaaatacgattcaattgccaagtcaagataatgttcagctttcacttcaaatcaagccaactgatgttgaagttggtcattccaaaagccagtttgaagaaacttcaatagtagaatctatttctgataacgaagctaaaaatgaatatcttaaaagacgctttatcccagcaaattgcgcctgcagcggcggtgttcaaactgtcagggttatttcattactattattattatcgttactaactattgggtttttgtttttgttatataagccattgtacacaaagttcaatttggttttaggccatctctcattctcaggcatacaaaaatgcagttgctgcgattcacctgaaggtgtattctggtgctcgagttccccaacatggattagaagatgtggataa

SEQ ID NO: 3151 - DNA, 411 bp, Cryptosporidium hominis
atgagggtaggacaaagaaactggccaatgaattgggttattattgaagactggatagagtatttaggcgaacttagagaagctgttttacaaggatatactgggattgtatatggaatgaaggatgcaaaaagactagaaatattagggccctatgtgcccagcattattcagtttattgataatatcgtcaacgattatagcggcgaatttcctaatgattcaaacttgaagaacgccacagcgctagtcggcgatttgataactgcgtttaatgggcagcttattcaatatttactttccaaggacaaaagatctattctcgaaaacatttgtacagttggtgagacttctagggacccagatattattagtaatataaagtgggtaaggaagctctgtaatatgtaa

SEQ ID NO: 3152 - DNA, 2649 bp, Cryptosporidium hominis
atggatctaacccaagtactgttaaactgccacaattcagtagagtcaattagaaaaaatgctgaacagcagctccaagctgcccaggagcaaaatataggagaatatttgacacttttagctgaggagctgtttaatgagagtaagccagagttgtctcgccaattggccggattactattaaagaatgcagtttcagggattgaacccagaatagatattgaaagaagaggaatgtggatatctcttccacaaaatgttacatcaaaaattaaggcgttagtattagagtctattttgagtccagttgcaagtgttagaggcgcatcttgccaagtaattgcaaagcttggacgtgtagaacttccatgtaaaagatggcccgaacttcttccatatttaatcagacttgttcaaaataactctgacaacaaaatgtcaattatatataaacgctcctcattaacggctttgggatatttgtgcgaagattcaaaaatactcgaaaatgaggtttcatccctaataattacagaagatattagcaaccaaattttaactgcaattgttcagggtatgaatgaccctgactcagaaactgctttggcagcaaccaaatcattctactatgcattgtactttgcaaggagcaacttttcaaatgagatggaaagaaatttaatttttcaagttttgtgcgctttatgtgggacagaaggaaataaaagagagcttcttcaaactgcggcttacgaatgcttagtctctatagctactgaatactatgattacttgggttcatacttatcagtattgactccaatgaccataaaggggattaaaggggtatatgaaccagtttctgtttgctgtattgaattttggaacactattgcagatttagagatcgaattgtcgcttgaggatgagcacaataatacatcgccaagtacaagttgtatgcactacatctcccaagtccaggcggcgttaatacctgtgatgctggagacgctattaagacagaatgatgatgatgacctggaaagttggacggtttctaaagcagccggagcttgtttaacactttgctctcaacttcttggtgataatattttagaacccacgcttgggtttattcattctaacttttctcattcaaattggcataatagagaggctgctgttttggcttatggaagcattcttgaaggccccagcattcaaaaaatgcaacctattgttgaaacatcggtaacaaatttatgtcaggctttaaatgacaatgttgtagccgtaagagatacttgcgcatggacgattggaagaattgttacgtttcacccaactattatttttccattactaggccttcctcctcaacaatctgttgagcattcgaacggtttattgtcattattattgcagagactattggcagatgagcctcgtgtctgtacaaatatttgttggataatacatcaaattgcggaatcttctcagtttgtagaaggcggacaaaaggttttagatatatggtttccttatattgttcaaagtttattacaagcatttaaaagagaaaactctgatgagaacaatatgaaacaagcatgttttaatgctttatcaatggttgtggctaattctggggtagacaatgatatgaatttggtgaatttagcgcatgaactaattattggcgaagatattggtctacaaaagttaatggaaaaaaatcccatcccaagatctgatgcagcagttctaaatatacaactaatttgtggggcactatatgcattaactacaaaacttgggaaaagactaacacttcagtattcgcaaatactacttcgattgtacttcgagcttttacgacagggtggttcatccgaagaatctattctttctttgacttctcttattgtagcaatgtcccatgacttctctccatatgtaaacgagtgcatatctataataatccctctaatccaaggctatgatgaactcgatacgtgcaaatattcaatagaacttattggcgatttggttagatcagttggaaaaggaattaatccatctttggaaattattgtcaagactttgtgcgctttgttggctaaaaacgatgtagataggaaagttaagccattagcaataattgcactcggagatatttcaatgaatttgggggaggattttattccatacgcaatatcagtattgcaactatttcaacaagcttcaattacgcagtacaatgacggcccggttaatagtgaagactggatagagtatttaggcgaacttagagaagctgttttacaaggatatactgggattgtatatggaatgaaggatgcaaaaagactagaaatattagggccctatgtgcccagcattattcagtttattgataatatcgtcaacgattatagcggcgaatttcctaatgattcaaacttgaagaacgccacagcgctagtcggcgatttgataactgcgtttaatgggcagcttattcaatatttactttccaaggacaaaagatctattctcgaaaacatttgtacagttggtgagacttctagggacccagatattattagtaatataaagtgggtaaggaagctctgtaatatgtaa

SEQ ID NO: 3153 - DNA, 4965 bp, Cryptosporidium hominis
atggtaagcttccaagaatttacattattagaactcattaagtatttagacaagtcatatatgcttcaaaggagatggaaagtcgtaatatgggacttaagcattgaaaacttatgtgatgaagaggccagcgtatttatagaaatagattttggaacatcgagagaggaatttcgcgtacaacttgagtcaaaagaatatatcttgtcaaatggagatctcaaacatcgcctgagaacaccaattgtgcatagcctccttaaagataagcctcaaaaaataaagtttcacccttcttttgaatatagaggctcttattatgatattgaaaaagaaaaactcaagctttctgcctggaaatatcataattttagactaaatacattagacgcgatgtttgaaatcaaattaaatacatgcgcaaattctgatcttcagcatcagtgctacttgatgagattaggtgatggccatacattggaaaaggcttataggatttgtttcaatctatacttccaggaaatttatgattttcagctttcacttgatcgatttgaaataaaagaactattaactcatgataatattatggacagagttagttctctaaaaaaaaaggccgttgaaaaagttcctcttaataataattctttatttgaaatagatactaaaattaattcaaatgaattcttgtcagaatttaccattattgaaaatactgaatttgaaagtttcaataaaagtagatatcgaaatttattgggaaataacaataggataggtaatgatccaattaaaaaaatatttcaatatatttcctttaattatagtgaaaatgaagtggggaatgtattaaccgaaaaatctaaagctaatagtaaaacattgaatttagaaagtacgataaatgaacaagggaataaaggaaaaatcgaatacaatatagttgatcaaagaaaaggaatctgggatactttcttggggtttattggcctactaaaggaagatcaaaaagatagtgttcaaaaacttgatagtttattaatagaagcagaactagaccaagcaaaactccatcctgctaattgtagcccaagattaaaaattaacataatctggcctacaactttgaaaaattatactatgtatagcaatatgcaaaaaggtaccaattggcctgtatgggaaaacctaggatcaatttatttgcgaggaacaatagcagatttggaaaattgtttcattgatatagatgtcattgattgcaataaagacaaaacaataaactcacaggcaagaactcatatcccactaaaaggattgattgagactaatacagttattgaatcgaatctatctgaacctctgtggttagcagaaaaagtaaaaaaaactgaagagcgtagaatacttgctacttgggaatttgggatgattacaggaaatatttcattcaagaattatccttcacaacgacagaaagggaattttattcattttgtaaaagatagattatatttaatgattaaaataatcaaagttgacaatattataacttttgagaatttagaaaatactctagttaatatttcaatcactcatcaagggttaacctcaaagtctaattccaatatttgtagcagtttaaaagatagaccaatagatgattacattattttaccattgcagctaccaccaatatcagaactttacttttttcacttagagagtttgggtgagatttatatagacttatgggttacttcagataatcaaaacggttctaaaatgcaacatgcaggatttacttctttcacaatttgggacacaatattttctatcaaaggcgcaaaaagaccaacatctgaaagatattatagttcttatacatccggctcaaatgaaaagttaaaggtaagagtattggaacaagaagttccgttaaaattccttttcccaacagatagagttgctaatatttcctttgaagcatttattactccagatatattatctataaaaccaaagggtaatcaagcaatctgttcaaaagatactggaatagctgagaaaattgacatttttctaagaagtcgagtagaattttcaccgagtcaggcaccaaaagtatatcaaaacgaaaaagcttctattgaggtaacattaattagtaaactgggcacaggaataattgggagattctttatattttcttcttttaatcatagaggaaatgagcttatgcttacacaattcgttagaccaattcctgcgccaagtggtattattactccaagagcaatatttcattttgtaagatgcatccccttcattaatacaagttttagagaacctccaaaaagaacaagagacaagtttaacaatgaaacgtctaaaaatgattctttaaaaaggggtagtcaagaatccaaaagcgcatattcgtttgataagtcacattattggttcaccccagactttacactgctgagtaatggggggggagttattgaccattgccttttgcatgtttccttattgttaaagcaaaaaattcaagctttcgtatgtattggcacagttgctgggggacattttcattcttgggtaatgtcatggcactttagcgaggtagataatagcacatatatcaaattctgggaagtaacaacaggacaaatctatatactaaaaaataggtttatttcccaacaaagagctcgagaggtaactctgaggtttaggaagagggaacgccttttatctgccggagttgagccacaaagtaatagtgtacatataaagacgataaaactaccatatagaagtattgacactatttttaatgaaataaatatttggtataatgttcaagaaaatataaatccggggtcaatattttttgatctatggaatagttcattatttatttcgtgtacgaatacacctttagttcataatcctgggttccgaagccagccatattcatcaatattaaacaaatcaaccattaaaaatatgaagaatctattaaaaaatatactacattatgagattcaatctcgtaggagtgcacagaatcttggaacaagatggaatatggacccaacgttaaatctttttttggaaaaaggtctggaaatcatagagctttccgaaatatcaagcgaagaagagtatcctgacgttatgacaaaatttagtgactggaagtttgccatggaatcaaaagttccattaatgcatagagtgttgggatttccactctcatttaatcatgcaaacccaaaaacaattgcggaaacagttttcgggaaacttgaaattttatttacaagagataaatcagcaactttgactattgcagttttaattaatggctatccaaatcatgttttgtgttgtagaatattcattttggttattcaaaaagtcagtgaaagagaaaggaaaaaaattttggaaaggcaagagaaaaaaaaattgaaacaggagaaatcatttaaaaacgaaaaatcaaattcattaaagttagatttaacaagttctaaatttgaagaaaataatgatattaatcaggctaacattaattatcaagatggatttaacatagaaaataataatcaaattattagcgaagacacaaaaaaagctgtacatagtagtgttccattggtgacggctgacttcataggtatattagacaaagaaaataagatgatacggaaaagaagagtagtcttacctgaaggtagcatttctggaaatctttggatttcaaaaaaaattaaggatgatggaaattttcggtactatattgaaggaattgaaaattctgtcagtgaaaatttaaatatatcaaaaaatagagtatgtgcaactgagttgaattatgaaggtcaaagagtggggtttgccatcttgcctggcctaaatgatgatgaaatgagtcctttagacttgatgtatgaaatggctttaaaggtggacgaattattgaaatcagacaaaaactttatcgaatttactggtggggatgctgtactggaatgggattatgaacaaatggaaagcggaggagaggatgaggaagtgatccaatacatagaaaatgaagataattctgatgtccaatcagaaataagcgaatttgaagaaaacttaagcgaagaagagcttgatgaaacactcgaaagtgaatcagaagaaaacacagaaaacattgaatcggaaaatgaagacgatataaattgtttaagttctaatagttctagctcaatatcgaatacattttcgagcttggtcgaagaaaatgaacaaaatacaacttcaagacatctattgaaaagagaatcaaatgaagacttcaattccgatatttcaaatggattttctgatacttcagtagaaaatggaataaaaacagtaaggtttgaagtacgggagaattctgataatttaaatagttcaaaaaataacctcaaaaccaaaataagttcaagtgtttctgaaaaaaagaatctgaaaaggtttacaaaaacggggaaatatataatttatagacggccagaatatgaacaatcaaaaatagttagcaaagagctcataaattccaatacaattactagcgacttatcagtatttccggctgcaacattagcaattagcttagcaagaggccattctgagataagagaaagcggattgttaagtgcaaacaaggaaacatattacaacatagaaaaaagtaggtacatcaaaaaaacagataactctggaaataaaatgcttactcattcgagttcaaacgacttactttctaatatgttttataaaggaaactataatacatttgcagaaacattaaataaaaaaaattcaacaaataatgaaatgattaactcaataaaggctaacaaacgttcaatacctagaggaaactctattacctttagaaaaaactaa

SEQ ID NO: 3154 - DNA, 1956 bp, Cryptosporidium hominis
atgaataatgaacttaatactaccataaaaaatattttaaaaataaatgaaattcaaaatgacgatcttgctttgatgttatcaagatatattcagaaaaactttttaataaatacaaataatgatttttttgcagacggggaatatattcatgaagaaataattaaggtatctattgcaattgtggcaaattgcaatttaatttccagcacaaatattaaagggagagacaatattttaattaatagtgagggagttcctgtttataaaaattatattgaatttgagaatttcaaagatttaaataattggatgattaatctatatgatcgaatacttttctcgaaaaaagagtcttttcaaactgaaaatatagttgaagaaaaaatgcaaaaattgataaatgaattgaataattatgaaataatcccatttgaactcccaatagactttattacgtcaatttataattcggggacaatatcgtcaggtagaatagttgattatttaagatcaatgtatttattatttaatgtagatgacggaaatattttaaagcatgaacccgaaattaaagataatatttctcacgaagatatttacatatataacgacgagttaactgaatatctttctgatgatcaagaattaaaaataaataacattggaaataaaggatctttctcaaaaacagttgaaaccgaactttgcgagcctagtgttaacttaaatcttagggtcagcttttctattggcaagttttttgaaaaaatggaaactgatttaaaaactttagaagaaatcgctttaatattttttggaacaataagttcgacttctgaacatatgaataatccagataaaagagatatacttttaaatgttttttataaaaaccaattaattcacttaataagacaaaatattaatagtattaatatttcaagtcgatttttactcattaaagttttacatagaggaaattttggccaagtttatgtagggcttgacttgctatcatttaagttagtttgtttaaaaagacttatgggaagcttgtcggatgatcagtatttaagaaactctataattgaagcaaattatcttaacattctgagtaaatcttcagtttcaaagtttgtgccccattttattgatgttgtagtgaattataataatatatttattatttcagagcttcaaggtaaaaatttactatcttttatagaagatgattcagcaaaaacgtatttaactttaggcggaattcagaggattattaatcaattattaatttgcattaaacaccttcatgaatcacttaaattaattcattgcgatattaaaccagaaaatatagttattgcaggtattgatacacaagacatttttggatatttaaacaatacaaattttgacaaaaaagacgagataaatattaaattgattgattggggaagttgtttaagtattgaccaagcgtcaaatactagaaattcttatatccaaagcaggtattatcgatctcccgaaatctgtttaggactagcctacaacgagaaaattgatatttggagtgttggatgtgtaatggcagaattagtgcttagaaagccactttttgaccataatagttcaactcaacaattgttagcaaacatcattacaactataggtaaaaaaataccaatacggatgataaataactcttcaataataaatcacttcattactcatgacggacatttattcgataaaaacttaaacaaaattagactttttactacattaaaggaaaattccatacataagaacagaataaatgaattgttttcgaacaatggtcctttatttgtagatttattaaacaagcttctctgcattgaccccgatgaaagactttctgcatctcaagcattgagtcatccttggttcagttataattatcagaattaa

SEQ ID NO: 3155 - DNA, 2286 bp, Cryptosporidium hominis
atgtcagtattttcccaccaaatttttgatgatcccagtaatttacaatatatatataaggatatgatgaacaataaaattctggaagaatcaaaatctgaaaatactttggatgattcacttgaaataaagaacattttgcctgcgaatattataaaaaaaaatccttctctttatccgctttcgtacaaaactttagaactatcttctttgcatagaagaataaggaagtttttgaaggttcacgagagtggtaattctcaatttggaattatttcaaacacattatgtgattctttccgcgaacttttgaggcattttatgattaaaattacaaagtttgaatcaaatctaagaaaagggcagctcacagttcaaaatatatgtgcatactctcagcaggctttaattactttaaaagctttggatttgatctcagttcaagtcttacataaaaaagggtgtgaaattattgaccaagtatataaaattgcaaataacgaatttaaaggggaagaatcatctcagaaaattgcaaattttgttttcaatcaagtttttctttcttggtttaaacactttttaacaccctggttgaaatttggaactgcttttgatcatttttcagaatttattaattacaatttaagtactaaaaaaaaaaagtttaataaagaaaatattcactcgaaaaatttttatagagaaaaagaaagaaaaatatattttatacttccttcatttatgcatgaattagttgaaaaagtcaattatattggcttagttagtcattttgtttctcacatcaaccatttgcatagtcaaaatctgtcttttgatgcagtgaaggaaaatggaatgttaaattgtaaaaaattagaaaatacattggaacaaatgttacactctctgagcaataaatctgatttaataagaaatgaagaagttaaattatatatcaactcaatgttttttgaatcacaactattaatttacagcgtttgcaactcaattaccgatgtcagatattgcattaataaattctatgaaatatttttttgtgcgaatgattctctcattcaagaattcattgaacacattcacaagttagtgtttagaggggaaagagctgactttaattcgtctagtaatatcacacgtaaatggagtgaacttatggttaaatattatggagtatcaaatgattcagataaatctgatcgatttgtttgtaaagttgagaaaaatttgatcacagaatcggcaacggaggagttatttaatcctgcaaagtgggagataaaatcagttttatttgaagaaggttttaagtttatacaaaaagataaacaaaatatctcatgttcggatgcattcaaatatttaacaattgaatttcatgaaataaagacattcggtttgatttggcctagagaattgctgtataaatacgaggttatttttagattagttttccatttaaaatatattaattatttgcttaacaatatttggatactacatcaaacttcaaataatttggactgtgaaatgagcaaaaaaaagcctaatatttcaattagtgggttaatatataagtcttactttttaagacaaaaaatgcttttgttaacaacaggaattttagagtacatctatcaagatataattatacctatatgggggaaaatgatgcaaaatctaaaaaatatttcaactttggaagaactaaattcctatcaagaccgtttactcaatgaaatactaacactatgtttcttctcagagggagagctattacattcactatatatgattttgtcgctttgccacttatttgctagccactccaacttactaaatatttatgggttttccgaattagaaaaaaagatttcacacaaaataacaggaacaaaaaacggaaaatatgaggaaagtgtacatatttcaacatatggcagaaatctttgtaaaaaaggcgaatttgagaggtcaagcaacacattttgcactaacacgcatatcaagggtttactaatcgatactacatatattaatttggtagaaaaatttagttcaaaatttgaattgcttctttccagatttttcaacaatatatccaactgcaagagcaaaaacattaatctaataaataaattattgttaaagttgaattttaacagcttctacataggaaaaattcctgccagcgttgaaacttggggggaatacacactgaatgaaaattcctcatgcgatgaattaattgacgaaagcggatag

SEQ ID NO: 3156 - DNA, 780 bp, Cryptosporidium hominis
atgcttaatacaaattcactctttctgttatgctgtacagcatttatcttattaggagaactttatgcagttaacctatcatgcgacgctaggctaagggaatgcgaagttgaagttaaatctcttctcaaaaaaaatagtgaatgctcttctgatttggattcattaaaagcggaagtttctcatctttcggaaattatctcccagtatgaaagaaatgttaactttactcaggattctcaccacacaatatcatggagagtagcagtcaaccagttgaagaacttttcaatatttttcaaaggtcttattactgcatcatatagcaatattcctaaggaattggacttgcagattagatctatttacagcaaaatttttgtttatttagatcctgcaattgaaaagtattctgaagcgtatccattagtttgtcagcatataaaaagttatatgaatagatatatcaatttattgaatccctacattgattatatgttggtttattcagagtttatcaatgaaaaattggacggatacgtttctagaattgaatcttttgagccaaatatcgtaggaactatcccaaagagcctccatgatagagttttttacatattatgcgcattgttggcattatatgttgctttggaatcaatttgtatcgctttaagactcttatttagatgttgcggaataaaatgcggctcttcttgcacaaataagaagaacattaaatcgcctacgtcgaaatctacgcctagtaacagaagaaaataa

SEQ ID NO: 3157 - DNA, 1968 bp, Cryptosporidium hominis
atgcaagtaatatgtcttattttatttcacccacaaactatggtgagtagaatgttcgagagccagcaaaaccctatatctgacataaatataactcataatgaaagctcattaacaacttcattaatcccatacaacagatggtttgattctacaaatgaagataaaaaaattcatgatgaaataatacaaaaatcgaatccagaaaatctcgcaattgcatcacgatattttaatttacattgcccaatgtgtggtagaattataccacacaaatttttttctaatagctttaaacaatcaaccagtgaagataatttattcaatctgaaaaacttacaagagcaaagaaactttgggtacgacagctttaacattgggaatgaatctcaagtcgaaaaatcaaaaacacctcttaataactcagataacagtgaatttgaaaatgtttctgatattagtgacaaatccaataaacgtttcaatggaaggtacgcaagctatagtgttgataaccagaattacttttttttcttagaagaactatatcgccaaatcaatattagaagtggcataagtagacttcaatattctgtaatgaataaccttgtagaaaaaaattttgattcaaaagaagctaataatgaaggagatatcctagaatttaatacaataaaatctccaaaaggaattgatgtggaaataaacaacttaattaacctcaattctgatttgttaatgacaggctattatgaaaaattctttgtagagattagaaagcttggaagtggtagttttggtcaagtatatctttgcgcccatgtacttgatgggattacattagcaaaatatgccataaaaaaagttcccgttggagacgataaaaattggctttcagcagtattgcgagaagtaaaaatccgtgaattattgcatcacccaaacatcgtacaatataggcattcctggttagaaatgtacagttcaaatgagttttgtcctaaggtaccttggctttttcaattaatggaatattgtaactctgggtcgcttgataccttaatttattctgctccaacatttagccgaaacgtaaaaagttatgaagaacatgaacatagagctaattatcttttatctttttcaaaaaacaatggaaaatacatcggtgatgaattaaacttcgattataattatttcttagaaaaatacatggatgaaaatcatatatggaaaatttttttcgatattatctttggtttgcagcatttacaccatagaggaatattacatcgagatctaaagccgtctaatatcttacttcacattacttttgataaatttcttgaacaacccatttgtcaggcgttactttcagactttggaactgcgcaagtcctaaaaaatgtaaattttaagttattttcatcagaaattattccagattttaattcaattatgcctgaaggtcaaaatattttgtcagatgatcaggaagaatgcactatcttgtcaaatcagcgtcatggttttacaggaacagtggaatataccgctccagagcttctcacaaaagatgagaacggcaactttattggagaatataacatctatagcgatatttggtcattggggattacagtttacaaaatgtgctataatcaagttccattcagagttgatacaagaaatggtcttgatccggaagacccagaggagtgcatcaaggctatttttaaaggaatgaatagccttgagtttccaaatgttcctaacagaactaatgaactaaagttcctaattaggtcaatgttggacccaaacccagtaaatagaccaaacaccgatgacattctaaggcaccccataattcaagacaaactgagatcatcagaaatgatcaacgcaagcatagaacttgcaaatattatagggcataagaactataaattaaataatcagatttaa

SEQ ID NO: 3158 - DNA, 1146 bp, Cryptosporidium hominis
atggaaatatgcgatgtaatttggctattatcaactggttttaagttcgaagaaaaaattttgaatggaaatttagaccttgaaatcaagactataatagataatatgttcagatacgagaaaatcaatgataataaattctatagagagatttatagctctgaaattaaagtaattcacagtatttttgcacaaattaataagcaattcgaattttcgttcaaaagctctcctcatgatttcaaattgttaatttgtcacataatagataaaatactattaaattataatattttagcaggagataccgattgtaaatattattcaaataataataacaagttaatgagactagatttatttccaaatccatacatttatggtaacgaattatttctttatctgtatagactgaaagttatttgcacagaaaagcttggttattatgaatggtcaaacctattatcagagttaaatttaataattgaaaagtacgaagcgattaaagagatatcaaatcatgtatctttttatgattcgttcaatgattttctcatttctgacttggaaagaattattctagttaataaaaaatcatctttaacatttaatatgctgcaaaatagccatgtatttggcaatttgtcaaagttttctatatttttaaaaggaatcaatctcttaaaaacaccagaaatgaaaaagttaggtcaacaatatttattaaaatcaatttcaatacaatctttatcaaaagtaaatttcgatagttttaagtttttggttgataaagctaatatttttcaaaacgaccaactgtttcaaatatattgtaccatttcaatgttcatgaattcaaatgattttagaaactatataaagtatattattcgtgcagaaagattattaagaaatctttcaaagtcagcaagtattggtgctattgttttgataaaaatttatgtattaatttccaagctctacttattaatgcgcaatataaatgctaaagatggaagattttgtttatataattctaagtttaatatatttgattgtttgccttacataattatttctacgttggaattaattcattccgagatattggaaaactcgaagtttctgacaaaagagaacagataa

SEQ ID NO: 3159 - DNA, 252 bp, Cryptosporidium hominis
atggcttttaaatttatttattcaaatcaaacggttccaatgtacaaaaaaagagcggttaacttagcttttattcaggcattgacactactaattctgataaagaatgactttagtgcattggaaagcgacgagttaaatatgcatttacagtttgaaagaaatgaaatggttgaggaatcctatatagatggtaatataatcatttctaagtatatctctattactagatcactaaataattgtatttag

SEQ ID NO: 3160 - DNA, 1659 bp, Cryptosporidium hominis
atggactcgaatgagccgaatataaaagttttaagaaaccaatcaaaacactccaaaattagtaatgggaaaagctcaagcgtaatgaacaaaagttttaatcaatacaacataaaaaagaagaataaacaatttcaaagaagctatgactcaaacagtattgaagcaagaagtggcttaatttcagatagaattgcaaatgcagaagtaataaatggtaattccacagaatttgctgtattcattttggttttgattggtagtgaagttgaattgaagcttattgacaacagagtatatcatggcatttttcactcaattagtaaaaaggaagggactaacgaacagtttgtttgtattcgtttttgtagaagaatacatcaattatacagtaatgagctttcaaaacccatcgaggactattgtatgttcccacttgattcagtttataggctttccacaacgaatacaaatggaatacctacaagatttgattcagtttccggggaattaaaggggaacaaaatatgtggaattaatgcatttaggactgataatgagataagtcatgacgataggcacgtgcacgaacgcatattgaaaccatggatgtctgaggatcatagttcagatattattgaggatattctaggtagtgaacccatcgatcgttgggatcaatttgaagaaaatctcaataaattcggaattcaaggtacttttgatgagaatttgtatacaacaccgctggattacaatgagatatctgaagaggaaaagagaaaagcagagattcttgcaagtgaaatcgagatggaacaaaaaaacgcatctgtaaataacttcgacaatgatgaagaaatgaattttagttctgtgcacagaaacattactgagcaaagtaattcaaataaaggcgttgatagcaagttacaaaatgaatcagtatatgaactcaatcaacctaaagcaaatgatgaacattcagaagctgctgaggagctttcaaataaagattccctatctaagagccgcaaatcaaagttttctttcaatcctaatgcgaaggagtttttgcctagagcaatttccaataactccgaaatatgcgaagatcctttagataagtttgataacattcggactaatgaagtctcaaataattcaaatgaataccaaaatgattaccattattcacaaaaaagtgtacattatgatcattctaatcggcacttacaacatcattatgacaaccaactgagtcaaacccatcgtgatcttagcattgttaattctgtgcagtctaaaggagcgcagtttatagatggtttaaggaacgaagttatcaacgatatgtcggttaatcaaatttcatacgatgaatattactcacttaatactcaccgccccgactatgttgaaagtaaaaggatcgggaatcaatacccagaattttcatgtgatgtatcaaatacacaaactgtttactattatgctcctgaatctgaagatattcaaagctcaggatattatatatcagattataatacagaaaaatggtccaactattcgatgcacaatcaatactacattccaagtaataattcagaggtttacaaccattattgtaattatcaaggtcgaagagcatactattaa

SEQ ID NO: 3161 - DNA, 1251 bp, Cryptosporidium hominis
atgttagtctttctttcaattaaatgcgtgattaaagtattattgttgttgggccaggtattggcatttgatgcagaagggcatagtgcaatcggaatgaccactatatctggccttcaaaataacttttcgcaaaaactcagaaggttgatgaatggaaaagatattgttgatatttctggctggggagaaagggtctcaaaaaaacacccctcaactcttcctttccactttcaaggacagagtaaaggcgattattttaagaatggagaacttggaaacgatttgaaagaaaagtttattttgaagtcagataataattgtaaacatactgggcattgccttgtaccaatgattaagcatttatattaccgattaatcggagataattcaaaatttaaaataaattatcctgaaggcatacaattaactgattcagactcgataaaatttctaattaatttaattggagaccttcatcagcccatgcattttgggtttattgaagatggtcttggaagggaaattaagggaatgatgagtattaatgggacaaatgaacgattatcattatttgaaatttgggagagtggcatagcacgaaaattaaaaactgaaaaacctcaattttggtttggcggatggacacatattttggcaataagagatatatttgacaaggaattactcctctggaaagagagaggtatagaaatgatcgatgactgggctaaagaaaattttgaaatagttactaatgaaatttactttcatccaatatcaaagcaaccaattattgataattttaacgttgacgttacattggaatttgcatggcttgaaatttttcgaagtagaatattaattgcaggcgctagattatcaataattttgaatgatattttaaagctaagagaaggtaaagaaaaaccgtttcgagtaacaaattcattattattatcgagcgatgaagatattagccataatatttctgaccctataattggcattaacgttaacaggaaacagactcttgaaatcaatgtatttggaaaaaagataggtatttcagtttggatcagaaatttgatcataaatctaataataatattaatttgtttagcagttcttgcgtatatatcaattttcagactaagagacaattactccattttaaacaatgctcagttgccagtatccgaagtaaaaacaaaaagtgttcagatgaagcaaacatcagctattgattga

SEQ ID NO: 3162 - DNA, 1731 bp, Cryptosporidium hominis
atgaattcaattatagaaagttcaagtaatgaaatggtaaatgttgctgaatacttgtgtattcgattaagagagttaggatgcgatcacatctttggagtgcctggtgactatgcgctttcatttctaaatgttgtaatggacagcgaaataaaatatattgggacatgtaacgagctcaatgcaggctatgctgccgatgcttatgcaagagttaaaggcattggagcattgtctacaacatttgtagttggagaattaagcgcaattaatgctactgcaggttcgtttgcagaagatgttccagtagttcatatttgttctgcgccaatatcgaagcaccataaaaatggaactttattacatcacacactatttgattattccaagacattaaaaatgttcgagcaagtgacggctttagctgtgaaagttgcagaaagagaaacggctgctgaaatgattgataatgcgttgcttaaatgtgttacattaagtaagccagtatatatatgtttatgcgcagatttagtcaatgaatatattaaaagacctgaaagtccactgaaaaaaccaatctcgagaagcaatatttctgaactagatgcagttatgaagaaaactgttcaattgattaaaaacgcaaagcagcccgtattcatactaggatatgaattattaagagttcatgctacagagtcgatgaatgaattattagaaatatcaaaaattcctttttcggcaatgataatggggaaaacaacaattgatgaacagcatcctcaatatatgggtatatatttaggtgagaagggtaacccacatgtaaaacaatacgttgaagaaagtgattgtttaatagtactcggagaaaaaatgatggacttcaatacaggtttcttttcggaaaaattacctaaacattgtatggtttataatcatttagggaagtcgaaagtaggggaacaggaatttaaagaagtttatgttgaagacattattcaaagaatgataaatttgtacaaaacgggagaacttaaacagtacaacttttctggttctacgccgccttatccacaagcaatgcatctattcactcatagaaaaaataagggtctaggcttggagccagtaagaaatcttagtattgatagaatgttcgacatagtagcatcctccttacctgattcagtgaatgttcttgcagaaacaggtatttctctatttagtggattggagttgatgctaacaaagaattctcaattttttggccaaagtttctttggatctataggatatacagttggggcgactcttgggttatgcatagcaagcaagaaacgagtattttctttcattggagatgggagcctacaagtaactgttcaagatttatcaacaatttttagaaattgcctgaaccccataattgtaattataaataacgacggatacactatagaacgcgtaatttgcgatgatacttataacaatattgcaaattggaaatactctaaattgccaaaaacttttggttttccaaatgtaccatcattcatttgcaaaactgaaggtgaattctataaatctttgaaatttgctcttgaaaaccctgaaaatgcttgtataattgaggttgttttcgaaagatgggattgtaatatcattctcaaagagatggggaaggaaatggcaactaacagccaaattattgagcataagaaaaaataa

SEQ ID NO: 3163 - DNA, 1194 bp, Cryptosporidium hominis
atggaagcaacctatggtgaaagatctactctaagacagagaaaaagagatatagttttaggaaatatagtgaaagccaatgaagctttgcaaacaaaagttaagaaaatagatatatatggaaaaatacatgaagattattgtgttaagtcaacaagtaggagcattatttctctgcttgtatatattattgtgttttttctaacattgaatgaaattttcaagtattttaagggtgaaatgatagataatataggagtggataatacaattaataacaaattagacattatgctagatattacctttccaagattgagatgtgaagaaatttccgtcgatagtgtggattatgttggtgaaaatcaagtagattcgaaagaatatatggccaaaattccgattgatttgaatggacaagaagtgcgtaatattaaatataaccaacaaaatgatttaaagattgaatgcatgagctgttatggggcagaaactaatgaatttttatgttgtaatgattgtgattctctaaaaactgcatatcgatccaaaggatggtcgtatttagatattgtaagtaaggcgccccaatgtattgagaaagtaggatgcagaatcaacggaagaatgcaggtaaacaaggtttcaggaaatattcatgtcgcactaggaactgcaactataaaaaatggaaagcatgttcatgaattcaatatgaatgatgtttctagagggtttaacacaagccatataattcatgaattaagatttggctcagatagaataccttttttattttccccattagaaaatattcaaaaattcgtacacaaaggtacaaagatgtttcactactatgtaaaactaataccaactcaatatttttcaggtaacggtgaagttaatctctatgggaatcagtatgcatttacagaaagagaaagagatgttcacgtgcaaaatggtgagttgtcagggcttcctggagtttttattgtttacgattttcaaccatttttattgcaaaagatttacaagagggttccaatatctcacttaattacatctttttgtgccattgttggagggatttattcaataatgtcgttgctagacacatttgttgcatggcttttcaaaaataatataaataggtacataaattacatttataaaatgaattattcgaaataa

SEQ ID NO: 3164 - DNA, 564 bp, Cryptosporidium hominis
atgaatgagttagatcaagaatatgttcaggaaaagatcaatgaatttttggatgatgaacgcctgatcaaaagtattaagacttatttaagaattcatgttacaaaggctttaagaaaaaaaagtaatataaaatttaatttgcttcaagatgaaaaacttgtgattttatttaaacttattcatgaatttttaaatttttatgaaataaataatacttgcaggatgttagaagaggaatgtgctgacatttttcaagtgaatatagaaggatttgatgataggctaggcgaattaggagctttaaatggtggctcagaatgcaacacgaaaattgaaactctacttgaaaataaatcgttttgtagagaaaaatgtgaaattgacgaagttacaaatacagtgttaattgaggcaagtaattgtattgagtctttacaagatgaaattaaaacgttacacaatgcttactttgagcaagtaaatacagctagagaaatcatggaaaagaaagtatcaaatatagagaaattatatttagaatccctacttagaaatgattaa

SEQ ID NO: 3165 - DNA, 1914 bp, Cryptosporidium hominis
atgctagtagctgtcgttggagttcttggatctttaactttaagtttttttttgtggaaatgcatggatgaaatagcttcagatgatataagtacatttactataataccttgttacttgggtgctctaataagtatctctcctataataattttaccttttgatatcgcaggttcattattgggctatgaaaacaataattatttttctattgtaaaatttttttggaaattagcatatcttgtattatttatcttatgttgggtaatttttcctattctcctggaatacgagttatcaggcgattttgatcacaaaaaaaaattaaggacaagccttgaaaggaataaaaatcgctggataactcaaatcataataatcgcaataacatcaatattataccttacagtttttaatttacatgattccaagttttcaatttcgtcaatgtgtattgctgttgctcatttttgggggatggctcaaataacatttttatggggatttggactagttgctatcccattgaaaataaaaaattcccgtaaattggtaagtaaaaatgatattattaaaactttaaatagatattatacgattttacacaacttagaagactggaaggcgataaatcaccatgaaataaagaaattaaatgataaattgaattacttatacagtatttctaatgaggaacgcaaaaagaccataattgggaaaatgattaaaacaattaatgaaagtaaaactgtattgatcaaaaacaactatttaggagaagcacaccattcgaataatatagattttaagaacttatctgaaaaaagcatcttaatgattgaagatttgataactcttaatcgtgaattaaaattattagttactgaacaaaaacgtatatattacctatgggaatcaacattattaaattcttggaaactagaaaatttgattgttgatattgagccgcatctatattctaaaaacgagaacagcccattaatattctcatccagagcaactacaccagtgcatacctccaataatagcctgaagaatgatgacagtgtatcagtaagaagtaatcatttggttatgaataatgaaacaatcgatggagtatttcttccaaataataatttcagaataaaaaatgcagaattgattaaaaatataggatatttattagagaaattatttaagattaataacgaatacttaaaccaattcctttatatattttcattagttactagtattggaataatttttgcagaagctactatgtatttcccaaatttgaacatttccctatattcacatataataagaacatgtttgaggataaaatatatgaaaaattacatcaagtttattttagtttattttatttgccagtttttactcatttatgtttatgtatgcacatactggggattattttatttcaaaatcccaaagaaatatgggatttatttaaataaacacacagatgggccatgtatcgtttttttctcacagtttttatgcaagctttcaactgctttatgtttccactatctctcaatacttaaaattgaagaaacagaatttggaaaattttatggaaaacaaattcagcatcttctagatatttttgggaaagattttaatatattttttttccctattattgttgtactagtttatgctattaatatttttgatttgcagggaaagttaattaggaacagtggaatttactatgtattctttgaatactacatttttgatgattacgtaataggatctaatttagaaaatgaatcaagcgagaacgaaaagatttccaatggaaagagaatatctgaagtccaaaaaatgaagaaaacgatggaattgaactactgtggaggaaaaatggttcaatcatga

SEQ ID NO: 3166 - DNA, 1155 bp, Cryptosporidium hominis
atgaatgaagaatttaaaaatatcgattcatggagggggtccgtggctggaacaactctgagaataaatggccggaaaaggaatgaaaatactacctctttttttagaacggaaatttttaatttacttattgttcaaataactatgatttcaataatgtgcatattcatattcattggcgtttccttgcatgtagttaaacttaaaaaaatacatgcagatgaatatatatcacatttcaacttagacaatgatacgagcaatattttaaccgaaaatttgagatcaatagaaaaatctatgggtcaaatgtcattttttaaagtattgagaaataatttggatctatcattcccaataaaaaataacaaagatggtaatattattttttgtggtggcactcataaacgtggtacaaattggtctgaggaagtaatcaatattacaaaaagaaccattgaaattgcgctaggtaacaaagtgttaatcgaattcaaaagaggtttagtatttgcaataaacacagtcgatattgaaagtagtaacattggtgttaaccaagatcatcttaatcaactaaataatagctcaatgttatttaaattatttctagcatctagtggatatgtatctccttgttacatgtttggaaagagattatattcttatattttggggaaaaattctggatttttggggtattttatggttatgataccctggtttttttcaatactgtctcctcaaccaatgttgttggtacattttccaagacttttaatttactttttgatcgcaatgcatagagttatatttcttcacattatcattaatattgcagagaaaaaattattctcttttgacttttcggatcatattgtattgtatgcaatgtatatattaattatatctattgaatggtgtgctatttgctataatatcaaaaacaaattcattgtttcttgtataagagggtattgcctgtctctactagcgataatttcatatagcagtttttttactgcattatattttcatttccctcttgaaacgctcgctggatttattattgcattttttggtctttttggaattttttggatgcttatttttttagagtatattgacttgactaaaatagggcttcataagtag

SEQ ID NO: 3167 - DNA, 546 bp, Cryptosporidium hominis
atggactctaacagcataaatattataaagaaggttttagaggagagcgaaaacatcattgacgaagaaattagagcttttgataacattcaaaatgatgagaatgaacttaaccgtttaagagaaaaaagaattgaagaattgaggcaagagttcaaacaaaaaaacaaatttatacaatttggccatggaaaatatgatttcatctccgatgaaagagagttcttcgatgtaataaaaaaaagcgaaaacgtagtttgccacttcttcaggccatcaactctaagatgtgaaattttcgatcgtcatctagagattatttctaaaaaacatctagaggcaaagtttattaagattaatgcggaaaaatcgcactttgtttgtagcaacttaaatattaatattttaccaactattgcattgattaaaaattcgaaactcatacacaaaattattggatttgaggaactttcatcgagagataactttacaacaactcaacttgaggagttgttggttagaaggaatataatacaagaacaataa

SEQ ID NO: 3168 - DNA, 1614 bp, Cryptosporidium hominis
atgaatgttgcaatggatgaatatgggaacccttttatcatattgagagagcaagagcaaaaacagcgtttaaaggggatcgatgcgcataaatcaaatattttagcagccaagtctgttgctgatatattaagaactagtttgggaccgaaaggaatggacaagatagtcgtaagtcctgatggtgaaattgttgttacaaatgatggtgcgacaatcatggagaaaatgaatattaataacgagtgcggaaaactgctggtggagttgtctaagtcacaagatgcagagataggtgatggaacaacaggagttgtaatattggctggtgctttgctagagcgatcagttgaattacttgaaaaaggaattcacccaatcagaatagcgaacggttttgagtatgcatgctcaatagcattaaagaaactcgaagaaatatctctaaagaatgggacagtttccgacattcaaaaagatcttctatttaactctgcaatgacagcattagggtctaaagttgtcagtagccagcaggagcattttgcaaaaatggctgttgatgccgtattagctgttgcagacttggatagaagagatgtgaactttgatctaattaatattcagggaaaacctggtggtagattagaagaaagttgtatagttaatggaattgtcctggataaagagatgagccatcctcaaatgaacaagaaaatcgaaaatgcaaagattgctcttctaacttgtccatttgagcctcctaaaccaaaaactaaacataaaattgatataaagagctcatctgactttgatgttttatttgaaactgagcagaagtacttttcagaaatgatagacaaagtagtttcatcaggtgctaatatggttgtttgtcaatggggatttgatgatgaggcgaaccatatgctttctcagcgtgggctcccatcgattagatgggttggtggagttgaaattgaattacttgccattgcgacaggcgctcatatagtaccgagatttgaggatctagcagaaaataagctcgggagcaccgcgttagttaaggaagtgacatcaggaacagaaaaggataaactaatatttattgaaggatgtagcaaatctaaagcggttacagtgttaattagaggaggaaatcaaatggtcgtggatgaagcaaaacgttgtatttatgatgcactatgtgttgtaagaaatctaataagggatagtagggtggttccgggtgggggcgcttctgagatagcatcaaacattgcggtgcaaaaagctgtagaatctgtttcatccattgagcagtttgcagttgaggcgtttgccgatgctttactttcactaccccatgcactagcagataattgcggtttagactctatttcattagttggtgaagcaaagcaaaagcaagtttcgcaagatgaccctaattatggaatagattgtgataaactatgcgtagaaagcatggaaaaaataaaggtatttgaatctctggcgtcgaaacagcatcagcttgccttagcaacgcaagctgttaagatgatactaaagatcgacgatgtaatcaaaccaactgagcttttttaa

SEQ ID NO: 3169 - DNA, 936 bp, Cryptosporidium hominis
atggaaagtttaagggataacttctctacaaatatcggccctagttgttttgcatccaacgcctctctgttccagagaagaaattcttcggagcttgtgcgcaggcagctatataaaacaaagatgtgtgcattttataatgtaggtaaatgcacaagggggaacctatgtgcatttgctcattctgttcaagaactaaggcctctcccggaccttaggtttacacgtctttgcgaactgactaagcgaggtgatatctgccgcgatgtaaactgtacatttgctcatagcataaatgatttaagaactactgaaattcctccaacccctctatcagaatttaatattatgagatctaatgaaaatacggctttaattagaaagctaggttcaacgagtgaatccaagacgaagttcagaactggagaatcaattaaagacccttttttgagcaaaagtgaaggggaagatatttttgtctcaagtacagatacaactcctcaaagtctcaggccacaattgagaaatacagaatacgaaattccgtgtcaatggcgcaagatagataatatcatttcaaaaaatgttggcagcattcgtagcggaatattttcttgtttgaacgaaactgaagcttctcaaatagataattgggtttacaacgaagaatttgcaagtagattttctcctgatatttcgactcattctgaagcttcatgtaaatttgtaaataacagcgactttcaagagcctccaaactatttttcttcgaagtgtttgttagcaaggggaataccagactgggattttattagtaacgacgataagatatcaacgcttcaatgcgatattttgaatattatcggaggtgatggcaaccaccatacagaagatatttgttcaattgaaaagggggcgcttcatatgattaattaa

SEQ ID NO: 3170 - DNA, 981 bp, Cryptosporidium hominis
atgaatgggtttgcgaagtgcatggatagtattataaactgttttgaatgctttgcgaagtttcttggccatttcttaatagctttcgtgttttttgcaatatcattcctgtatacaagtgggacattttttattttccctttcatgattaaaaactcagttattctcatactgacaagattggcattacttttttttactgtaaaccttgtttacaattacattttatgccttattacttgcccggggttttcaaagcctatcagcaaacaggaagagtcaaggaatgaagtatctcaacacgatattgaagcaggcgaacttttatttctcgaaagcagaaatattttcaatgatcgtaatcctcaaattgaggatagttttttgccagaggaatatttcaaaggcgatgataaaaataacttatttattgatcaaggcaaaaattacatgaccaattgttcaaaatgtaatgcgataaagcatccaagaactcatcattgttcaatttgtaataaatgcattttaaatatggatcatcactgtccatggataggacagtgcgtcggactttataaccgcaaatattttattttatttttggcttggtcatttttaagctgtcttttaatctcaatattttcaatcccaatgattattatattgctttcatctttatctggaattaattattacagtgatgcatcactctatgataacgttactttccaaggactgcttctttcatcagtgctttccgtttctttttctttaggtactggtacattgcttttttttcatatttatctattagtaacgaaccaatcaactattgaataccatcagaacttgtttttcagaaaaagccttaatggaggtgaagctctgataaatcgattcgataaaggattatccaataatattagagaaatcatgggcacaagcaaatttcctctattattattcccttgtttttattaa

SEQ ID NO: 3171 - DNA, 957 bp, Cryptosporidium hominis
atgtttcaattaagatctggacctcccactagcagaggggcttcagaatttggcaccccaaatgcattttcacacaggaataatcaagttccgcaatatacacagagggctaatccattaatgtgctgtagccctcctcagattaatagtatgcctataaatcaggctcctcccagcaggatgataagtgcggctggcttaaatgtgcagtctgtgaatgctccttcgagactagtaacaggtgcaagcatcacacctgctgcagtcgttgctgcgcctgaaaggcaagttactgagccgttgcaacataaacaaacctttatttacggaggatcagaaaccatggaaccagaagactgtggttggttggagccaattagattgaaggttcatgcaatggaagttcaacagtatatcaatcctagtaatccggaggctacaccaccgtttatttataatgttgaccatttaatggaatgcgtagagataccagaaaattgggctccagagtcagtcacaggagttgctgccttaacatttgagaatctaaatacaaatcctccggtaatacagcatcctttgaggcttgagtctgacggatcgaaaaatggaacaaataatccatacatacaacccataagataccatgtagaaagaatcaaagataaagatagcccagagaagttagaaaaaataatcgaatcagaccaagacgttacttcgccttcaggaagtaaaaaagataacgagactatcacttctaattcaaatttcttttctgcaattcttagcaaaattaaaaatggggtgaagttaacctcagataaacaagctataagtgaaagtaaagaagaaagttttgaaaacaatgagttggaagccgaaactgtagaagatgaagttccaactatgaaacaagattccgctcctgaacataatcagttcttggaccaatag

SEQ ID NO: 3172 - DNA, 834 bp, Cryptosporidium hominis
atgggctggaagtatacaaggggttttaatgaaattgaagaccttttaaagcgtgttaaacaaattgaactcctatgcgaatctgatgtaaaaattgatgaggtttcaagcattgaacaagaatatataaaacacaagattaaattgtttgaattatataatacaacttgcacaattttagatcatcttgaaaacgacgagaatcacccaaagttgttgacaaaaattaaattggaggatttaattagtcaaatgaaaatagaaattcgggaattaaggaaaatttgcaataaacattcttccagtttgcgcattaatcagctgaataaagatgataataagtacattgacattaagaattatgaaaaggagtttattgaaataaccgaattgagatttaataaattatttaccgatccattttcaaaaattacacattcaacaactttaaatgatttcttgcttaaacctggttcagcaaacaaagttgaacatagggaaattggtgattcagataaaactaaaattaatgaatggagtttggaaaatagaagaatagatgaagatataaaagaagtaggaaatatggcgttaagaatcgcagataaagcagtacagcttggccgcgaggctaaagcacacaacataagtattgaagaaattaagaatactacagaatttgctacagccgacatctttaacctgaacagaagggtacaggaagttatcggtacaaataataacactaccttctgttgtagaataacattggtcacgctagtttttgtctcagtttctcttatcattgtgttgatatttaaaaaactaatttaa

SEQ ID NO: 3173 - DNA, 711 bp, Cryptosporidium hominis
atgatcaatttggataacactccattatttcgcaatccgatgacatcacacagagtttatgaaatatcgatactgttgctgatagggaagaaagtcaaagaaaagaattttgtatcagcaattgaggttcatcctaatttacccaagctcgaggcaaaagagagtgaaggaaagaatttgaattcaagctctaaatacatacagtcaaaaaattctcttttcactttggatagcaaaaactttgacatctataatgaagttgatccaccaccaaacaagggatttttttcattttctgatttgacatctcttcttgagaaacttccatccactgaattaataaagtatggcaattataagagcgattttgtacgtcagaatactgaactaaaggcatctgaggagcccttgacgtcaagaatgatttctcggttaaagcagatagcaattgggaaaagtctacctgagtacaagaattatataaatcaagttcctttagagaaaagatcatctgaagatcccagaactccgaaatgtgatacaaggctgacaaaaagagaatttgacaatctttatagagaatggcgtgtaaaactacatcaatatgaaagtaaattttcttctggcgcttcaactagagtgaataccccagaagatgatcttaatcatcatagtagatattgccctgatattaaaacgttaaaaatataa

SEQ ID NO: 3174 - DNA, 792 bp, Cryptosporidium hominis
atggccacaattgaaatggattctgtcgaaggatttcagctgaagcatggttcattgattggcggtgcaaggaaaggctgtttatgtttatctctaagacttgcagtttttttacatgggctgctgaatattatattgttatttttgacaatatccgtgttattctcaattcctattggtttgttaggttctaatcaagaggaagttttgccttcaggaagttctcactttgaagttctgaatagatttggcttaaatgctgtcaatcttatgaataaatatctaccacgtgatttattactcataattactgaaataatacgtttcataagaggttcaacaatagaagggaagttcgtagcatttacattggatatatctatattatcatctttagtttctattttcggagtttttagtaaatcaatgggattgatcaagttttctatctttgcatttttaatttctcagctacttactatatttggaatattttatgctcccactttaggcaaattgtacaatctgaaggttttgtcaaatccagttctattgctttcgatattgatcttagttatgttttacacaatgtggtattcacacctgctatattcgtactacaaggtattaagagctggtggaagtggtggcgagtatttatcttacagagaaattattgatcgcagaaatttcttgcgatggaagacttggaaagaaagagaacttgagagaggatctccatacaacccttctttttcgagaagttcggagaaggatagattgctcaagtaa

SEQ ID NO: 3175 - DNA, 792 bp, Cryptosporidium hominis
atggggtacaaacacatttcatcagatgactgtgaaaatagcattgaagttgattgtaacatagttaaaaatatgcaagcaccttgtcaagaagttgagaaccatttttcatccattcctgtaacctcccttaatttagaagaaaaacatgaggagggtagggccttaaaaaaaataaaagcaaaagaaaagacttatacgataaaaacggtcattgacaaacatattgggacagactgggcaaattcaagaattatgactaacttaatcccatctaaagattgtatagagtctcaaattgcaatcattatgagtagctgcaacttgaatgtaattacattaaggaagctatatgctattctttcaatatgtttcaatatcaacttgctaaacatcgatattcaaaatgtctatcaaattattagagaaaacttattgaaacaaaggaaaaccgataaacaagaaataaaaaagaccaaaagagttcgcgacaagaaaaaaaatcaaataaaaggtttaataaagttcatgggtgaagatattgtctcaataaaatcgtgtacattgagaattaaacaatattgcgaagaaaacaaattagttcacccatcaaatgcgaaaatatttacgcttgatcaaaatctaaaggacatatttccaggaagagactcaattagtaaaaatgttaacgatattcaaaacttgcttaggatttcaaatatagaaatagagaaagaatgctcaaatcttcacgagcagatgattaacgaaaacgatgctttaaaactttaa

SEQ ID NO: 3176 - DNA, 3384 bp, Cryptosporidium hominis
atggacgccttgtgtaaactttatgaaggtttttcatcgcctgacggctctataagacaggaatcagagacacagtttaacaacttgaagcaatctgacccgaatacatttcttcaattaactcttgggattttacagcaacaaccgaattcgcaatatcgagtgcaagcagctatatcgttaagaaatgtttttagggagtttgttcttactccagataattgtatatggaataaggtttctgctgaaaaccaagccatttgccttgcaactttattgaaatgtcttgaaactgagcaagtgaatgtagtttccttaaatttaagtgatactgtgtctcttattgcaatggagttgtttccatgtgggaaatggccagatttactaccatttttattcaggttaatatctaatttacagaattatacaggggcaactagtgctcctgaatcagtttcgattcctgcgcgacatgcatttagaattattggagaaataatgccagttttagatgatgtagtcacttctcatagagataatatagtctctacaattaatacagcactgcaatttccagacgtggaaataagattcgaagctattggacttatttcttcaattgttgagtctaacgataaaaagaattggtcaccattagtcccacttataccatccattttagaaactcttcaaaacttaatatctgctcagcacgctttggttattgatgtcctgtatcgtttaactacaatatctgaatcagaaccagcattttatcgtcagcatttctctattttcttcccacaaattttaaatattgcaaagaacatacagttatcaactgatataagacaagctgcaatggaatgtttactttgcattgttgaaactcgtccaatgatgtgcgtgaaacatccttcttttgttaatgatatggtttcaactttactaagttttatgttagaatttgatgatgatccaaattggtctgaaattagtccagaacaagaagagaatgatttggagtcagatatcgatgatgatgattgtttatatcctattggagaagaaggtttagacagacttgcaagagctcttgatgcagattcatttattcccgtattctaccaatttgtaacaatttatatgcaggagacatctgcccatccatggaaatatagatatgcagctataatggcaattgcgcagaccattgaatatcttccagaggatgatgacaattaccaagatagaattggacaaattatttccagagtattgggatttttacaagatcaattccctcgtgtcaggtatgcttgctgtcaaacaataggacaaatatcattagaccattctccttttattcaggaggcattccactcttctgtaattccacaattgatacaggcaatagacgatccaatcagtaaggtttcatcacacgcgttatccgcattaatcaatttcaccgaagaggttgttgctgaggacctacaaccctatgtacgaccccttatggagaagctgttaggaatattacataagcatccccaaccccctagaattgtaagagagcaatgtatcacgatggtggcagttattgccggagtaattgaaaatgactttactccttattactctacagttattccatatctcaaaaaaactatgaatgaggcctctccccaacttagaaccctcaagggaaaatgcattgaatgcatcacgatcattggattttcaatagattattccatcttcaagaatgatgctcaggaaataatgttggtatttctacaattacttggtagtggtctaaaaggggatgatccactaaaagaatatttacaagaagctttacagagaatgtgccgtataatgaaacaagatttcgttccatatttgcctcatctattaccaggaatttttaatatattggaaacgcgagaagatagtctggcaactaaattgttaaattccaacgattcatcttcagatgaagttgataagagcgacggcggttcattgggaatgctttcagcacatgacttcatcggaatgagaacctcattggtattagatatggaatcctcattggacattcttaatacttttattgaagtgcttggctcaagttatcacgaatatattgcaggcacaataaaagtaattcatccacttataagattctcattatctgatgaaattaaagaaaaaacatacgaggttttaagtggtttattaaagataatgcgagaattagcggaaagagactctaatattagaacacaattttcacagataatgaatgaactcattactctattcttgtctgtaatggatgaggaatgtagaactggtactattgatagccaagtaattgttattaacggggtacaagaatgtttagattcatttggcaacaatatattgaataatgaccaagtagcaataattgcatctagatgctttgatatgcttcaacaaagttttgttagaaggagaaaacttgatgaaagatcagtaggggaaaatggcgagatacaagcaaaattggacgttgatgatgatgatgacaaacgttgtattgaagaggaaaaagaacaagagcaagaacttaggctaaatattttgggaattctcggtgttttgatgaaatactacccaaatgtatattgggaaagagtgggaaatattactatccagttggtttcccaacatatagttaaagttcataacaatgtagaagatagggtactaggtttccacctttcggcagatgttttccaatatttatgcccaacggcctaccaacattgtctaccatggatacaacatattttggaaggtattaacgacccaattgcaagtattcaacagaattgtgcatattctctagcacaagctgcaaaactagaacaattttctggagtattaaatgatgcactacaagtattgttgctaagattgcagagtaaaaccaaagggaaatcatttaaccttgcaaaggacaattgtataagcgtcttaagcaatattattgttcatcaccaaggatctattaacaatgttaatgaaatagtgaatctttggatttcgttattacctataaaatatgatacagatgaagcacagaactctcatacagcattgatgaatttagtagactcaaagaatccactcattttgggtcagaacttagaaaattttcccagaattttggcaatattcattgatatatatggtacctcaatgtctaatgattcactaaattcgagaattaaactattaattgctcaaactggccctaataatcttcaaagttttgcagcaaatttttcaaagaagcagattgataagcttcaaaagctttgccaataa

SEQ ID NO: 3177 - DNA, 573 bp, Cryptosporidium hominis
atgaagatagaatttaatcagacttcatatgagaagattctttcacactcaatgaaatatccacaaagttttattgatggtgtattaataggttattctagtgggcaaacaaatttgattattactgattcatttccgctttcgcatgggccaaagctcccacttatggttactcttggtatacaatatgcccaaggatattgcgatatactaaatcgtctagataaatctcctaaacttgagattattgggttctattcggggcttcctgatgaaaagtgtcttaattccggaggatcgaagacatatctcgaccttatttcagagaagctattggcaaataacaaaaattctatacttgttacattttctggacaaaaaatgctattcaaagagagcatgaatgtgtatttacttagaaataaacaactactattacacacgttcatcgaagatcctttaaggcctgaaacaaaaagactaaaagacttagattactacaacctaagcgatttcgaagatcatttatgtaatatacaacctaaacttgtaaataatctattgctaatttaa

SEQ ID NO: 3178 - DNA, 1866 bp, Cryptosporidium hominis
atgcaaaactcagatataagcggaactacttccgccagagcggaagaaacccagaatagttggttttctgggattctagggacagttataagagtgatattttttcaaattgtaatgaattattttatgggtgggcataagaatgcagcgattaataaaaccactggagaattaataaaaccacttggtaattattacaagccaggaagtatttacgatttatatgctcacataatctttggaaatgaagaatttgtttcaaatttgaagttcgaagaccttaataaatcatctattttattggaagcagctgacattattaatattacatctgtaattgaagtttggagaattagaaaccttaaatacgacaattctgatgttaatttttccaaggatatatcctttaatcttccaatggagcttttcaggtataacattgaagacatatcaaatacttacaacgatataaatgcttttcttgttgtttcattaattggcaaggaaaaaaatgattttgttcctataaattatgttgatcttactaaaacaatgaataaactaagcgatgaagactctttaataagtttattggattctaatgatcaaaaaggctctgtggaccagcatgataaaaaagtaaaatattggaaagataatattaatattcgtgtaatatatgataaccagaattataatattggtcaaagcaacgtgccacctctatctttcatgaaatataatgttgcagaaggtatttacttacccataatctatccgtcagacttctggtgtattgaacgcaactttaaaatgttaaattccacaactattaaccaacctttcaacttgactctcacattcaatacattttcactatttaaatacaccattcagagacagatgatggatacttgggagcttcaaagcagatacggtctaggacagagtcaaaaagacattatgatgattaagagaatactagtagaaactaacaaatactatttaatttttagcctggccttctttattttacattcttccttccagatgctcgcatttaagaatgacatcagcttttggaataaaaacgaatcaatgtatggtttaagtggcctttcgatacttgcatcatttatttctgagttaattattggtctttatttatttgactcgaatgaaacgagctggatattgcttattgaaatttttatcggtatagcaatttctgcttggaaactatggaaaacaaagatatttatattgagtagaagatttccttttttttcaatcaaagatgattctgatgctcatttagattctactgatgaaggtactaagctaaaactggagcaagaaaagctctcgaggtattatgattcaatcgcaattaaatatatgtcagttttacttgcgccttgcatcgttggatatgcaatatactcattaaaatactataaatataagggctggtattctttcattatttccacgctagcaggtacagtatatacctttggttttattatgatgactccacaactttatattaattataaattaaaatccgtggatcatttaccttggagatttctggtatataaagcgttgaatacctttattgatgatattttttcatttattatagatatgccatggatgcatagaatggcatgtttcagggacgacataatatttattatttatatttatcagaggtggatatatcgttcaaaaaaaggatatcaaagtggcattgaaagaacgaacgcaagtgttattgaaggcgatgaaaaagggaatgatcattcttctcttcccataaataaacctaacgatcctaataaaaagagcaaaatagaatag

SEQ ID NO: 3179 - DNA, 837 bp, Cryptosporidium hominis
atgcagaaaaaaccgatattccataactttgcgtttatacttgacgtaataaacttcgcgactgcatcatcatggttttgtgcgtatttggcgttgttccttaaattgaaacgcgaaaaaaacgtagttgggctttcacttcaaacaatactaatgttagttgtggctgaatgcaaccacgtacttataacagctgttctctcatcgcattatcatgttgaacttggtttagatttttacttatgcgattgctcgactgcacttttgtccgctgtcacattcgcctacatttattttaacttctacgaaacatacgaaagtaacagagacacatttgggttgaatgttacaaatttcgtaatttgttggatttcaagagctggtggaagtaattattttattcaaaaaaagagcaacaggtattacccaacttctcagaaaatcttttggttgactatctacatcttaaacttctttcttggatcaataatattttttttaagaaaatccagctcacctccaattatatcattctgggaatcatatatggattcactactttccttagctttactaccacaaatatttatgttttacaacaagaaaccgcgaaaagtctcttctcttctagcccattttgttgcattcatactgctagcaagagtatttatgctgttctattggatattatatccgttatttaaattatcaattgttccaggaagaagacttcatattttctcggaatctttaaacgtaacattcctaatgcacttcatgtatcattttataagatcgaagctgaatggagaaaatgatatattcttaccattatag

SEQ ID NO: 3180 - DNA, 294 bp, Cryptosporidium hominis
atgtcaataaaagtggaattttccggtggattggaggttctggcaggtgacagacaaaatgttgaggttaatttgaataacctaaaatctagttctatgaagaacctaattctttatgtagaagaaaatattattcagtatagaaaagatcattttattgagacagggtcaaagatcaaaccaggaattattgtactagttaacaactgcgactgggaaattttaggtggagaaaattacgttttaagcgatggagatcttgttacttttattatgacattgcatggtggttaa

SEQ ID NO: 3181 - DNA, 2622 bp, Cryptosporidium hominis
atgataaacaataatataataaaaagagaagttgtaaacgagcgcaagcaggattgtgaacatggttcagatattataaataataaagataatatgtttaacattacagccaatacagaaccatatgatgtgttagaaaatgacataatgaaaaacaaatctagaaaggtaaataattcttcaaaaaacggtttcgagagtacaaatatttctaataaaatattgtccgaatttacttgtcccgtatgtctcgactattatatgttgcctgtcacaattccatgtgggcatactttttgtagatattgcattactcataaccgtttgttgggaaaaaaatgtccagtttgtaggcaactaataggatacaactttagaataaacatgacgatccataacgtcgttgtttcattgggaattttcaaacaaatagagaactcttctcaggatgagagactttataacgaaattctacttacaaacaacgaattaataggtcagaatcgtccaaaatggtggcaactatgcttctgcaaaccaataatatcagttacattatttgcaagaataatttctgatgaaatactaggaattgggatagtttttgcagaagacttaactcgatgtattattgaccatctatcgaagttgtcatcaataatacaagataaaaaattaaaaagtatgatatggtcgaatggtatatacatgattgggccattagaagttaatttattaacaaagtggatgggttgtccgcctctaccttttaaacttgatgacaaagaaaccgataatttggaaaaaaattctgattttactcttaataataatgcaatatttaaaaatcaagttaaaaaatgggtggaagaatgcatcgctttaaaacctacaattttaaatattggccaaaccccctttactaaaacaagtacataccctatattacgtatactaagcgatagaatacatcgtgtggaatcaaaaatatatgacttaggagctcttaggtctcctcttccttgggatcttggaaggcattctaaatctactatccaagtttctcactcgtctgtaagtacaaatcacttattaatagtaaacattaaagagcacgaccaagttgctcaagaattgaaatacaaaagtaacacttcacataaatttgatgaaaactccccaatcgaaaaagattggggtattggggtaatagacttaggaagcagtattggaacaatgctaaaaattcaacccaagcaccgacttgcaacagatgaagtaattcacttggcggatagagttgaaataattgttaaaattcgaaaaatagaagaaataacaaacgaagataatttaaatggcgatagcagaatattaattaatgaatggaaaaaattacgttggagtaataaattaaatttagttataaacattgatgagtataacaaaggtgaacataaaaccattaatagagctaaaactagtgattttgaagacttgcttgggatctgcaatgacaaagatagattagattcaagtgaactctcgcaagaaagcaaaattgtccaagttcctcttgaggaattggaaatcgaagaaattaaagagtgcttagaagtctatattccaattgggtcaaaatcttttgttccatgtgagggagcaaaaaaaacagaaaatggcatgtactggtcggtaattgttcatccttctgggatggtatttggccgaggaaaaaatggagctcttggtttgagaaaagtagaggttacagaaagtaatggatatattagcagagaacactgcattttttactattcatccataagaaatagggaatatgaaggccttgactatttgagtagatctaatggatgcttatcaaattggtatattaaagatgtatcaacatctggtacatttttgcgtttaaaaccatttagctatccagttagagtattgcccggtatggttcttaaagtaggacaatgtaagatggaaatattgccatatatgattggtgctttgtattccggacaaacaaatagtagtgttagaagcagttccatcaatctagtgtctcaagactttcaaccaattcaaacaaacttaactgaagttgaatcatcacaaactcatgtttcaaacacgaatcaaattccaattccttatttaagcaacagtgccttatttactcaaacacttaacgatcaatatttatctaatataaataacaatgtgattgtacaattaaatattttagctgcatataattacattaacagctcatctataacgaatttggttaatcctaataacatcgtcgaatttaataatcaaacttatgaagatagaataattcaaagacaaaattcatcttttgataatattattttgcagagtatattaagacattcaatagtaaataacaatatattgtctgccgggcactacttaggaaatattcaaactagtgaagataattctattactggtgggtcaatcggctctctggaggtaaatagcatattaaattatgatagaaggccaagggaaccaagagttacacaagaggtggatgtttcgttccaaatagaaagttttgaaaacgaagattgttaa

SEQ ID NO: 3182 - DNA, 1152 bp, Cryptosporidium hominis
atgccacatccagacactgttaaagggaaaatacctagtgttttccatgatattaccacaaaaaactcatttattcccgatataaccattaattcatatgaaatccatgtggatggatcatttcaagatataatcaaagagaagctaaggagagaaaaatctggaaaaacaatatataataaaatacaaatatctattatcaatcggttttggaaactatcaaaagaaagaaagctactacactatatacgcaataaatgcctaatttctttgaattgtgctgatcccaatcatgagcaactatttcaagattattgggcgttagcatatccagattatccagaaataaatcggatttcgagtaactggaggctgctagggttccaaaatgatgatccaagattcgattttaaatgtgcagaattattaactttagaaaatttggtctattttgcagaaaattataggaatatatttaaagtgattcttaaagaatcccaaaggttttcttcgggtgaaaaaattaaatactcacaccagcatagcattcaaagatatattatcaattcccataaaactaatggcatgatgagtccatttgaaaccccacacaactttcagccttcatctagtaatttaagtattatcaccactccaataaatatgaaagattcaaaaaaagaatttggtagtaacttcgagccgttattaccaaaagttacagagttaaggtcaactattagcgaaataagcaatagttcgcaaattgatcaaatgaatttttcatatccgctttctacagcactaatcaacgtttcaattatgatatgcctttatcttaattttattccaagtatatataagattcctggagttccaaatgtctcagcaagcaggaaagcaatgaaaaattttatgagactaaccaatgaattttctttcaatacaatttctgagcttttcagtgtttgtgcaatacgatttcatgcagagtggctggatattgtaaaattcttaggacataaagttgcaatttcagaattcgataaagttcttaaaaatgttcaagtagtaatggcagagactattgaaaaccttccaaaagatataattgagtttagacaaatttgtaatttagaaaaatactattag

SEQ ID NO: 3183 - DNA, 546 bp, Cryptosporidium hominis
atggagagcaaatacggaaacaaaattatggaagatagagactgtttatcgtcaaaaaatgcagcccatggtttatcaatgtctaactgtataaaaccactaccaaaagatattgcaaggcttgcgctttatatcgtttgcatttctgactttagctctattattcaagcttcgtatgacattgcatcgtcggttacagttagtacaatattcgtcattttttcgatcatatgttcgtcgttcgggcttcttggtttttattcgattacaaagaataacaattctactatgaaatattacgtggtctatactattttaagattaatactagagtcgattacatcttttggaatgtcaataatattttacatttattttaaatctacaatgtacgacgaaaacttacccgtctgggccatttttttaataaatgcaacatgcttaactttatctagaattgtattttcatatgttgcattctccttctatcaaagactagagactcagaaccaagaaaattttgaaaaggttacagataaagtttag

SEQ ID NO: 3184 - DNA, 1926 bp, Cryptosporidium hominis
atggcatcggctacggattcatcgttgagcaatacgagcaagcggaggaaagttatgaagaaaacagagatggattatgagcctctcaataagtggtgggaaagacctccgaaggaagagcttggaattcaatgggaatatcttgaacaccaaggcgtgatgtttgctccaccatataaagttcataatgtaccattagaatataacggtgaacggattcaacttcctccagaagcggaagaaatcgcgagttattggtcagtcatgaaagatacggagtgggctcaaaaagagaaattcagtaataatgtaaggaaggcatttatgaactccataccggttggtgacaaactacataataatctggaatgggaaaaatgtaattttgatattataaaacaatattttgaggatgagaaagaagctaaaaaaaatttatcaaaggaagagaaagaactccagaaaaaatgcaggggagaccaggaatctccatttgtatatgctcttgttgattggattaaagaaaaggttggaaatttcaggattgaaccacctggtttgtttaaaggcagaggagaacatccaaagtctggtatgttgaagaggcggatatttcctgaagatgtaactttgaatattgcggaggatgcacctgttccaaaggtacctaatagtatgaaaggacatgcttggaaggatatattccatgataatacagttacttggctcgcgtactatagagactctataaataatcaatttaaatatattttcctttctgcttcaagcgggtttaaagggatgagcgattataataagtacgaaaaggcaagaaagttaaaagatcatattgatgcaatacgcagtgactataggaaaaaaatgacaagcggagatatcactcagaggcagcttggaacagcaacatatttgatagattttttagctttgagagtcggaggagaaaaagatacagatgaggaagctgatactgttggctgctgctcattaagagtagaacatattacatttaatcaacaagaaaaatcaattactttggattttttgggcaaagattcaattcgatactataatactgtcgttattgatccctcagcattcaataatttaacaattttctgcagaaacaaggataagatggaaaatgtctttgatcagattaatatgagctccctaaaccaatatctaaaatctattatgcccgaactttctgccaaggtatttagaacattcaatgcatcaattacattagaacgtgagctttcaaaaatttcagcaaagtcagctgtgaaaagtgaaaaaaaaaccaaaatggaacttgaatcatgcttaaaagatgaacttaatttatctaattttaataatgaagtggatattaccaatgttaacgatattttaagattttacaatgatgctaatagagaagttgcgatattatgtaaccatcagagatcagttcctaaacaacatgaatcttccatggaaaaaatgattaaacaacaacaggagttagaagaagatttaaaaatttgtgaagcattcctcaagattttgaagaaaaataacaaatctgttacaatgaatgacttgccaaaactatctactgaggtatctttcaatggaaaacagagaaaatacccaataaacttgaactcaagtctagatgtagtgcaaaaaaaaatagattctattaagagcaaaatttcaaatttgtacttaaagatcaaaataaaggatgataataagactgtagcgttaaatacatcgaagattaactatatggatcccaggatttctgttgcattttgtaagaaatacgatttaccaatcgataaaatatttaataggagcttaagaacaaagttcccttgggcaatgtatacgagatcagatttttcattttaa

SEQ ID NO: 3185 - DNA, 786 bp, Cryptosporidium hominis
  misc_feature (768)..(768): n is a, c, g, or t
  misc_feature (775)..(775): n is a, c, g, or t
  misc_feature (781)..(782): n is a, c, g, or t
atgtttgatgaaattgaaaaaagtatcggatcaaatatttggtcttgtaatgtgttcattacttgtggaagctctctctttattgaaattgagaatgtattacttttttggttaaatttaatattttcaagttctgatatagattataagcctccatttttccctaaaattcgaagttctttgcagttatctacatttttaattgtatttcttaagtcgttggagcataaactaaaaaatgatatttacttaatatgtacagacagatttaagttagatttggatttaaatgtgcgtattggcatcatcagtgtattgcatccattcttgataccaaataataatatagaaagtacagattcttgcatttcagttcaacagagctcatttgatgaatttattggagaaaaaaaatcgttgtttttagatcttttccaagtaattcttgcgatggaaagcttacttatgtccactcctatttcgttacaaaagagaatcataaataacctagatagttttgaatcgcattctagctttgaaagcattcacccaaacaatcgtattaattttattgaaccaagggagttattattttacgatgacgatttttcaataaaaaataaaaaatgtttagacggtattgtaaatattgtttcaggtaaagatattgtattaatagatattttatcaagcttttattttgataatacaatgagtctagatttagacagggtcataaaaagattgggtagcttagaggagtcgatncagcttnaagaannttag

SEQ ID NO: 3186 - DNA, 918 bp, Cryptosporidium hominis
atgaacaaattgctttttgcgataatcttagtttcttatatctataagtttgcaaattgctttatttcatcattctccgggccttttatgctgttttattcggttttgcgtacaatagatgggatggcggagaatatacaacacatcagtaattcaatggatttatcgttacagtcattcttatccactcaatttctcagtaaaatcagcgataaaattgataatccaattgttattggagcagattatcatgggtcggtttccccttgcgaattagattttcatcctttaatatctagtaatgtttttatcgaaagatcaattgataaaaataatacaaattgttttcaggtgataaataactcgcctatagttctacccttgaccgataataaaaatattcaaatatttgaaagcaaaaagtataaaacagagaatattggaggctgcgactctgcactattcaagagaatggatgtaaatttggtaaataaacaaaatgaaataaataatgaaaataattatagtacagtattagaaccgttccattatggtacaaagatggtcagtacagaatttaaaaaccaaaatggaaatggctacgcaaacgatcttattctcgcaactaaaatcttcaatccattgcagaactatgaaataaataataaaaatatcaacaaccaaaatataccaactcatttgggcaaatctatttcaagcaatgaaatattttataatcatcaatatgagcttcgagatacagaaaacactgaatttgatttaaattcattcaggctatatacatattatacaacacactatctttttcagattacaagtattttttcgatgggtatttcattacattctcaatatagacgtaagtctagacagagaaagttgcatctagtaaaatag

SEQ ID NO: 3187 - DNA, 627 bp, Cryptosporidium hominis
atgaaattctatgcgcatttaattattctacattatatatattttgttgaaataataaatcatattttcgtagaagcattggttaatgatgctatttgtaacgttgcctctgggataatggtaaaggaagcgtgcagcgctgtaactaatgcagcatgtagtactgtaggaacagtggcatgccaaacagcaggagatatagcctgtcaggcaatgggagaagcaatttgccaaactacaggtaatattgcatcagatgcagtgtgccatactgcatgccaaatagcatcaaatacagcaggtgaagcagtgtgtaatattgtttctcaaatttcctcagactcagtatgcgctactgcatgtcaagttgccagcacagtaatagggcagtcttctagtgacatgttagctggtttcggagcagagatcacaaactctttaatttcaaaaagtgcaagcagtcaaataatggcggcatcagcggctgcaaactctgtaactatttcagtgactatttccacagtaatgtccattctacaagtaatgatctctttatttggaatgggttttaatttatatactcatatcaggtctttaaatgctagaagaccatattatgttcgttaa

SEQ ID NO: 3188 - DNA, 2385 bp, Cryptosporidium hominis
atgcatatactccagcttttttttttgtgcctttttattgcttcatactcagccctatgtaaattttcgaagaaaggtatccctattcctaacagacaccatttagaagatgcccataataatatatgctatgcattaattatgtcatctggctcaaacaaaggtccctggcaggcaggcgtcgtacgcggtattgctcaaaaataccatgatagtggaaaaaaactaagatgggatcttgtaggcggaacttctattggggcaataaatgcattggcttctcaattttatcctcctggcgaagagttggcttggaccactgaacttgttatactttggaagatggcaagacaaagggatattacgacatgcaagactcctttaaaaaaaaactatgcaaggtgggcagtttcatttcttaaaggttggattagctctagaaatccatttaggtacttgtgcgataattctcctgcaagaaagttattaagggagctgtttttacacagaaaacataaacaaaggcttttctttactaacacgatgcgttacacagacagaactgcacacgtatttactgagcaattagaactcgaggaaataatagaggcagtaataggttcaggaacaattccaggcatatttccaatcaagtatttgagaaaccttggctatcatgttgatggtggttttattgctgctggcgaccttgaaactgcaattaaacgatgtatcgcagtcggaaaggctaaaactccaagagatgtcgttattgattttatatctgcagaagaaccacgcgaattaaagaggaacacttcctttttagaaggagaggatcatagaagtccccaccagcttccattatactatattgttttacaatcattggggattctttcagatatggtttcatcaacatctgtagttagacagattatttccaaataccctgatgtaactatcagatacctgattcagccaaatgaggaggctcttatgtggataccaggagtgttggttgatttttcacaatggaaaaagatgcatagggttatagaagcagggtacaaatctggctataatgcgcttccaattactggtgaaaagcttaagaccattatggaacctgcagaaacacattttcatccaccagaccctgccgatgttagctcaatattagaacaatactatcaggaatgcgaggcaagaaagatatcaagcggttttagacctatgggcttagatgacgttactctttatctattaacttcaaatgtagaaaaagctattaagacggtgtttactgaagtttcgccatataaagatatatttccatataaagactctatagcttttgccacatttatgggtcctttttttattactaagaggtgcattgacttgatgcactattttgcgcttgcaagaggagtaagatctcccactcaaagccagttttactcttgggttggcaggctgtgcaacattattgcgtcaaaagttaatgaatacaatacgggcgaaattcgtaatctttccaaacaatatttcgttgaagaacttccgataactttgcaagatcaaggttctgcagaaattacttatgaatttggcaatcagtcaattcaccatctctctgaaaattttgttgaaaattctttagatgatggaaaggatattgattcagacaatatcgctactaaaattaggaatttaatatatgcattatccaatgataataagcatattattggaatgacattcttggagtttaccaatactaagcgctcgattgcaggacttagccaatgtgtaaacatactattgaatgacttgcaggaaaaactagaccaaattagccctggtgcagctttaaggcgtgcgctcttaattaaggaaagaaaactgaagaatacacatcagacacttaattctttcgttgtggtactcaaatctcttaatgacgacattcaaaggttaaacaaaacattgataacaattgactcatttttaaaatcatctaataacatttccaataaagcaactaagcttttgaaatatatagaggataaacaaaaaaaaggtatattttcggctaaatttgaagatgttattacattactatctttatatgaagattatgttgaaaaattacaaggtatccgcattaaagaaattaacagtcgtagaataatcgttgactcgaaacattcgcagttaattctcgcaagaataattattgcattacgcgaacaaaatgaacattttccgaaattgattaatggaaaatctacagaaggaatttcagagtctattaatagatgtatcagtattgttgatgagcagtataaaccaatattagcagcaaaagattcatcctag

SEQ ID NO: 3189 - DNA, 438 bp, Cryptosporidium hominis
atgatggaatttaaatatatagttgtttgtgtgattttatatttaactcatggcacaattgaagctaattctattcacaataaaattcaactaggaagtttcgcagaatacgacatattagatattatcaccaatacaaaaagaccaggtacaaacttaaggagaaacctctcaagtttagaaattaacaaacaattcaatagttctattgtgccagcctatatgaagattaaccatggagcatgtaaagaacaatatagagagcaaaccattcacatatcatccagccctatattcattagtttaaactattcaatagacaaccaaattgaagtaaatggcaccgactcaatatcaattaaatgttgcagtactattatttcacctgaattgattgcaaaggtaaacacgacgcacgtagttgatttgattgattag

SEQ ID NO: 3190 - DNA, 1779 bp, Cryptosporidium hominis
atgggtagaagaaaaataaaaaatgttttgcggatggagagtgatgacaggtcggacaaatttgttgaaaagccctctccaaatttagttatgcctgaaaaaaagttaatatttgaagatcatctccttgaaaatattcaactcgaaaatatcaccattgcagatgttaagagaataacaagcaagacattcgattttttacgtgccacaggattaaggcaaactcatatctctgctacaacaggaataaatcaatctattttgagcataattttgagggatcctggtactaaaactatttcaattaataggaagaaagatgttgtattcaagttatgtgaatattataacaaaataaatttaggattaatttctcatgacccattgacagcacccaaaatttctaattccaaaaaaagtggagaaatcattcaaaagaaaagaactcttcccagaagaaatacatctgaagatggatcaaatgaaaattcgattataacgaatcctgagaattttgttcactcaaattcttgccaatacaataatttcgaacttgaaaaaaaagatgaagaaagccaagaaagtgtaattgattcagaaggtgcaatatatggtttaaaggaatcaaaaatgaaacgcatagatgattgttcatataataaatctttagggaaaaatatcttactattcagctcatgtattggttgttctataatccccacaaaaataagagaggaaaagaaattttttagtgaatatttttccagtgggccaatgtcatcttttattaacgacaataacactctaatcaaattcacagaattaaatcgctcctgtaaattgaatgagaatcatttaaactttaattgtaatcaagactttacttcaagaattttagaacctatattaataccattatcagtcaacttgcggcacttcattacgagctcatttactgacaattgcatagctgagaatgctaacatttcttcagtttcgagatctaactcatcgacgatactctctacactcaaggggaaaaacttcaagcctgaaagatttatctggtcctccgtttcggactccactgccctatggggctttgttgaaaatctcagtcgcgagagacacttatctatatttatgagcaatagtgaaaagagaagagcgtttaattggctagtaagggagatagaaaactataaaagtttatatttacaatttctttgtgtaacattggcctcaaatatcagaccagggaacaactcactgctaattcgtgagattcgtttaaatgagtcatatgaagatgtcattgtgaatgataggtttgagtggaatatttcgaatcccacaaatcagctagtaagatatgttgagtgcttaatttcagatctaaacctaccacaagaattattttctgagttgctttatagtgctttgaaacaggtttttgatgaaattacaaattttgttaaaaggtttaatcacaaaaacattactgacgaacttaattctacccagtacattagcgatcaatacgaggatgatacgtctagcaactactcttttggcgcaaattttgagacccgtacgaacgatgtaaatattgacaaggagtctacaagattcgtctcatatgggaattttattaaatggggaagtcgtgctgacttagagtatgattcagatgataatgctaagcgatttcctaccattgagaacgcagaagaaaggaggcaaatagagaaccgaaaccgctttaggaagagaagataa

SEQ ID NO: 3191 - DNA, 180 bp, Cryptosporidium hominis
atgaattgttggtcgtgttgcgcatatactagcaattcattcttgcatagttggattttcgtaactttgtataatcctggaaagaatgaagacaaaagatcattttctatttatcaaatagtcaggcttcacaacatcaatagtattaattttatgcgaactctctttattattttgtga

SEQ ID NO: 3192 - DNA, 1914 bp, Cryptosporidium hominis
atgcattatggtgcaaataaagtagtgcctacagcaatcatgccgcagaacaagtttatgaacaactacacaattaatggcgttcgaaataatatttataattttcattctcatgcagaaaataataattttcagcctttatctccgtgcattaataatttggatattgttaatttgaaccagcgccaatttattttacataaacaatttacaccgccacaaactccaaataatttacgttgtgcttctctatcgccattttctagattggataatttacaattcaaaagagaacctaataacattttaattcagaagtattcgacacaaattattatgccgtccttaacttcaaggcgtgatgggttgaatgcgcctccagtctcatttaaaaaatttaatgtatttcagcactgcaatatacaaggttcacaatcatccccatacaatttacatgcggttccaggaactcctagctcaagagaaacgtatttcttttctaagcagtctaatttgattttaccagataataagactaacaaaaactttactgataaagtaagtacaactatattgccaagctgtgacaaaaacaaaaaagcttcgaaaagtgaaagaactttattttctgtgagtgcctctaacttacaatcaaacaatggaaattctgctagtagagcggttagaatggataatactccaaagggttctcagtatgactctttttcgactaaaattgaacaatcggaaacaaagtatactgatgttaattcagaatatccatcagaaactttttctcaacttacttcaaacaatgaaataattgaaataaaaaaagatttgataaaaagagttccagatgcaagtaatggtgttttacaaaggttaaagccaaatgaatatataaagatggacgatttaatgttagagcctgctactcagagaggatcgttcggagttgtttttaaaggtagaattagatctggaatctggtccaataaagaagttgcagtgaaacggtggaaatttgataatgaaagcagaatatcggaagaacattttaaatcactcgagagggaagtttacgcatatagactactacgccatccgaatatttgttcttatatcggagtttgcttagaacctggattctacgcaataatcacagagtatctcacaaatggaaatctttttgaattattatatgaaaataaagttgtagtatctgcctcggataggttaaaaatctcaaggcagctttgcgatgcagttaactttattcatcacaacaatatggttcatagagatataaaaacagcgaatattattctagatcgttcgaataatgttaaattatgtgattttgggcaaactagaacgatgaatattgcaactaagactagcccgcctggtgttattctggatgaaaatggtgggtcgcctaggtatatggcacctgagtgtttttacattggaaggtctatagatgaaaagtcggatatttgggctattgcttgttgcttattggaaattttcggcggccccatacctttttatgaatactcttcaaatgaggaagtaattaatgcaattatagttgagaagaagaagccaaaaattccgtcatggtttcacccctctatatctaatttactctccaagtgtttcgaaagaaagccattcaaaagaccatcttcttatgaggttctaatgattctaaatgggatcaattctgaagatattaagaaatatggtatgaatgtgaagagaaacattaacggcgacctgatgccagggaataatgtaaattgtaatagcgtcaatatgagaaacggaagaagagtagtaggaaactgtgtaggagtagcacaacagaagagaatagttgttagagcgacccccgcactcgattag

SEQ ID NO: 3193 - DNA, 282 bp, Cryptosporidium hominis
atgtatatagagactttagtggaaagaattaacctcaaaaatattgacttcgcaaatttaatgttggaaagaatcaaaacaacattgaatgacgctctaaatacaattctaattaactacgaagatcttaaaactttagaagcgaattcagtaattttaaaagaaggcagccgcaaattgtttaaaggtatactaagagataattatattgagaaagacatgagaaatttactatttgcttctacagcaatagtggcaattataatattattaaataaataa

SEQ ID NO: 3194 - DNA, 1908 bp, Cryptosporidium hominis
atgaagccttctgccaatgatgatccaatatatgagttggacagtaaaaaatttgatctctataaagaaactagtgttgcaaatggctgctatagacatgaaagatatatgaaacatcctcgtgctgttagatttgtttttgcgtggatgcttatagcgcaagtacttaggaactacgatactggtgcgttgccagttctccttgggttaatttctgatgagtttggactagacgaaatgaaattaggagttttgggtgcagtaccgtatgtatctgcaatggcaactgcatttattatgaatcacccccttcaaaaatacagccagaaatggataatagtcacttccctatttttcctatcttttgggctcgctctattgatatcttctacgacaagtacattattgtatatttcgaggataatcatgggatctatgcaagcacctttaagtatttatatccctgtatgggtcgacgaatttacgcctccaaataaacttacagcatggatgggggcgtcacaagtaacaatgattattggagttgctacagggtatcttattactggattttctttaaattaccataatggatggagatattctcttcttgctccctgtttattacttttaattatgtcaatttgtcttgtattcacaaaaagtgaatactttaacgtaaagtattttaatcacgaaggcagaaattcagaaatagaaatgggaggtgacaagatgaactctgatgatgcaattagtttggataggcaaattaaagatagcgcagcaattcaatgttcaattccttcttcatgttcaacagagctcgttgaaagcccctataactcgattgctgtttcaactaaacttattaccctaaataagtcacaagaaaacatttcaaattctaataatactttttcatttgatactcgagttcagaaaatatcaggcgatttttctgccgaaattactaagtctcgaattgaaaagagcgctctgagtgatttaaacgacacaaaaaatactgttacggttgaaaagtcgactgattttcagccaacactcacaactcactatatttccatttcgaggtcgctatcactttccgaatttacaaatggaacgtctcagagttcacaacccctaaatcctagtattattaatctaaatcaaggaccttcagccaatacaacaaacgaagataaattagaattggaaagttcaaaatcaagtgttttcaaaagattaattgcatacagcaagtggaaatgcctattggaaaattcaatttatatgctttcaatcaccactctgtctgttatttactacgtggttacagccgtacaattctggacgactagatatttacagcaaatatatactactagagatggaattattttcatgtcattctctgcaactgctgtgattgcccctactacagggatagtattttccggctttataatcgactttataggcgggtataagagtgagcgcggtttattttacactatgctattttgtatggtatctgcaatatttgcaactttatttggtgcactagcacttataatcgataattttacagtcacaattgttggcgtttggggattattgtttttcggatcatttcttgttccacctatcactggtattagcgttggagttgttgaaccacaagcacggcaatttgcaacaacagttgcaatggtaacttaccacgtatttggatttgcccttggaagccttttgccaggcgcagtgctacaattatcaggtattaatagaacagggatgactatagtttatggcttctcaggattgggtgtgattgtcaatttttttgcttgtatcattgcatataggaaactacgcgcttcaaaagaaagcatgcatacatag

SEQ ID NO: 3195 - DNA, 873 bp, Cryptosporidium hominis
atgtcaaatcaggagaagaacaaatttgttattcaaatagatacccattggggagatccattatatataatttgtaaaaatagttcgggattcatacttaattttgaaacttggaaatatgcaaaatcaagatccaaatctattggaattctgctcgagatgagtgattcaaacggattaaataaatatccattttgtttaactatactatcatccggaaaactgataaatactttgagcaatagtcgaatattcttaaacaagtttattaaattattaatctcaagcccaatgatgaatgaactaaacaaattcccactggactatgggcagattgtgttttttgatgaattgctgtttcttgtagaacgtggaagcctacttcttttttcatggagtcaatcaagactagaatgggttcagacccctattctctatctatttgacgcttttataagaaatgaagagcaatttaaacttaataactatatttcttattccagaatgaaaagatctggatacaaatttaaaactagttcaaatgaaaataaagttagagtccaagataacattcactcggccacaaaatttttaaaatgcattgatgaggcagaacatgtacagtatggcactgctatcaaacaagcaatagcattgagttctattaattcaaatttggagagttatttaataaccaatttagaaggaaaaccaaaggatggagaaaaaaatgatctatttttcgcttcaaaacaacctcatgacacctttttaataagaagtaatataactagatcaaataataattttgttgtgagtataatttcaataaactcagaaactaggcttaaagcatcgatttataaattttag

SEQ ID NO: 3196 - DNA, 3990 bp, Cryptosporidium hominis
atgtcagttaatatttacgcttctgtagttgacaactcgttgattaaggtgttatttgttaagacaaaagctgctaattcggctctgtttgatgatgtaataaagcaaattcaaaattcgataattcattattcgtcgaatattgatcaacttaaaacaagcctaaaatgcaattatataaaccaaaataggtcgttattagaaactaagccttttaagataaacactgtttatagaacaatatgttcaaatagcaataaaacaaatattccaagatcgttcatttgtattgaccatgttgttatttttgttactttaaaaaaaaaaagtttcaataacagaatatttgacaatgagacaaatatccctgaccatccatttatttatagagttgacatcgacatcattgatggtattaacaaagagatagagttaaactgcgaagataaaaatggtattcaatttaattcaatcaacgagcttgcagaaaatgttattttaaatattttttgcaaattcaattcaattattaataaatacatagataaaggatatgacaaaattacaaaaattgagttattagaggacaaaaccttagaaattattagatatagaatgagaattgcagggatatatttggttttgggatcccccatatcatctgcaatgtactataattcaatattggagctaatagaagaccatgatttagaccttgcttattacttagcgcattgttttgaaggccaggctaccatgttatattatttctattctaactcagaaaactcattggaatggtgggaagttgtatctaattcattaaactcatttattcaagacttgcctatcccgatacaagtcagtctacagtcaaataattacaattctacaaattacaacgactcgatttatattatacagtcgaggaaacaaattttttttgattcaatacttaaaaagcttaatctttctctaaatttgctttggaaaattaatcattttacgaatggatttataatatctgacaacaatataaaattaaattacaacagtgatttttccgtttcaatttatgaattaataattaaaaagtcacgatttttgatagagaattttgtaatccatttctacctagacaggaaaataataatagactttttggatccatttgttaacttaaatatcccaccagaatattcaaggaatgacttatataactatgctatgtttttgataggatgcgcagaaatttatttcactattaatagtaaaagaagggtagggatcatcctaattaagctatcacaactattcaatcaaaacaaaatatataaccatagctactatatttcatgtgcagcctatcagtggtattcaagtatttatagtggaactaacaattttgatctcctgaaaattattcagaatttagctgctcacattctaaaagaagaagataattattcaacacatattcaatgtgcactatgtaatgtctctaataattcaaacattttattgggaagtaattatagacttgatcaaataactgaaaaaaaattaggcataatatttgaaaaacattatgttcctggaaaactttatcttgacaacaattatttacaatatctttctatttacaaacacgatctatctttgagttattcagcgcttatatctaatggaggttcgagcttatatcaagacttagagtgctcaaatgcccattgtgaattgcttgcatctttaaagccttttgttaacagttttgtttcctatggtgtgcattcaatgcttcaggcatatcgaaaattttatctaaacacgattgatttgcaaaagttaaaagcatacccatctagatatgaaatgctagcgttgataacaatgattgagtcaagtattttatttggatgcgcgtcaagatctgcaacagttttattactaatacttgataaaattgtatattttcctcctatatataattatgatacactaaaaataattcaatctaaatgcatagactcattgtcaatcataagcaatactattcaacttccaataataagggcaccatatttctcagttacaaacggtaaaaatcgttgttacacttcaatagaatcattggaccatttgttcaatactttgcttcatacaacgcaattaatacttatcttcgatgttacattcgagcaaattccattaaataccgaatgctacaagtgtaacaacgaaattagtttatcttctatattcagtgcaaaagtaaatgattattgttctaattgcgaaagcaaaatactaaaaacagatggttcccccatgattttttgtaaaacttcaaatattagttatttttcggatccaaagtttattattcaaccaaaatttaaatgggttcctctcaaagtcaacaatgcaaagatcccagtgttaaatagtttgaaagccaaccaatcaaacttatttttatacaacccatttgaaaagaaagtcaatgatttaggggaaatatgcaatcgtggtaaatctcaagttgaaactcaaactaatataatttggcaagctgagaaacagtatacaatttatgtatcattatttaatcctttcctaattcctattattcttgactgctttagtgtaattattaaaggtgaagtgaaatgtgagatttcaccggtttctgtagtaattccaccaagtcccagattctcaacacctggcgaagtgaaagtagcaattgcagtaattccaaaaaattcaggaaacttatctattattggcgttacatataagttctcaggaataaattacgtaaattttggttcaaaattatcattttttaataacaagaacaatttaaaacaatatttaaatatttttgtagtacctaatatttcaaatgatgatataattttatgggaaaaaaatgatatgcaaaaacaaaatttgtgtattaataacaatggaaaagtagttattaaatcaaaaaaaaaactcaattacgaaactgagaaaaaaatcaaattattaacttcagaagtcttcatagatcaaattgaaactacaaatgaaatcttctcatttgaaaatatgattacgaaagataatgaattaattgtcactattgaatgctcaaatatatataagatgaacagatataagctcctagtaactcattggctggaaattaacgggaaggtaattatttcttccaaattatttgatttattttcaaatattcctccacttcctaagataactaatatttcattgatacctaaattaaacttccaacagggttactttaggtcaaacaacaataaatggaaggttagtagcatttgggttattttcacattagaaaataactcaagagtatacccaattgagttttcgtttagctcaaatctattagaagggaaaaaagcattgcttttgccagacaaaaggaattataggtgggttgttgagacaaaaattaaaaatttaattgaattacaaagtaatccattgttattaaattggaaggcattttttccaaatattatatttgatgaaaataaatcagagtttataattgctggaaatctaactgcaaatttattaatacctgaatttctatctagatatgaattttatgtagaaataaagtgtaatggaacgaaaattgaaaacaagcaagcaattccagttaattcaatggccaatattgaaatctatgcaataactgaaagaaaacccacaagtttgacaagcatcaggattatcccgtttggagatacaatgaaatcaaaacaaatatacttagactattacgaaagtgatattaatgtttcagaagtgcctattctctatttttctattattggtctggagaaaaaaacatatgagtggattgtaggagtggaagagttggaaacatcaactcaggaaagagtatttcattggaaaaacgatctactctcaatttcatttacttga

SEQ ID NO: 3197 - DNA, 639 bp, Cryptosporidium hominis
atgcttccttcagagttgatatttaatgatatttctgcaattactaatatgatattctcatttattgatgacataatttttgaaattctgtatggatggagagcattacttggatatgaaaagggcagggcagtttttgaaaagtggtttagccaattaatacttgaattggaaaaggaaggaaaaattgcagatttaaatttggttgaaaataatagtttcttaagtatctctaaacatttaacattaataattatttatctaatttctacattaaatttaattaaaaaaaagaaggtggaaatttcgcacagtgaccttaaaaaaattaacttattgtttaataagttattgatggatggagatagcaaagtgaagtggggatgtgaacattcagaattttgcatcccgtacatattttgtcactctgatgtcgagaacaacattttttttagcaaagcaaacagcataaaatattccacctttgaataccaatttggtgatttaattggagatgaagttttaaacttagcattaaattataaaggaagttctaataatgttaatatttatgaagattactacttaaagttcgaatttgttaaacgaagattagatgaattcttttcaagtaaatga

SEQ ID NO: 3198 - DNA, 654 bp, Cryptosporidium hominis
atgccaacatttgatataagatttatccctgttaagaatgattgtctgagccacatatataaaactatgggattgagtgatcaaactttattctggtctaactcatataagttttgtgagaagcatggaaacttggtgcaatgcgcaaatataattaataatatattttcttgtatttgccgaaaaaatatgtattatataaacttcaactctgaaaatacagatataaattcaattatttgtaaaaaatacactgctcacctagtttcgcatggtttccaaacttttgaagtttcagagagtctatcgattccgctatggaaagataaacttaatacagttctagaaaatgtcaatgataacttctttgatagccctattaatcgtacactatttgcgggaacatttgacagattacaccctgggcataaagtaaatattacagttgcaacttggtatgctaaagaattggtaataattggtataactgataagttgcttaatgctaataaaagtgataaagatatcattcaagtaagttcttttactgtttttagtaattcattgattccatttaggatttttcctttagaagcgcaaatgttcactcatttatcttttctttatctcctgatatttctgttgccatattaa

SEQ ID NO: 3199 - DNA, 753 bp, Cryptosporidium hominis
atggataggtttaagttgagcaaccctataaaagctcagaagcatttagaagatgctgtaaatgcattgaaagaactagttaaaataaaaaaatgcccagaagatttattattcaataagaattcacaatttattactttgattatttctttatctaatactccagaatttgttaaaagtaaacatgtaagaataaaaatcccaaattctttgtataaacatccagaaaatgaagtttgcttatttgtcaaagacccacagagaaaatggaaagaactgataagctcttcttcaattgaaccaaaagtcgtttcgaaggttattggtgttagcaagctctctaaaaaatatagtacatataaggacaggcgagaactttgctcgggatatgatctatttttatcagacgaccgtataatcgaaaagatgcctaagttgttaggatcatactttattaaagcaaataagatgccgatagcaataaagattagggaatccaatttcaagaattcactagagtctgcgctatcctcaacttttatgagtattaagaaaggtaaatgcattggaattcgcgttgcaagagtcgacatgaatactaaacaagtcgttcaaaatttaattgaagcaataaaacaggtgtcagatttttttgaaggcgacggaagtaagaattggagaaatagtatagaaagcttatatatacagtctacaaacacaatgtccctacctatatggttcaaggagaagtaa

SEQ ID NO: 3200 - DNA, 807 bp, Cryptosporidium hominis
atgatgcttggccattttgataatcataaagattctccaagtgaagccatacgtgattcaaacatagaggaaagcgattctgatctttttggcgagagtgactcaactcctgaccagattcataatgatggggattcttttatgattgaaaaagacgatgcaaaaactcatactagtataaatgataatattaactgcgatagaattaacaactttgaagatattaaaaatttaaaattacaactacctacaaattatttcgggattgacaacaaagatcaagttttattaacattaaaacttccggaacgtcttaaagttgtaaataaaacaaatgttgataatacaacagaaagtggtttatgtatcaaaggcggtattaaaggtgaaggagattcatactctaactccaaactagtttcttggagtgacggcacttactcactattgatcaatgacgaattagtatatgattgcgtgattggacccgataaagcatttatttttgatgataccttcgacaaaaagtacaaggtctgcataaaaagagtggataacaagttaacagtcagacctagaacaattgaaaaaagtaaactacttagagactctcgttccagagccatgatgccaacgacattagaggagatcaacagacatgaggttgagtcgaggaaaagaatagacgaactgaacaccatctcatctataaagattcaacagaaaaggacgatctgcacgacagagtcaagaaaaaagcagatgacaagccatttcctggaagaatcaagtgaagaatcaacttaa

SEQ ID NO: 3201 - DNA, 753 bp, Cryptosporidium hominis
atgtgttattcaaaaagatttggattcccaaatgaaccatatgaaatacaatccgaattttgttcagctgcttggaagttatatgaaatagatggtggaattggaatttttgaatctccaacgggcacaggtaaaactttaagtattttatgctcatcactgagttggataagccaaaaaatttatagtccgacatcttttgcccgagaaagcaagccaatgcctttatgggtcgctaatgcaatcaggaaaagtagagaaaattcatgcgagcaatacattaatgaaaaaattaactttttaaaatctatcaacgaagatattttaacttcgacaaaaaaaaatgtaaaagaattaatatctagcgaaaacttagattttttttctagttactatcagataatcatctctagtagaactcatacgcaattaatgcaattcgttgaggagtttaacaaaataaaaatggcaaataaagataacactcacatttctaacatttattcaattgtatcgcttgcaagcaggtcacatctttgtttacataatgaagtaaaaaactatccaaaccatcttattaatgaagtttgtaaaatatattccagtgacgaaaaaaaagaaaataaatgcctctataaagaaaactacatggaactcacgaaaaagtgtttaattgagccaatgaacattgaagaattacgtaaagaaggtaaaaatttaattgtaagtttatttaagttattttcatactaa

SEQ ID NO: 3202 - DNA, 1107 bp, Cryptosporidium hominis
atgaaattaactgctggtagaaagcttcaaactgaaaaacgtgatccgcaatcaatcaatcttaattgcggatattatgagactaaagggacaagaagttatatggaagacagaacatttttatcattagatgttttaaatggagaattaactcaaattaaaaagccaatagtttcattctttgggatttatgacggtcataatggcgaatttactgttgactatttaaaaagtcaccttcacaaaaacttttctcttgcttttaaccaacttaaatatgatgaaacaattcaaaatactataaattcattggttgattcattttatttaactgaaaaccaaattaaaaaacattattttaattccaataacgagcaaattatgaaagaatttgaaattatggatcagaagcagggactaaatataaacttagagtcttctttaaaaggacaaaatattaaatatatatcaagtggatcgaccgcaattgtgtgttgtattacttcgtctacaatatgcgttgctaatcttggcgatagccgagcaattctttgtaaatgcggacgcgcatattcgctaaccaaggaccacagaataaaaagtaatttagaagaaagagaaagagtaaaaaacgaaggtggaacatttgatgatgaaggctatctttctggaaatcttgcggtttcaagggcatttgggaattgggatatgtacagtggaatgaaattacaaggtttaagttctactcctgaaatttatgttcacaatatcacccgtgaagacgagtttcttttaattgcatgcgatggaatatttgaatcgtttagggatcaagaagcaataagtcttattagaagagcattaattgaaaacaatgatccaaatctagctgctgaaaaacttgtctccgcagcacttcaaagacaggctctggataatttgtcagcaattgttgttgtacttactcctccaaactacatggcaattgggaatcataatttttgcattgattccaatgcagaatctaagaaaaagacaaactatgctcatacttcaaataggaagatatataatttttccaaacttaagaatctattgctaacataa

SEQ ID NO: 3203 - DNA, 1548 bp, Cryptosporidium hominis
atggacacaaggaatgaagagtatgctgaatttaaaaagctaagacaaaatgtcaagcaactacaggatgagttgcaaaaacgcatttctgcagaggcagagcttgaaagtgaagtgaaaagattgcatgaagaaactattccattatctgctgcaagagcactaactcatgtagcactttgcaagggaagggctctcgaaatcttatctggaatgacgagttctaactctgttaacacatcaaatttaaggtgggcgtttaggagtctatataaatttgcattcggagatattgcatacgcaaaaaagattggtgaggataggtctgcgcaataccactataatgaaacccaacttcgcttatttcgtcaggaacaattgcttctactggcagaaaatgaaaggttatcttcgcaaatcaaaaatttgcaacttgagctagctcaaaactataaggcaacaaaattagaaaagatagtaaacaagccgtcaaagagaagaagccaaacacaacccagatcaggaaccaataatgaaccgattagagaaaatgaagctgatagtgtttcgaacagcgaactagaaacagaatcagattcagagtctgaaacaagtagttgtattgcactaaatgtcgaactcgtaacaaggcatctatggagtttaattcactgtatgcactcagcattccagaggcgaaagctgttggcattcattacatggaggctaacaaccaatagatcgtcgcatcaaatatctgatggggctccaaattcgagttcatttacaaatgaccaaggtatacatgagacttcaggatcaatgaatataaaccgctttttcgaacttcttcaaagaagatatcgtacaatgcttcttgcaagagggttttggaggatttggagctcttgttattctcctttattcaaacgaaaaactaattgcggtgtagttcgtggccccgggatgtcatcatttaggccaataaatcatggtggcctaatgcataatgactcagcatataagacaattggtgggcttgaggatgttgcttatgttacaattcagggttcaggagcttcgattagcagtagttcaacttcgtttgcaacccaacctcattatcttgcaaacttgcctagtttttctaaaataacgtatgctcctaggaacacgtacttcgagacgaaagatttaccaccatttccaaagccaagggagggaattaagtctcaacaacattctttagagcaaaataagagcatcccaccatattttagaccgttcgataaaccaaataactatatcaacgaaataaactgttcttctgatttgattaataatagtctgcatcccagttcaacgggaactagtgatattaatgctgcaagaacagaacttatttccctgcttgagccaagaataacaaataatccattgggacttataaatgagggaaatattagtcaattccaatctggtccaatggataacatttcaacaaaactaaagtacttggatattttaactgaggctatagatgaataa

SEQ ID NO: 3204 - DNA, 1449 bp, Cryptosporidium hominis
atgggtaaaagaaacaataaaaacgtagtaaaactcagacttcttccatcagcgaatggagtagatgggtcatctccaagatgggctcctgtttctaatcgagagtttactaatgatgaaaaacaaggaataagaaaaataattggaaatgtatatttccatgatgaacttgacgatataaatttagaacgaaagaatcttgggagtgaaaggtctgtgcaaaaaaataaaacaaataacgacttagacacggatgtttttaaagataactacttcccggacgatgggtatgattatgaacaacatctttgtacaattaaaaaagatggtaattacataaattcaactcttaaacataaaacaaatcttgacccaaagtctttattgtttaactcaacttcaatactctccaattcagagatagaaattcataaaggcgattttgtatctgagttagttgaacttgtaaattgcttagaagagccggatgattttgaagaacttaatgatgattttatattggacatgactggtctaaagaataagtgcgaacttgatcagaatattgacatgaatgatatactatggggaggaggaaaattaaagtcaagcctcaaagatgatatccaaagattaaatagtgaatttgatcaatcagaattgatgactcaaaactttgatagttcatctgttttttccgaagaaaattacaataatgaaaacgataatgacttacttgagaatgtattaaatgaatacaatgataatatcgctgccttgaatgaagatacaaacgaatctagtttaattgaatttaagaaaaagttggatgtttcggaatatgaacatattttggatagatatattaatcaagttaagattagaaattctgctaagagcaaaccggagaaaagttacggtgagattggtatgccacttgataaagcccaagtagaaaaaattatctctatattagaaagtactgaaatctgtgataattcatctgaagcaacactttctgatatttcagactttgagagcattgaaaaaataagtgagagcttttcccaagctagttttgaagtcattaataagccaaaaaaagtagatatattaagctattattcaagtttaaacttgaaaggccaaacaaaatgcccaacgccaactcgacaaaattttttttttgagaacgaagagttcagccataatcaacacgataatttaaaagcaccaattgttgcatctctgcccttaagaaaaaaagatgaaactcctgaggatcgaaggaacagaaaacaagcagtaaaacaagctaagagagaaatgcgtgatttaaaaagaaaaaacaagcaggataccaaaaacataaagaagtcagtcgttggaagccttataaattcaaataacaatgatattaaaagtggtgttaggtatttcaggttttag

SEQ ID NO: 3205 - DNA, 597 bp, Cryptosporidium hominis
atgaaaataagctttcgctggattttgttgagcttgattgtggcaatggatatatattgccagtctctgctcattggttgtcaaattgaaaataatgtatttaattataacagcagtaattatttgttgggcgcaagtgggaacataaaggattgcattccaaaccacccttacatgcgatcatttttccagattaatataattaaaaatagcttagacttagaaagcttcggaagatcattatatgtgtcgtttgaatcttcaaacgagatcagatatcttttaatggtttcagccgggatgtttgctgttgcggaaagaattttactgacgttttttattttacgaataattatcagactatttgtaactccaataataaagacgctatctacagtattaattattattgttatattaagagtaatgtttgctatttataacctttcagaaagctatagactatatgacactacagtcgttctttggaattcattgcaaagtttatttttcttaatagacaacaaaatatataattatggtgattatctactgcaatactttggaatgagtactaatcaaacactagctttttga

SEQ ID NO: 3206 - DNA, 1875 bp, Cryptosporidium hominis
atgcaaaattttacagaagtatacagctgctcttccgtccaaaacccaactgagtggggattgccggatagctcaattgaggaaatactgcagattatttatattatgacaaaactttgcaaatctcagctttattcatactcttggtattgctacaatcatcttattaccactcttgatcaatttattgaaaactcagagggaaacgttcaatattgccattataggggagatagttctgtggatacaagtaaaaaaaggaaaaacttgattaaacaatttaatgaatttgatagtctttcagaaaaagttcaacatttgcgctttcaagatgcaagacaatctcattgggataacaataaattttcaaagcatttacattggttgggagaaatagtggaaacaaaaatccaaactagggattggatacagacaaactatgttggctgcctttcttggtctgaaaggttattaaatcgaatggaaaaatcaattatggttgttcctgatgtaaatcagtgtgttgggcatgcatttgcgtttgcatttcttcaacaagttgtagtagaaccatctgtgaaatatgaagctaaactacagaatcttttggacaaaataaaaaatacctatacaattgaaactaagtttggacaagcagttggatacaaatttcaaattattaaaaaattaagtgataataaggagaaattgaattcccttaaggcaattaagagattactaccaacagttggtaaatacattattaaattaaccaggctacaaagaatgggaacaatttggtgtaactctattttatcaatttcagttgggaacactagaaagttcctaaatggattattgccattgataaacaatttgattattagtctctcaaataaattgtacattctggggcaatttactaaattaatggatgatagtgtaagtttgactacttttggaaagtatgttaaaggtaaacttatacatcctaattttttgaaagtttttgaagatctttatgaactacttaatgcaagttggagaattgttacgattgcttccattttagttccttcttcaaaaatagaattatcaaatatagtagaacacaaatatggtacaacgttagaagctttgagacgtgatattttgaatcgaaaaagtgaatcccacgcatttgagtggccatccaatctagatcaagagacttctaattacttcaatggagaaaggaattcgcttttaatttctttgtttgatacattggatgaatattggagtacatgcgcgacattacatcccttattacacaaactttgtgttatagccggcagaattcgtgatatattgactcttttggatcttccaactgcaagccctgtttcttggaaaagatttgttccagttaataatttttccggaacaaattcaggtatttcatcattcacacatgcaacgagagcaattgttgagggcactcttggatatccttctaattactctattgagtgggacttcgtgaattatcaacagtctagattatgcggtatagatgcagcctcttcatttattactggggatgtaaataaaacagtggaaaaaatttcgattgaaagcaatgaaagcagcaaaaatccaattatacactcaaatactcctttatgcggagtttgtgcattgcctgtttctactgaatccactgttaatacacattattttgatttagatgagtttagatatacgtctaaatcaacactagtacgtgggaggtggtatcacaaaacttgcttagaactgttaaattctgaatcagaacgcgaaaaccattctttatttgtgctgccgaaaataaatattcctcaaataatatag

SEQ ID NO: 3207 - DNA, 228 bp, Cryptosporidium hominis
atgagaatagtgttattcgcatttttaatagtacattttatacttaggacttttgcagcaaaatcttgcgaagaactcacatctaatgcatttgtattaagttattgcaaaaatggatcaaaatgcacgattgataatattggtggagaaggaattaataatcagctaaattgcgaatgtttggttggatatagcctatctgactgttctcttcgtaagtttaaataa

SEQ ID NO: 3208 - DNA, 1962 bp, Cryptosporidium hominis
atggtgaaaaaaaaaaaatctgatgtaaaactaaaaaaagcagcggagaagagggaaaaacaactttttaagtcgcagaataagcacttgaaagagcttaaacgagatggtatagatgatatagttaaaactgtggaaggttttgacctaaattccggaggtgatgatcttgagattcaatgcagtattattcaatcagaaaggccaagtccaagaatctcttcttcatacaatattcacccaatatctggagaagtaattatttttggcggtgagtactatgatggaaaggaggttaagtgctttcatgacctatataaatggaatattgataaagatgaatggaagcaagttgtaataggtaatattaaatcatcaaacaattattctggcggtcctaaacccaggtgttctcaccaggcagttatctttaatgagtgcttatatattcatggtggagagtattctactgaaaatcagttttaccactttagagatttatggcggcttaatttaaagaactattcatggcaggaagttaagactacagggctcagtcctactccaaggagtggccatagaatggttgtttggagacattactttgtagtttttggaggattccatgatacaataagagagacacgatactttaacgatatccatgtttttgatacaaaaacattacattgggtcagaattgattcatcgaaatatgaaacttgcccatcaccaaggagtggcgttcaaatggttctctgcccaaacagtgatcgcattttcatttatggaggatattcaaaaattaaagataactcaaaaaattctgttgggaaaactcactctgatagttggtttattgatatgaagccatttttaaatcaaggacttccaatctgggaaagggtatccaagaaagggaatccgccatctgcaagatctggttccacgattattggatataaaaatcaatgcataatttttggtggtgtatttgatcatgatgatgagctcgggttgaatctcaattctactttttataatgatttatatgtgtttgaagtgaataataaaaggtggtacgaaattgagctttccaaaaataaaattaaacaggaattttttggcgataatcagcctaatgcaaactcaaatttcgcagacattggcacccacaagaaagatgaggcaagaaatataaataatacaaaggatattgatttatctgataagcatttaagagttaaagggaaattatcaaagtttggtttagaacagcaaaactctttaaatagtaacctgcccaatgatgagttaggagaaagaaaagtaagtaattctgaaataaactttgaaaataaatcaattgacttgccacttccaagaattaattgtggaatgtttttgagaggaaatattatttatatttatggcggattatttgaatcaggtaaaaggaatattacattagacgattgttggtgttttaacattttgaaaaaagacgaatgggtatgcgtgctcccattaagtgtaaaatcacaagaatgggctgattccgactctgacacagagagtaatatatcttcagaatgttttagctcatcgaatgaaagttgttatttaggggaagaaagcgattttagtgaacaggaatacgagttaagcgagaacgaacaaaacgaattatctagaaaaactattgaagacgttataaaaaaatatcaattagatgattcaaacaaaaccccatttgttaatgaatcaatacgcgaatttttcatgcgcacaaagacatattggttgaatttgattatgaaagaagaaatgggggggatttctgatggaaaggatttatcaaggagggcttttatgatggcaagagaaagggttgaccaaattaaaacttatattaatttagttagtaaattcgaaaatagccagactaagtatgaaaattag

SEQ ID NO: 3209 - DNA, 1656 bp, Cryptosporidium hominis
atggaggaaattaatctttttttaaaattttttgaaaatgggccagttaatttacaagaaattagccatgaaagcagcaaaatgaaaaaaataattttttctattttcaaaattgtaattacggatttagataaaaaggcattgatagatggtttgattaacaaatttgaaattgataattcttctctctggaactcatttgaattaattcttagaccggaactgaaaaaacttaactttaatattgagaatattatcaaaaaggttgaatttgacctatataactcaaacagtataacctacttaaataaaacttttaagaaagctttgctatttggtgataaagaaaatatcactaaaaaaaattcaaaaaaatttatagatcaaactaaaagtagtgagcaagctttaaataataataaatcttcaattcaaggcattgaaaatattgatttttttgattacgatgaaatggttaaatttgtcgatgaaggagttcaaaatacgaacttcgaatacagtgaaagcgatatttctgacttcagtgatcctagtggagttgatgatgcctataatttaaaatatgacgattttttcttagatactaaaagtactgatgaatctgttattgaaaactctttaaaagattacgaaatagatgattttagtccatctgagtccgaaatagtcttgaataaaaacaaaataagtgaaaacttgatcaataacacgcaatttcctaatacgaaattagatcatatgtctaaattaagtcgggataaaagtaaaatggatatgataatagatgaatttgaagcaaacattattaaagagaaagaatggtataaattaggtgaaacttcaataacagatagagaaaaaaatagcttgcttgacatacatttagaagtacctcaattttcaagtacaaataattcagtaaaatatattgatggactaagtaatgaaataatttcaaacgacaaatctaaagtagaagatattaatccatatttagagagtatcgttaggcaaaggatattaaatgatttgttcgatgacgtgaaaccaaaaatcgaattgctaaaggaatttgatagagaaaataaaaatgaaggtacagaaatacagaccgaaaagtcaaaactaagcttagcagaaatttactcaaaaaaatatgaagaacaaataattggtaatataaacgacgagcactctgatgaaaaaaaacaactttcagggctctttactgaaataatgtgtaaattagataacctgtcaaatcagtattatgctacaaatttaccaattcttagggattctattttaaatgaaaacactccagcgcttaagactgaagattctattccagtaattatttcgaacaacacaaggctagccccacaagaaataaaacctcaaggaagacttctgaaaagatctgaaatgacgcgtctggaaaaaaaatcagatcgtaattctattaagaggaagataaagaagagaaaagaattaggctctgattcaaagatagatgcgaaattaagcggtaaaataaagagcaaatcgctaaataaaagaggaaaattagttattgagactcatgagcatgagtcattcaacaaacgctttaaatcacatcattttatttcataa

SEQ ID NO: 3210 - DNA, 792 bp, Cryptosporidium hominis
atgtttactttttttcttgatttttatttagcgagggaaaattggtatcgttacccctcagatcagctaattatgccaattcgaatttctcctgaaatattcaacatcgggctgaatttaagcgaaaatgatttaaataattatgataataatcgttttggaccagcatctacagaagttagcgattcaaaaaaattaaaaagagcattgagcgattttaaagaaatcggatatgacttcatttgcgttcctgttaaccaaatggtaaaagataataatgacaccaacttttttagttctaaaccaaaatttctaggacattatgaaatcagtggaagcgattggaatactggtattattggccggttccctgcggaagggcactcaaaccttaatgaggccagaaaattacttgattggtgcgattttattggttatcatgcggttattatttcaattgataaactttcaatacacttcttatctatgatttcttcttttattggacttccctctactggtgttcaaatttggatagaaatagaaatcaatgaaaacaattcaattgatgaacaatggagtgaatggcagattacaaacacaataataaatgcgtcaccaaatacaaaaatagggctttcattaaaaattgatagcaatttatctagaatttcaatagaagattattctcgtttttttggagagcctataaagtgcatgttcataaattatgatttttcgaatcaaagcattcaagctcgtcaatttcagaagtactcaaacactctatga

SEQ ID NO: 3211 - DNA, 903 bp, Cryptosporidium hominis
atgcctttcttcactaatactggatttaatactgaggagtttgagtcacaattacatttgtttgcccaaaagctacaaactattaacactcaacaggatgtaatttgcgcgttatctgaatcaatcatttgtattaaagaaaacactgtaattttacaattgtatatgagagttgtcgaagaatatagtagcagagcaccacctgaacacttaattccgcttgtttacatattgaacgattttgctcagaaatgtaagtctcaggcacattatacatccgaagctttatttaacattttcaaccagattaacttatatcatacagaatatatggctaaggcaagaagatgttacaatatttggaagatcagagaaatatttgataatgatacattgaggaaactagactgcgctttattaggactcactccacctgttccatctgcgctctcatgtggaaatttaaaagaactacaggccttaaattcagaaccatatcatcgggcaaatgccgttaacagtttagcagactcttctcaacgtaatcaaacaaataatgacacttataatgagcctaattacttagaactacaatgtaactcacataatgaagacgacttaaagcttgaaagtcaatacttaacactttgtacaagtgtagataatgttcttaaagatgcagcaagtattagggagaaaagaaaaattattcaaaacatttgctcaactaatagaaaaagtaagctttcttccaacgaaaagttacttaagctaatagaaatggaatgggatttgcgttgtaatatatgcttaaacctgcaagaaactttaaatttacttgatcatttacattcagaagttattataagactctctaatacagtaacaacattgcaaggataa

SEQ ID NO: 3212 - DNA, 1359 bp, Cryptosporidium hominis
atgaaaaataacaatgacaggactatcgaggcttatcaaggtacattgaaacatgataaactaaacgccaatatttcggatatgaatggtacacctttgcttgttcatgaagaattgaatgattttaattataagctggacgaagaacacggttggtatgtaggcgataattcggtatggctttataataaagataatgatgtttactacagcagctcattatcaaagttgttcagacttgaccaagagaaattgagactgattgaaatgagtacaaacttcgagttggaagaagtttcaaacaaagaaattaatattgcgcatgtagaagatgaatacacaccatttttggaaagggggattcatgcaggaaccagcgtaattccgagcccaacaaagaatttggatttgtgtgaagataggcatattacaaagaagcaattcttttttaatttcaacaaccaaactcccagcacatttttttttagcgcacttttcgatgggcatgcaggtaataattgtgttgaatatgttcatcaaaggctattgacaaacatttatactgttttttctcagaatatgagtcgatttagtgacaaaaggtcactttaccgggccgaaaattcggtttgcagagtggataacactcgaattctttcttcttatattgttgaatctctctgtaaagggataaaaaaaggttttgaaattactaataatagttttctttcaattgcaagaaagaacaaagtatttgatggcacaaccgcattagtctgtatcatttttgggcctgatcccatagataacaaattaaagttggttattggtaattgcggtgattctaaacttattcttggatacaaaagtggaaataactcaatttctgcaaaacgcttgacaagaattcatcggcttagcgatattaatgaaaggacaagaatcgaaaaggcaggaggaaaagtagaattttgcaacggcgcatggagagttctggttaaaaaacaacaaaggtatagctttgatgttagtgccaaatgtattggattgtgcacatctagaagtattggagatataaatatgaaggaacctcagttattatgtatttcagatccagagattacagttcatgaaattgacttagaaaacgatttatttttaatattagcaacggatggaatcactgactttttcacagatgaggaattagtgggaattactgaaaagaatttaaagtgcactccgactgaagctgctaatgagcttactaaagaggctgaaaaaaagggtagcctagacgataagacagcgacagtaatttatttccaatggtctatttccgagttattgaataattaa

SEQ ID NO: 3213 - DNA, 1443 bp, Cryptosporidium hominis
atgtttgatactctaaaaattaagttagatggaccggatgcatatcttctcgaggaggaggaaaaggtcaagcgatcagtggtactaaataatatgcttaggtctgcaattcaatcaagaaataaacctgacacatcaaaaatggtagagacatccgaattcattaatatctcgtcattaaagcgcaaaagaaatataagcaatgaacaatttttaagaagtaagcttaattcaaacggtgaaaggttagaatctcgaaagtacaatttttttggagccggaaatgaaaatgatgctcagggtttagataaaataatgaaactgccatgggagaagatccctagatatttatatatgtcttccggagttgatttattctttattcacttaaacaacgaaatagtgcaattagttaagtggctggagctgactaattctgaacatatgttaagaactagagcgctagcaagaataacattaatttctcattccctatggcctggttcaaaagtccagccctttgggagttattatacaggtctttcgctaccaacaggagatttagacgtttgtattttgaatgttccgggagaccctaagagaagacttcgtgaatttgcaagcattttaaaagaatggagactctgtacaggaattgaacttattttgacagcgaaagttcctattattaaatatgtagattcagaggcatgtatttccgttgatatttctcttaaccaagaaagttcaatagatacaactaaacatatttcggaatgccttaaaaaatttagtacattgaggcctttattaatcgttataaagctatttttaagacagagaggtttagatgaaacttaccttggcggtcttggatcatattctcagttctgcttggttttatcgtttttacagcaacattcatcatcctactcgcatattctctataaatcaacaacattagggcatttactatttgattttttggaactgtttggtattgtatttaattacagcagcacagggattcgcttaaaagggaaaggcgagtattttaatagactaacaacaaaatctgattcaacattgttcttggaatctcccttgccacctcataatgatttgggaagaggtgcgtttaaatataatgatgtgagagagtcatttagacttgcatttttggacctagtcgaatcaagaggaaggttcaataaaatatgctcatctttagaggaaacaaaatttaaaagcccggaatactatagtattatctcttctataatttgcacggactatgagctttttcaatgcagagcaagaactgttgataaaacacaactttcaataagcgcatatagaaagcctccgtatatttctaatgaaattatcaaaaaagtgaaattagagatggaaaaattggatataaatgttaatgctacttga

SEQ ID NO: 3214 - DNA, 1053 bp, Cryptosporidium hominis
atgcatattgggagtaaatctagatatattcggattgcaggcgataaaagatccattaataaatcccagattaagtcaatagcaattaatactttgttatcagaaaatagtttcttaatatgcgggttaaacagaaagacatgcgagcattttctttacaacgataagtttgctggaattcctctagaaggtgcagaacctgagatagatgattatggaatgtgtttatttgaagaattagtctataacttatttattcaaacgaaagctatcaaacagtattataaacaacatagaccaaatgagatctatttcaacaaaattaaatgttcgttaattctgattagtggtaaatctgaagattctgactctgagcacatatatgacgtatttcaagggttaaatagtccagttgaggttattctagataatggagtttgcaatctgaatgtacttcaagttgatgtaaatgatccagtacaaatctttaatatgattaacattgcgagaaaacttcaatttgaaaaatcaattgctgaaaaagagatatatcataaattatttatctttgaaattgaatatgcaagctacgataaaaatactgaagattgttatttattcaacagtgtgtataataaaatctattttttggattacaattacaggatacgtgaatcaagtatgtttattccctcaaaacaaataaaatcggaagatatagacaactcagttaactcttttttcagtgatttaactttaacgatggcaaagacgtcccactttttactagaaattgtttccaatgctatttttgatagaaattattccttcatcatttgtgctcaatgtaatgggttgaacttgtttattgacaaatgcaatattgaatccagttcgctttacaattctgccttcagccttcggactaaaataaatgaatacaataattgtgcagatgaaaatacattagtatcattgatcaaaaaatttcacaattatcactcgcttttaaaaaataattttttggactctaaagaacgaagaaaatgttga

SEQ ID NO: 3215 - DNA, 1644 bp, Cryptosporidium hominis
atgaacgggtttcttagctgttttagaaaagaagttattgctgcaagtaattcagaagattccacaaaaatttttaccagcgatgaaactggtataaaacttccgaaaaaatctggttataaatttgaatacttatggtacccacctatttcacaaggaaaattgatcgattcagtcagatatacaattccccaactttcatccgatcttagaaagggcaatcttggaagaattggtataattggtggttcaaaagagtacactggagcaccgtactttgcaggaatatcatcattaaaattaggagcagatctatgccacattttttgtactccagaagctgcagttccgataaaaacatattcacctgaattaattgttcatcctctgtttccttcatatggagaactaagtaaagaagaagcacgtaataaatcgatagatttgatcagaccttggctcggaaaaatggatgtaattattattggttgcggtcttggaagagaaaaagacattgcatttattacagcagaactgataaaaatatgtagatgcctctctattcctattgtagttgatgcagatggattatatgtaatcgctcaacaacctgagttaatatcaggatacaagcattgtattttgaccccaaatttagttgagttctttagattagaaaaatcagttaaaaataaagaaacaaatgatacaaaaaatggtaattcctcgaataacaataataaatcaaactctgatattgaccacggcacaacattattaagtcatatagaaatttcagataaaataagtagggtaaacctgagtactgatagttcaataaatatccctagagttcttcctttaggtattaatgaagaaagactcccggaatcgctgtctccttgcgaacgtgttcccagaactgaatggccatcaactgtcgaagatacagtacttcaaatgcatgatgatggcgaagaaatcaatttattttatcaaacagattcaataaacaaacaaaatattatggtaaataatgctcgagcactctcttcaaatcctttgaatatgtgtttttatgagcatgttttaaatgagaattgtattggagtaaataaaacaaataaaagatgcagccaaaatgcattaaatgattctcaacctacagtaaatgaagaagaatttttgtgcattacaaacagggtatttgaactttcaaaaagtttaggaaatatttgcattgtattgaaagacaaaattgatattataacaaatggtgatgtagttgcggtttgtaatattgctggttcatacaaaagatctgcaggacaaggcgatgtcctttcaggagtcatttcgactctatttaattggagtatgcaatattttacaaaaaacagagaagataaacaaatttgtaaatatcccgaggtaaattctgcatatgggtcatgcttgatagtaaggctttcggcatatattgcttttaaaaagaaatttagaagcatgcttgcatctgatttaattgagaatataccatatgtatttgaatctatttttgaagtcaataaacatgatttcactgaagaagcaagcctgctgcttctttttaatgagcatcaatccctagcagatgatgaatag

SEQ ID NO: 3216 - DNA, 840 bp, Cryptosporidium hominis
atggactattctagaagtttgaacagttatattaacccggtaaataccggtgatagcttatctgctaataatgttggtattactggctatacatttgaaatgcttactacagaaacagactccgtgcattccaatcaatacaatctagattctagaaacaattctctaccatatatgggaatacttagtaattcatcaaataaaggcactctaaaacaggttgctgtgagaatttgcactctattaaaggtgtggaggatttctacgcaaactgatattgccgacaatttaataatggaatatttaggccctattgactcaatacgtgcagcaaatgaccctatttatcagaaaaatcgcgagtcaagtgaaaaaagcataaggagacgagtttatgatgcaattaatgtcctaatttctgcaaaaattatagacaaaagtaataaaaatataatatggaaaggtatttctagcattaatcacatcttatgttcggacaattctcaatcatgtgataatctaccattaatccaacaaaatattcgcgaaaagctcgtcgaatacgagagattacaatatctgtacctttcgttgaaaactataatagagaataatgcaagcacgaaagcaatgaataatggacagaaaacgcttttaccatgttgtcttgtaatagctaattctaaggattcaaatatttcctgtatttataggaataacaaatctgaggttgctattcaagtaaacagcattgtagactttttagaccaatatgagattattaatagagtagcagcatgtataagaatgacggcggtagattccgaccagcttgtttag

SEQ ID NO: 3217 - DNA, 711 bp, Cryptosporidium hominis
atggacgctgactactcattttcgctcacaacattcagcccttctggaaaacttgttcagatagaatatgcgcttaatgcagttaactctcaagggcgtcctgcattgggaataaaagcgagaaatggagttgtaattgctaccgaaaagaaagttgcgagcccgttggttgaggaacattcaattagaaaggtcgaattaattactagtgagataggctgttgctttgcaggtatgcctgctgatttcagagtgattctgaaaaagagtcgaaaaattgcccaggtttactacaatacgtatcgtgagcaaattccagtatgtgaactagttcgagaaatcgcaactgttatgcaagaatttactcagtcaggcggcgtaagaccatttggaatttcattattagtagcaggtttcgattcaactagaggcccccagctatttcaagtagatccctctggtgcctatttcggatggaaggcatctgcaatcggaaaagacatgcagaatgcaaaatctttcttggagaaaagatataaccctgacgtagaaattgaggatgcattacataccgctctcctcacattgaaagagtgttttgaaggagcaatgaatgaagacaacattgaagtaggtatagtaggggaagacaaaaacttcactattctatcgccacaggagataaaggactatttaggtgaggttgaatag

SEQ ID NO: 3218 - DNA, 2475 bp, Cryptosporidium hominis
atgtggggaattaaggagacgccgtgttattcatgcgcgccccgcgatactgttcgatttactcaactgaagattgtcattacactgaataagttctgtttgcgtaataatatgagttttttactacatttactcgtgttttcctgccttattataaacttatgcttcggaagtgaatctactggtgtcccttccggagctactttcgacgagtcccaacttggggacttgaagaatattgatttatcctcttttggagctaatggtggttcatttgctgacgaatcagaggctgttgttgataacattactcctgctccttcaccagaattatctaacgatgatgagaccgctattcaaaaaactagtgaaagctacgagttccaaactgaagtttcaagacttatggatattattattaactctctctattctcagaaagacgtatttcttagagagttactgtctaattctgcagatgcattggagaaggctagatttatttcggttacagatgattcattcctgggtgaacaacaagaacttgagattcgtgtctcatttaacaatgataaacgtacaataactatttctgatactggtatcggtatgacacgtcacgatttagtcaccaatcttggtacagttgccaaatctggtactgcgaattttctagagtctttggctaaaggtggagatttgaatttgattggtcaatttggtgttggtttttatgcatcctatcttgtttcagaccgcgtaacagtaatttcaaagaataacgaagataaacaatatgtttgggagtccagtgcggatggatcattcagagttagtctggatccaagaggtaacacaattaaaagaggtaccaccatagtcctttcattgaaggaagatgctaccgagttcatgaatttttctaaattgaaagatttagttcttagatattcacagtttattaacttcccaatttatatttataaccccgagggagtaaataaatctgaaaaggatgaatctggagagaagaaggagtccaagggtagatgggagcaggttaatgtagaaaaggcaatatggctaaggcctaaagaagaaattactaaggaggagtacaatgggttttacaaaagcatcactcacgactattctgagccccttagatatctacatttttccgccgaaggtgaaatagagttcaaatcattgttgtttatcccatcccatcctccttttgatatgtttgatacctatatggggaagagtggtaatataaagttttatgttagaagagttctaattactgaccatattgaggacttactaccaaaatacttgaattttattaagggtgttgttgatagcgacgatattagtttgaatgttgcaagagagcatgttcaacaaagtaggataattaaggtgattagcaaaaaaatggtaaggaaggttcttgaaatgataaaacagattcaaacagagcaactcaatgcagagaaggaggaagcaaacaagccagacgaagagaagaaaaaggacgcagccttaacagtttatgataagttttatgatatgttccacaagaacttgaaacttggttgttatgaagatgactcgaaccgctcaaagattattaagcttcttaaattccatacttcaaaaagtggggacagcaccgtatttttatctaagtacattgaaggtatgaaaccagaacaaaaaagcatcttttatatttcaggtgaatctcccgctgcgcttttaaagaacccattggtttcactctatctaaagcatgatattgaggtactgttcttaaccgaaggggttgatgaaccatgcatttccagagttccagaattagaagggttcaagtttactagcattgaaaaaagcgatgtaaggccctttgaagaaacagaagaggagaaaaatatgcacaagagattatcaaaattctatgagccattgctcaagttcgtaaaggatgagttccctggcgaatttttaaaagtggaagtttctaaacgtcttgtaagtgatcccgctgtaattacttctggtccttggggacagtccgcatacatgcagaaaattcagaaggcccagacattctcaaataaggcagactataagaataagcatatggaaattaaccctaaccacgctttgataaagaaacttaacgacctcgtcatttcgaaaaataatgttgaggctaaagcacttgccctaaaaattattcaactttctacaattgcttccggatttgaccttgagaatcctagtgaattcgcttctggaatgtttaagatcatgctacagagttcagggatagacgagaaagatgtcattagctccgttgaattacccgaagaagtaagtacagacgaaggtgtagaggactccgatcaagaaaagggatttgatgacgaagaagacgaaaaaaatgaaaagcgcgacgaactctag

SEQ ID NO: 3219 - DNA, 2376 bp, Cryptosporidium hominis
atggaagatgagttattgtccattttaacctaccttgatagatggcaattgtatgacaatattagattttgggctgaagtaatcgacaaattattggaaagtaaggaagcaagaattcaaatatctagatttcttgtaaaggatttgaatttacaggaggcttttaattatttgaaggtagaatgcgataaagcaaaattacaattgggttctaatgaggattcaataaataaagaagtaaatttatatggtgattatttaactattaaatgttgttatttaatgggaagaattgatgaagcagagcgtatgatccttaaaatttgctcgaaacctctgacagagcttgctgatagttgtttaatttcaccctcagtttcaccaaaatcttggaaaggcactccagttacaaatgagaaaaaaaaatcattatcctctatcttttcgacaatttgtatgaatcctacaatgctgataaaatacattcatactggagaattaaaaattccaggagattctgctgggctgtatttatggggaaatattcttgaggaacttgatgccaaggtttctgctttatattgttatgcaattgctctagattggaatccagttttatggaaatcttttcaaaaactagtaggcctatcatgccagtatcctcatgagcttgttaaaatatgttgctgcttgaataactggggcgagaagcatctagaatatgtgggcacaaacagcgatgctttggtaatatcaactgtgtataagaacgaagccgagtgttggcaggtaaaaaacattcaagatgggaatcttctgatatctatatcagataagtctgattcggaggaattatatgtattaaatgtttctgatttcttttataatgttggtgatactttacaaaaaagacatatgctgaggtaccattcatttactaattggttggaaaatccagttaaagacggcaattctggcccaaaatggccatatagtgaatttgaagatgtaaagaatgcaaatcataaatttagttcatcaaatattagtgaaattaattacaattcagttgcgaacacagagaatatagacgaaaacattaaacctctcgtttcacgttttcatccattgatttctatgattcagttgctgtcaaagtttacacatcagatggaatggtatctttgccatagctttctcaaaaatattgaaagtattccaaacaaaatttcggaaatggggtatgtaagagagttgcatgtaagggcactttttgagtcaaatcaatggcaagagtgtataaacgtttgcaaatgtattaactatgaaaccaattataatctttggattaagtgtctcgatatttatagttcatgtttgtggcagttgtccaggagcattgacttaatcaatctttcaaacttaactttaaaaattattgaaaagaatacccctcagctttggattgtagttggaaattgtttttccttgcataaggaatacgaaagttcaattaagtgctttaaaagggcaattcagtatgataaccgctatgtttatgcttatacattgattgggcatgagctttcaattattgagaaatacgacgaagcgatccaaatgtaccaaaaagcgttgaaaattgacccaaggtgccatagagctcactggggaatcggttatgtttggtttaaaagagaggaatactatcaagcaaagagccatttcaatttggcacttaaagttgttccaaataattctacattaatacattaccttggcctttgctatctaacaactcatgattttctctctgcttataatactttccaaaagggaattctcaaagaccaaagaaatccttggttaaagtatcatgcaggaatcgtgttattagagctggaaagatatgaggaggctttaacaatgctgacagccgctcaccgcctcgcttcaaatgaacccaatattcatctatatctaggaaagactttctcacatttaggcaggaaggataaggcattaagacacttaaacattgcatttgacttaactaaagacatcaatgagaagcagatcatattgaatctgatgaaggaacttgaaaatggctcaaatatagagggaaggtactgcaaatcaaacgaaactaatagaagtgggaggatttcgaatagcggcgcaggatattcatcgggtagcaaactactttcttcttttaggaatcaccactacttccctatcaggaacgatccacctaacccgttcattcaccaccagattcaacaagaacacaacatacctcaaactgtaccctctcctgcagtttcaggcggccattctttattactaacattaatgccaggaaataattga

SEQ ID NO: 3220 - DNA, 2211 bp, Cryptosporidium hominis
atgaaagaaattgatcaaaatgtcaagaattatgtttctacctatcataaaacttctggattttcaaggatcgcaaatgaacaagaaagtaacatcaaaaataaatcatttgcgcctattcaaataactgttgaacaaattctcaaggaatcctactctggatctgcaaatagtgtaggaggtaataatagcttgtctagactgcacgaatcatttgatttcagaggtattgatgagttagaagattatagaattaggaagagaaaagaatttgaagacagtatcagaagaaagcgatggaaaattagtttatatctctcatacgctaaatgggaatctttacaaaataatataaaaaattcaagatccatttttgaaagagggattcttataaattatgaaaatgtacgaatttggagagaatatattaagcttgaaattacaaacggaaacattaataatgctaggaatttatttgaacgagtaactcaccttctaccaagaattgatgaattctggattaaatatatccaaatggagcttattctgaaaaactacatcaatgtaaggcatatttataggaaatggattgattggaagccggatcctagtatatatattcaatattctaaatttgaggaggaatgcggagaaatcaaatcagccagaggagtaatgaaagatcttattatatcatacccagatgagagcaactttattgagtatataaaatttgaacaaagacataaaaatcttttttctgccgaacaaataattaatattctaagtgagacattaattgacataaatggtaatagaattacagatctgtttttttcatccatttcagatatctttgttgaagaaaaaaaaattgaggaagctattaaactttgtaatgaaggaatcaaaatattgacgaatgaacactgtattaaaaatcttaaagataagctttttcagttatccaaaatgagaatttatgaaaaacctgatgaaaacatagagtggatcaaacataaattacagaattatcgtgataaattacttcataacccacaagactttgatatattatttgactatataatatttattactcaatacttagaattagattcagttttgcaagaatatgaaaatcttgttttcaatcataatataagcgatgttgttagctgggaaaaatatttgcattcttatttattattgatatacttttttgaaataaatcaagatgttaatagtccaaatattcataaattgtataatagtttcatccaatcaattaaaaataatcagatttccgaaattaatattgctgaattagaaactaaacaatccgaatcaaacatcacaaatgatgaaaaaaataatatatttgcaaaagtatttatatatttttcgaaccatcaattacgtattggagatttaaataaggcaagaaaaatactaggtattggattgggtagagtcccatgtacaaatctatttgatcactatatcgatatagaatttaagcttggaaattttgatcgatgtagagttttatttactaaatacatagaatacgacccagtttccaccaattcctggattaaatatatgcagttcgaatataatctctgtgagataaaaagagttataagcatcgcagaatctgctatttctatgccagaactagactctccagaaattatttggcaatactatatcgaactaatgattaacgaaaaaaatattgaattcgcagatagtatttataaacgcctattagaaaagactcagcatatacaagttgtaataaattattctacattcattatttctaagctgcatgataataaactgaaccgagaattcattttaggaatcttaaataaatataaggaaagacaattggactaccaaagatcaattttactcaaatattggctttctctcgaagaaaaacttgcttcaaaaaatattgatcctgaaagcaatatatggatcgaaattgttaataggttacttccaaggactatattagatgtgaattcaaagaaaaaaacgtatgtttttaaagaagaaaactatgattttgcccacctgatctctgtaaataaagatgatgaagcgcaaactttgcaaacgaataataacgacaaagtgccctcgtcgctcattgatgcagcaaaggaatggaagaaagctaaaatattggattga

SEQ ID NO: 3221 - DNA, 456 bp, Cryptosporidium hominis
atggtaaatgttaatgaattaaatttattgagtgtagactttaatgcagaactggccataaataacttagaaagtgtatttttgccaaagcacactcaatcattagacaacatcagcaaggctgcgttgttacttccctttgctattcaaaaagaattaaagttattcaataactgtagcacctcatcagaaaataatgatggtgagaacttagataaaaatataaataaaacaaaaagacagcttaatgttattagaaatattgaatttaaattaaatttaaaaaaaaaattttctgataaaaaaaagatcttcaattcagtttcaaacaaaataacagataaattttccattcaacccaataaatatttcttccaaactgaagaaaaagagaaaaatgatatttacgactatttgacaagaaaagaggtaagtatatcatgttattttcactaa

SEQ ID NO: 3222 - DNA, 2007 bp, Cryptosporidium hominis
atgacacaacaaattgaacattatggaataataagtggtaacattcttccagatattgatattcaaaacttgccttttaaaaaaggaaagctggtaacatcagatattcgagaatgctcggatgattatatttgtaaactttatttattattaaaaaatgttggaataaaaatcacagaatcgtttttatatggaataagtggtccaaacagaaaaacactcaaagttccattctgcaatggggtaaaagccagctcattcaactatttcttttttaatagtccaaacttagagattgttgatttaagcaattgttaccaagtaaataatagagtaataaagtgcataatttccaattgcaaaaaattgagagagctaaatatttgtggatgcaagttggtaactgattctgcttttaacacagaattcttctcgccaactggattatgtatgactaatttaaaagtattaaatatacaaggttgctcccaaataattgatttgcaaagcataataaaacgaacaagggatttagaatcattgaatatttctttctgtagaaatataactatttcaacttttgaagatgtaattcaatgttgtatcaatttgaaagagctagatatttcatcgtgcgatgggatcaatgattacaactacgaatttaattatagtgcaagcacaaacattgaaaaaatatctttgtcaaggtctaaattatcaagttctacactgaaaaagatcatttcatccatggataatcttaaatatcttaatttgaattacaatgtcaatgtaaatgatgaagtatttgataaaatatcatcaaagcttatgaaattaaatactttatgtttgagaagctgcgcaaatatttctgataaatcttttttttatttaggagaaggtttaaaagaacttgaacatttggatatttcatggtgcccaatgttaacatccaaaactctaaaatatctagcattgagatattcaagaaataatgtaaaaaaattaaaaactctcaaattaagtcaaaatacgaacttagggaatttttttgaatcagatgattattttaccgatatgattaatgattacagaaaaaaaatacccaggttatatctagataatcagtgtgagtcttcaaatgacgagatagatcatactcaaacattaaattccacaaagtatgaacaaaataatatttctgaatctcaaaaaaacatttttcaagacaaaattctggaagaatgcattgttaaattgatacaacatgcaaacgtaaagactaaactagttgggggtggccttactccattatctatgtgtttattaataaaatataattgcgaaactctagttgatcttgaattagaaggactaaagaatgttacaacaagcgatgttttggaacatatcggagtactttgcagaaatctaaagaatttaagcataagtatttttgagaacgatgacttatgtattgagtctttcaacaaaatttgcagaaaatgtacgaatcttagctctctttccttggacgtttctaatgttgagtcaagatatcaccactcatcaatagtcgattgtatttcaaatggagattcattattaaaattaaatgaactaagcattgctataaatcctaaacttggtatttcagatgaaaaccttgatttactttcatcatgtaaattccaactttcaaaattgagaataaaaaattttcagggattttcaaatgactattttaaaaaaaataattcaaaatttatacaactcttttcaagtgttatagagataagtttatcagggaatgattatgcaaatgatgatgacgtcattttattgctaaaattggttaaggttccaagttctgttgagttaatcaactttaacaatatttcaatggacttgccaaagtatatttgggaaaacttccaaagtattaagaaactgaacgtattcaataacaaaactaaggtattactagaaaggtttaattag

SEQ ID NO: 3223 - DNA, 2202 bp, Cryptosporidium hominis
atgcaaaacatactcaaaatggcttcagaacaaaagaatgatgaaattcaacaggaggattcttgggcactgattggtacatatttccgtgatagaggattagtaaaccaacagttagaaagctttaatgactttataatgtacaagttacaagaaattgttgacgaacatccgcctatcattattactcctcaatcacaatataggccagatgaacaaattgatacaaaggtacgatatgtccttaaattcggacaactttctttaagtagaccatcagttgaggagagagaaggagtagctagaggattgtggcctaatgaagcacgtcttagaaacttaacatattctagccccgtatttgttgatgcagaacaaaaagtttacaaactagaagacgatggttctgaaactttagtttatgagacagtctactctaggttaccgcttgcaaagatcccaataatgcttcgctcagaatactgttggactcataatattagtgagagagaacttcaaagcgcaggagaatgtgtgtatgatcaaggcggatactttattatcaatggcatggagaaagtattggttgggcaagaaagaatggcaaataattttgtatacttatttcagaaaagtcaaccttcaaaatacacatggattgctgaaataagaagcaatagggagggtatgcaagctacttctggattttctgtgaaacttagagggtctgatggcaaccaaggccaaattgtggcaacattaccgtatatcagaacagatatccctattgctatattgtttagagctcttggagttttgtcagataaggatatcctttctaggtgcgtttatgacttcaatgatactcaaatgcttgcattattaagaccttcattggaagagacatttgaattttttagccaagacgtttgcttagattttatcggtaaaagagggcccactgttggtgctgccagagaaaagcgtatccagtatgcgaaagaactttttgaaaaagagcttcttcctcatgtcggcgttacaagcggcagtgaatcacgtaaggcatatttcattgggtacatggtccataagttgtgtttaggagcattagggcgtgtcccagaggatgatcgtgatcattttgggaaaaagcgtttggatttggcaggacccttggttgctgcatcctttggacaatgttttaggaagatgatgaaagacgttcgtaggctacttcaaagaaatattgacaatggaaaagagtttgatgttgcaggcgtaatccgctctgcatcatatattacacaaactattcagtatcaatttgccactggaaattggggaaaggacaaagacggtaaaataatcagaacaggggtctcccaagtattaagtcgacttacttttacgtctgcactttcttatttaagacgtttgaatactccattaggacgtgagggtaaatttgcaaaacctaggcagcttcataatactcattggggcatgatttgccctgcagaaactccagaaggacactctgtaggccttgtaaagaatttggcactaatgtgtgaaatttcagttggatatagaccgtatgcaatcagaacatttttggatgaatggggcatggattctattgatgaaattcctcctgaaggaataaaacgaaaaattaaagtattcctaaatggaaactgggtaggctgttttgacgactcagaggattcaatatcaaatttaagaatgattagaaggagtggtgaaataccgtatgagacttccatagtattagacgttgtcaacagagaagttaagctatttacagattcagggcgttctatgcgccctctttatattgttggcgaagatggggacttaaaaataaaaaagtcacacattaactcgttactaaacgaaaatccaagttttgatgaaaaaatggaggatgagaaacatgattatacatgggatgaccttgtaaatacaggaattattgagtacatcgactgtgaagaagaggaaacatctatgattgcaatgtttataaacgatttaagaattgacagaggttattgcagtacctacacccattgcgaaatccatccatctctcattttaggtgtttgcgcaagcatcattccattccctgatcataatcaaagttccaagaaatgtttaccaaagtgctatgggtaa

SEQ ID NO: 3224 - DNA, 1368 bp, Cryptosporidium hominis
atgtataaatatataaagaacaatgaattaaaaaaaagtttaaatttattcaaaagatcaataacaattaccaaaaatcaactagtaaaagagtttttagttgatttggatgctagttgtattcgaagcgaaattttttacccaataagaaatctataccatccacccattgattttataaataaaaataacccatcagatgcattatttctaaaaaaaaagaaaattaataattggaacgagttaaataaccaagaatggggtaaaatattgcaaaattcaactaaatgctttagagataatattgctaattacattgttaatgatgatcaagatgagtttatgttgaatgagaacaacgcacaaagagatctcctccaatctcaacttttagaatttattccgaatgaaatgaaagatattgttaaatatgtttttcagtcggaaggaaaactaaccagacaaaattatttatctgctttagttggattacttaaatttgcaatgggcgttaatcattcacaaccaattggctcggatcaccgtatgcttattcattcaattcaattaattcattctgcctcgcttcttcatgacgacatacttgataattcagaaataaggagaggaaaaaaagctccatacaaaatatttggtaataagagaacgatactgctaggcgattatttattttccaaatcatgtcttaacatctccttaatagaaaacattaatgcaatgaaatgtatatctattatagcggagaatttagtaaagggtgaattctcccagttgaatggattaggaagcttaattgaaagtttgaataactcgaaagacaggaaaggtttggtcgaaaattattttgaaaaatatttattaaaatcctactataaaactgcatctctcttttcatttggaggaatagcatgctcagaattattaaagaaggcctatggaaacaaattgcgaatggaaatgattatttattcatattacatggggttaaattttgggcttgcatttcaacttatggatgatatcctagactttacgaattctatatctcaagtgaattctggaaagccatttttgaatgacataaagcaaggtatattaaccattccaatttattttttacttctcggggaccaagaaagagcaacaaaaatattagttaatacaaatgtccataatagcgataaggctgaaattttaaaagatcttgttaatatattatttgatacaaactcaattcaagctagtattgtgtgcgttgcacaatacctggaaagatatatccacttcattaatttaatttcgaagtctgaaagaaatattttttcttcatttttagttaaaatggcg

SEQ ID NO: 3225 - DNA, 1020 bp, Cryptosporidium hominis
  misc_feature (684)..(684): n is a, c, g, or t
  misc_feature (691)..(691): n is a, c, g, or t
  misc_feature (695)..(695): n is a, c, g, or t
  misc_feature (698)..(698): n is a, c, g, or t
  misc_feature (714)..(714): n is a, c, g, or t
  misc_feature (720)..(720): n is a, c, g, or t
  misc_feature (722)..(723): n is a, c, g, or t
  misc_feature (735)..(735): n is a, c, g, or t
  misc_feature (743)..(743): n is a, c, g, or t
  misc_feature (766)..(766): n is a, c, g, or t
  misc_feature (806)..(806): n is a, c, g, or t
  misc_feature (861)..(861): n is a, c, g, or t
  misc_feature (909)..(909): n is a, c, g, or t
  misc_feature (1015)..(1015): n is a, c, g, or t
atgcttacttcacaccaaaaaaaatttcatgattggtttttgtcattcaaggactcaaataactataattcgaagcaaaatcactccataaaagatatttttaatcggtttaatcattatatctacaatgatttaggaattcgaacaattgcttcagattttgatctgacaatgatgacaaagcattcaggcggatatattgatccattggataatgatgggattatattttctaaaagcctatctaaggaattcaatgttttcggaatgcaggcagaaaatgtaaatatatcaataagtgtagtaacgttttctgacccattgctgattccttcgaatcaaagagagagatttatttctggaagaagaatgattgagcattgtttaaaagaaagtggtgccgagtttaaagtaaagaattactattgcttttatccaaagatatggcaaagccaagacctttattcctcaataggattggatgccccaatgccgctctttaagaaatatcacttattgcaagttgcatctgcagataaacttttgccaaatcaaatcctgttcattgatgatgatattagaaattgtaaacaagcactacaagatggatttattgttcttcatgtagaggggaatgcagggttttcgttaaaaagtgttagtgtaggtttttattataattangtattanatgnccnccctcctccccccccncccttncnnctttttaccccncccctccnctttttttctcctctccctcttnctctccccacccccatccccccctctcccccccttaattnacacccttccctttacccatcctcactccaccccccccacacctttatcaactancaacccccacaccttatcttcctccatcccatcccccctcatttaaancacacaccttcttacctcttctctcccccccaccactcacctatattcttaaacgctcccctttcttctctttttctctttacacctactttccctacccttctcncataa

SEQ ID NO: 3226 - DNA, 1434 bp, Cryptosporidium hominis
atgcatatttcacatcgtgaactggatgggtttttagaagaaatgtcacaaatttgtcatttgttttataaatttaaagtttatatgaatgatctagtcaactcatttacaagtattaattctcaaacaaaaaatattaagagacccgagattaaagttgaaaacgaacaaattccaaaaaaaaataatctttttatcaggattgatgaaatgagcattcaatatgtatcatgtgaatatggatatgttatgtattctattaatcatgctcttaatacaactgacgaagtttcatgggaagatctagattcgttgatttcaacattggttgaagacgtatttttcttactacataaaacaattaacagatgtatctcaattggaaatattaaatctctaaagctgataattgttcatctaaatcatattttgttaaatgtgattaagcaaaaaatagttcaaaaccttcaaaattcgagagcgaattatgaagtttctctagggaatagcaatgaaagtatttcaaactttacgttaattcatttattagaaataataaaacagaaaaatgaaaattgccgaaatttatcaaattctatgtattcatggactcattctctaaataatttgcaagcttgcatagagaacttagaaatactttctggaactattacaagagactttgaatctagctatagcgacctaatatatttcgatatctgcataaatgggattatcctattggatgatgaattcaaagaaagtaacgaattattagaagataaaaacgctacaatcgagtacattaataaaactatagagcaaataatttctgaatttaaggtaattcacgatcactattcaaagatatcactacaaatcctaagcaaaattagtatttctcccatattaatccagctacacgaggagatatcatttgactttactgaagatgagagcaaagactattcattaaaccaatcttttataccatcattgacatcttctcttaaagtaataaatgaacatttgaaaaattactacaacaatcaaagttcggaattcatcctttctcttatgatcgaaagaattgtgcaaaagattgagcatatagtaattaactatcctgaaaagaaaaggttcacaatttatggcgcccttgtatttgaaaatgatgtccgtaatttactatcatatacaaactcccttctatctataagtattcgacataagttcttaaggctactggaaatttgtgatattttaaatataacatctcttgatgaactttctgatttattactaactgatttccctagtcgaaattggcacctggcaaaatcggatattttgaaaaccttgtttctaaaacaagacattgatcatgataaacttaaggaaataattaagaaatctagtcatttctttaattaa

SEQ ID NO: 3227 - DNA, 372 bp, Cryptosporidium hominis
atgaaaataacaaatatttcaaagttatcatcaaatgagcgtaaagacgctattaatgaagttaaacttctgagtagcatccggcatccatatattgtatgctttagagaatcgtttgttgaagatggatttttgaatatagtcatggagtatgcagatggtggtgatttattccgtaaagttaatgcacagaagcagttaaaaaaaaattttcttgaaaagcaagtcgtcagatggcttacacaagctttattggggcttgcgcatcttcataataaaagaattttacacagagatattaaaagccaaaatatatttatttcctacaacggattgaaaataggagatttcggaattgcaaaggtaatttaa

SEQ ID NO: 3228 - DNA, 282 bp, Cryptosporidium hominis
atggaatacacatgcgaagttggaaaaattcaagaaattgatattaatggcgaaactgaaggaaatcatgtttctaattgcaattatatcataaattgcaacaaaaaagcaaccaatgggtcaaagaattcatcagatgctcaaacctccacaacagcttcatactcttatgatgacaaggattccactgcaaatacaaaacttaatgaaatatataaatcgaatcctactaaagattattcagttaacttgtttccatttcaagtcgaaacagtaatttag

SEQ ID NO: 3229 - DNA, 339 bp, Cryptosporidium hominis
atggatacaatctcaaatattaacacagaaaacgatagctcacagcaagcaaacatttctcattctaatgtagaagagtctactcaatcattaaaattcgtcatgcaagacgtgcaggagcacttcaagagagcatcgcaaacaatactaagtcgaatcgatgaaatgggtagccgaatcgatcaacttgaatttatgctcaatgacttaatatcggaagttgaatcatcaagtccaatgaaggagaagacaactcacaatcaaaacgacctaaaccactctaaggcagaagttaatgatttaatacctgttgaaagcacggaacaggttaataagtaa

SEQ ID NO: 3230 - DNA, 1791 bp, Cryptosporidium hominis
atgatagacgaatatgcttataatttcctttttccattcagtttggttggatcttcaggtaccgctgtttcaggtaggactaatgatcgattcgatgatattgattcatcatatcattcgctggctaatctacgtaagtctgagatttgcacttacaagtcgattttaagaaataacagtaacttaaccaattgcgattactttcgaccgtcggtttcacagcctagtaattcacaaaaaagtatgcatgatattcaaacaataaaagattcaagcatttattctgtcactgatgaggttgacaaagacataaaacctactaacactgaaccagggtttatcgttgctctttcatcctttctaacacaaatcgctacatcaaattcatcaaactcatcatgtaacatcggagttttgacgccgtttcactcagtttgcataccaccgattccaattcgagcatatttaattagactggctcaaaactttggttgtagcaatgaatgttttgtattggccattatttatgtcggaagaattatcaaatttaataaaaactttactataactttattgaatgtccatagaataattgttaccgcacttattctagcaactaagttttttgatgacatttattatagcaatgcattttatgcaaaaatttcaggtgttggaactcgcgaacttaattcactcgaaatccactttttgagacttgtcagatttcaactttttgttactgaacatgaatatgaaatttataagcgttgtattttgaattcagcatttctgcattcaacaataccttctttacctgtaagtatttttgataaacaggtttctgatgaattaagaggcaatcatcgactaaaggatattagctttatgggagaaagaaaacgcttatcattacaaaattctttcccatataactataattaccctgctgtttataattcactacttaatggggaaaaattcgagagtcgcgacatacaatctatgttaattggtgattactctttaaattcacaagctcgctctactggcaatttatacactcgaaaattaaattcttttaattcgaatccagagctatcgtcgaactgcgatttttgttcaaatcagacatctgaaattattaattcggaattagcaccatcttcacaatgtgcgcaaaattgttatggcctcctctccgaaaagtgggtttcacaaaaacttacttttaataattctggctgcgttcatcaccaaattcaagaggaactttgtgctgatcaatttcgtggcctagttaaagatgagggattttcacgtaaagttaataagacttcattctcatctggttctaatgtaagaaacgactacctttctataaatctgaaacattcgtcagcttttaataacgggtatgcccgtgcacaaacagataattctgagcgtgcatataacgcaaatttgaatacctcgatctatttgacagccgaaattcaatcaagcgacttaacacaacgccgaatcgaaggttcagaggttcaaatacctaacgtgcatccagagtacaaaggtatagttaatttgaattatagttcatactccaatgattctggacattataattcagtgaatgcatcagatattaacgtattatctacgacaggcgttataacgtcatctgcagtgaccttagttaatccaactgttaatcgttatggacaacatatatttatgaatccttataatgtccgatgtactactggaatagatcgaagattgcttgtttaa

SEQ ID NO: 3231 - DNA, 2451 bp, Cryptosporidium hominis
atgagtgcgaaggacgttaaaggtttaactcgtaaggtttctggaaagtttatatttgatgcaaaaacagcaaagggttcaacagtttggtgtgactctgcaccatcggtattaaacgacccagatagtctctttgcgaagtgtattgttcaagcaggctccactgcagagaagctttccttaaaggaagttgattctaatgctacttttgaggcaaagatagatagttgttttatagccaatgaaccttttgatccaaatacctatccagatattggtttagtcccatacacctctattccttgtgtattagactttctaaagcagagatacctcgtaaatcaaatatacactactgctgatccattactagttgcaatcaacccatttaaagatgttggacttgtaggaaatgatgtgattttaaactatagagatgcaaatgatatctcaaaattaccaccgcacgtatttgccattgcaaagagggcatttgataatattatgtcagtttcaagatgccaatcaattttggtttgcggtgaatcaggtgcaggaaagactgaagcaacaaagcatgtaatgaagttctttgcatcttcgaagagtggaacaatggacttgaaaatccagaatgcaatcatggctgcaaacccagtccttgaagcatttggaaatgcaaaaactacccgtaataataactcatccagattcggtcgttttatgcaacttcaattaggtaagatgggtggtattgaatatggtgtagtacgtaacttcttgttggaaaagtcccgtgtaattacacaagaaagtcttgaaagaagctatcatattttctatcaattaattaagggagctgaaactgttcctggcttgaaggagaagttaaagcttaagagtttgaatgaatacaaatttattaacccagaatgtttagatgttgaaacaatcgatgatgttcaggatttcaaggatgtcatgcagagttttaaaacaatgggtctctctgatactcaaattgaggacattctttccttagtttcaggaattttattgcttggaaacgttgagattgagccggaagatgttggtggaggagtcgaaggatccagaattgcggattcaagcagagaatctttcaataatgctatggaactctgcaaattggataaggaaattgtagagaaggaacttattgtcaagatttcttatgctggtaaaaatgttattgagggaagattcaggccagatgagacaagaatgctcaaggattctcttgcaaaaggattatacgacaaattattcgattatattattttgaatcttaacgaaaacattaagcctccatccggatttaaagtgttctgtggaatgcttgatattttcggttttgaagttttcaaaaacaactctttagagcaattcttcattaatgtaactaacgaatacttacaaaagaacttcactgatatcgtatttgagaaggaacagaatctttacagcagtgaagggatctcagcagccaacttagagttcaagtcaaaccagatggttctagaagctttatgcgataaaaagaattcaattctttctgcaatggaagatcaatgtttagttccgaatggaagcgatgaaaagtttctatctgctgcatacactaatcttaaaaacaatccatgtttaaaaccagcaaaaattggtagtgatgtaaactttattgtttctcatacaattggagatattcaatactgcgcatctggattcctgttcaagaataaggatgtcttgagggctgagctcgttgaagttgtacaaaaatccccaaataaattagttgcagatctattcaaggatgtctttgttgaaagaggtaaaatggccaagggacaattaattggttctcaattcatgaactctttgggatcacttatgtccattgtcaatgaaacagagcctcattttattagatgtgtgaagccaaacgaatcaaagaaaccactggactggttagcatctaaagttttgattcaattacactcactctccatcttagaagctttacaactccgtaacttaggtttctcatatagaagaacattctcagagttcatttatcaattcaaatactgtgatatgtcagctgctaatgataaaaagacagatcctaagatccttgcggaaaagatgttatctggtacaaatataccaaagaattcatgggcaatcggtaaaactatggttttcttgtctaaagatgcagcaaaaagaatggcacaactccaacgagaaaaactcgctgcattcgagccgcttgtacaattattagaagctgtatatttgagatacaaactacgcagggaatttagaaagaatcaactaaaaccacttgtgaggatccaagcgcaattaagaagagtgctagatattgaaatttcagtaatgaattaa

SEQ ID NO: 3232 - DNA, 2193 bp, Cryptosporidium hominis
atgttccatattttcaagatccatcattattacctagtatttttgcttcacatagttctatatatatttttgaaagaggagatactgaaatggacaaaaaactatccaatttgtgcgttgaatacttttctagtcacttccactttaataatgattatggaactttcgtcattctatggagactcaacagaaaaagaccgttcagaacgaatctgcagtgaagttgcaaatatttgggagccaaatcttccatttatttttggagaaataagaaagatctttttaatggagtttatacgtagaattaaacaagatgatgcaaggtctggaaataaattaatttggccaagtacttcagctagtttaattacagccgactggcaattgatttccaaaacatcgagttataatcaactaattaagtctaatagctttgttggattttataattaccactacttttgggacccagcattattgttgaatgcattttattctcaagccgaaatactaagcatttattttgaaaaggaattcacggaatatatcattatagaaatatcacaaactccacttattgagcttgggtcatggattagtactattcattcgcctctttactcaagaaaaaagttgattacatatgatatgattaatcgtcttttgatttctcagatttcttctaaaaaagcaactgatttaaaaaagctcaatagcatcaaaatagatgaagatgaaataactacattttataaatattgctttaattgggtttcacaaatcctcatatattctaaagaagaaatcataacattttgcaatgatttagagaaaaaatatggaaggacagtgatttatatttattctgtaagccatcaatttgaactgatattcaatacaatgcagttcttggttgaaaaacatcctttgtcggactattctaatcatttaaatatgcagaaaagtatccacaataatattaaagatcagtttactgaaacactatttagttttggagtaccttcaaccacagaagttagagccttgaatggaactatagatactttaatttatattgatccggaaatggcgaattattcatttttaaaacttgcaccagttgaaatgcataaagatctccaaagcaaaaacttattaatctactctgacttgattttctttaatacatacgttattcgccgtgcatttcaagaagctatggcttttcttcaacttgaaagtatggtggatataaaactcgattttaataaaaataccaatttatctgatcttgagtcaatgtgtaaagtttggaccaatagccattcaaacgaaataattgttcttaatcccgatgatagtcaggtatttgagtatagtgtcccagtcatggaatatccgacagatgttgacggaacagtaacaattgacataaacgaccaaattaaagaagatataataaaagttatatgccaaacgtttatcgatctaatttcacccaaccacttccttttttcaattaaagataaaaataaaatacactcaaaattactcgaaaaaattagtgctaattctaaaacagctccaaaagacaaaattattggatggtatactgtttcaaatatcgtaagtatgtgggccaaagactattctttaagcgtagggcctcacattttccatcagttgattacaaaactatctgtaaaaaatttgaataaattgaagaaatactcattttcagatttttgccaagaaacagaaattaatcaaatcaaattctttttcaatccagaaagctttattaaaatgatgatagactcggcatatgagattgggtatttattaattgtcaacgtaattcctgatggagacttggttgattcaggaaaactcagaattaaagtgagtgagattttatcaaattgtattgatctaatgttatcactaattagtggaaagaacatctcgcttttgaagatagaaaacaagttaagcgaaaaatctcaaagtattgatattaaaaaagtttctgagagtgtttgtgaacacatggttacaaacaacaggaaaatgttcagaaactttgtggaatcaaaatcaagtagaaaagatgcagtaaaagatctttactataggatccaaaatataaataaagaagatggatctacgtcgtttgcatttatatatgaataa

SEQ ID NO: 3233 - DNA, 2631 bp, Cryptosporidium hominis
  misc_feature (2593)..(2593): n is a, c, g, or t
  misc_feature (2600)..(2602): n is a, c, g, or t
  misc_feature (2615)..(2615): n is a, c, g, or t
atggtttatataaacaaagaacgagagaaaagaagtttgagtagatgtttgttattaatcattttactagtaattctagaaatattatgcgcaaatggggaaggaagaatatcctctgaagaatatccatctgggttagataaaaataaacaagatgaacatttagttaatgaattaattgatacaacttcagatctgaaatttaaacagattttgatagagaaaacttgcggtgagaaaggaacaaattatactaaggatgggctgaaatttattaaaaaaaatctggaagagttctcgtcaaatgaatactacagactgaaatctttgaaaaaattacccaaaatttattctggaaaaaatgagaaattaatgctaagatcttttaagggaggcgaaattcttggctcaccattacggctaagatcaagagtattaaaggacgaattttctatcccagttattgaggatgattttgccattttttcagatgaattagattctagtattaatattatttatcccagggtaatgaatgaaataagatatacagtactcttgtgcggcggcggattagttactatgctgcctattgtcagatatatgaaattgttaaacagttatggagaatacatgtctaatgaccgcataattttgcaaggtattggcatttatgagagagaaaaggcagagtctcgacgtaggagcgctaatattgaggcaaaatacttgtcaacattgccatattcagatgaaatatataccggtcagagcattaaaagaggtggaattatagttggaatatctgattctataaaagaagaacaggatttaatgaagtcaattcttagtaagcaaaatttggatgatggataccagggagcagttttaggattaaatatccgtgcaaaagaagaattgtttgaaaaaaacagagagaatgctatgagtgatgcacaagggcatttcgtatacagctctgtgtttgattttgactctccaaatgcattgtttactatgtttaatgaaaatttatcgccttttaaaaatactaatatggaattcatggccagcaatagtaggaacaaaatacctcaccaaataacaagggctgagtcaattaaaaatacaacaattaatagaataaaatccaatttgatgggattggataacaattcaaatgaatactcttcagaaggatcgattgagacaggagctattgagctcgataagaaaaaaggggaaacagttttgccttatgatgacccagtcaacccagaaagtattataattggaaagagaattaggccaaatgatcaaatatcaacagggtcagcagaatatcaagcgagattaatcccagaatcaaagctagcagcttccgagcttgaacctattaaaggatttccaacaaatgataaagttgataaggttatagtcgaaataattagtgagctagaaaatcaaaattatatcaacaatttaactaatttaaaaacgtcaaaaacgtatactgaagcttatagacgtttccctgcatatgtttctcaaaagaaaataatacctgttcatgatcaagcatacattttttgggagtctctaagattctcgaatagtattatggataaaaaacatggagttaatgtctctaacttcccagaaaaagcaaatatacccagcgataagattttgccaaataaaataccggtaacaaataaagaaattaccagaagttgttatagattaataagatattttcaaaaaagtggtgttccctttatcttcagggcagcatcaaagattcaaggaagtaaaaattataacgtaaacttcgttgatccagcgaagtcggagtacaatcaagagtataaattatatgcaaaaatattatgtaaccaattgctaccggaaattttcgtatacacattccacaatgtatttgaacttctcatttctaaacgagaacagaaatacttcaatgaattggatgaaaagagattggaactcgaagtacagcagaaggaggcagatgccttaaagaagatacgagagtcagttatctcaagagcacatattactccatatattgtcgaaaaaccatttgaaaggtactttaatgcttggaggagaagctttgggtacaacggatttatagtatatccccgaataaaaacctcagtattagaaaaaatgtacaatattgccaagtttggcccgcaaattatagagaaaaaaaagaagaatgctactcctgatgaagtcagaagttctatttcaaaagctcttattagaattattgacgaatactttgcaaacttaaatacattggatttgttcttgaatagagttcaagttgaagagtttattaatggaacattttcaaacttatttagtattgcaattagtgagttaattaaaaaaatgccaattgcccccgaaatggatattaaaagccatggaaacagttttcaaataaaagagttatttgtgagttgtactgattatattaaagcaatattaaattttaataaaaatataaataagatttctgacaatttgggtttggaagataatcttagtaaaagtggttctnaaaatcnnnaattgaaagtacnactgatttttcattag

SEQ ID NO: 3234 - DNA, 2688 bp, Cryptosporidium hominis
atgaaactagatgaattatttcacatatcattacttattctttatttcttaattttcctgggaaatgtgaagtctagttcaactgttacaaagaaagatgatatggataaagaagtcgcacctggactacctttattgaataatgatgaagtttatagctggaatacacttagggattatgttgaatattatgaaagtaaaattgaaatcattcgagaaaaatacccttctctggaggatcatttaataaagagtcagtggttttctataatagatgttttgcagtgtgaatatgaaatagaacaggagaaaacattgtttcctcctagaataaagattaaaaaccttccaaaaattataaatgatgtaaaatctttgtggaaggaaaaaaactttctttcagtttccttggaaaagtctgaatttatacaaagatgtactacagcagttagaaatttaatttttcataaaagcattcaagtggaaacttatgataagagcttattaaaaagtatatgcaacgattcttcaataatgttttttaatcctgcaatgctttacgaagagttgaaaacaaaaacggattatgacaaacaaagaattcctatttcaggattaacatgcatagataaacataggattcgaattgggcaatggtctgcaattgtgcatttacatgctcttgattcagaagatggaagagatcgaatttttagtcaaaatgattcaatggaacaagatttccttccatattcaccgcctgattcatttcatacagaaattgaagctgaaaattttgaattagtatgtaaggaaacactgtcagactactattccagagttgaagataagaacgtcattttggaaattttttgcaaagatgctaaggatatttattacaatcatccactcgaaatacacgggaaatacgcaatttatggtacttcaattgaaaagctcaagttaaatgagattaaaaagaaggcaggcagaatcaacccaccatctttaatggcacttaatctaatggaataccgctctttaagaattagtgagtgggtagtaatcgttgatcagcttgaaatagacaagaaatctaaacctcgttatgaccgtatagttggaaatatttcaatagatccaagaccatatgggtttattgcatctttaaattctagagaatttgaagaagcatgtataaacgcactaatgagtagagttaagcaacaggaggagataatgaaactgatacataattttgaaatgaatcccgaaaaaatggaattagacgaagtaattgaatgggagcgtcagtactccatagaagtcattgaaccagacactttttgtaaggatgcagcgggagtttatttcggtattagccgtgattcatttactgtaatgagagagctaccgttaactaatcctccacagtttattgacccggggagaggattattaaaaagtgatttacctccaaaggttttggacttaaatagtgagagatcagctcgtggatctgagagaatcaatgatattgattggagggttgaagcatctagctttctttgggagagtttaatcaaatcaagagttcattctagaattgaagatgcaataacaaatattcagtggcaagcaataaagcagcaagcaaatggatttgtttttctagatattggaattgatggattttataatgggatagaggacccaccaaaaagtattttttcattttcagatgatccatttggaatgtacagccaatgcttgcatgcattttcggaatcaaataggaggaagaccaatattaattactttgataaactaccgaaatttgattataagtggacaatttctaaaaatatatcagagaagttgcttaatcgaggaataaattccgaaaactttgaaagtttcaaggagtattcaaatccagtcaaacagtctttatgtatggaagcagtaaaggaatactttgagagtgcaagtgactgcccaattgttaatgacgaaatagagttaataaaattcagtgtaaagaatgcgtttccaaataacccctttccagacgcgaaagatccaatgattgcagatccagacggagaacttgaggctaaagagcagtggaacttcatttatgaatattctttacagtctcgtaaccaaaagctgacgaatgatgatttcaatgaaaatattataattgtgagtcaaaaaatgcctctttcttatttagaatttagaaatttagactggcgtactaaacatgaatgttatcaagatatggcgattaactgtattcagtcttcatggaaaatggtggaatttaattggaagaaccaaaatgttcaaacagatcttgcatctgcattagccatattttgtgatagcgcagccattctctattttgagagaaaaaaacaatggaggcaattggttaaacttatggaaacaccaaagtattcgtctgctttttattggataagaaggggattttatttacccaggtcttacaatctactaaaaatatcaatcaataatggtaaagagcgtaagataagcgaagaagagttggcaatttataaacaatctctggcaaatagcatccttgagttggtaaaatatagatatttggctccacttactgttgatattgaaagaattatgtcattctcttgcagttga

SEQ ID NO: 3235 - DNA, 588 bp, Cryptosporidium hominis
  misc_feature (542)..(542): n is a, c, g, or t
  misc_feature (576)..(576): n is a, c, g, or t
atggttttggaagatgaaaaagaatcaaaaggcgaaaagtaccttgtaaaagattattcacttccatcgacagaaataattcatagtattattaagtcttctgaatactataaaattaaagcagattgtattcctcattttggctatacaataggaagaacattaagcgaaagagatttaatgagaggggctagatttgtttatagatgtcttagaatggatggccactttgtcactccacagactgcatatagaatttggattagatctcaatttttacgccgagataccccgaaagttccattttctccctataaggaggaaatgaagaggtttattaagaaaagaagggacggcgataaccagatttattgcccaggaaaatttcaagatcaagttgacgagatggctgatacaatagctactgcaatatatataaatggtgtcttccctgctgataaaatgatacacatttgtaaaattgcaaaagaatttatatataaaaagattgacaccattactcaatgtgttaaggcatttangggggtatattcccagactaaatggggattatantatcaatcataa

SEQ ID NO: 3236 - DNA, 1812 bp, Cryptosporidium hominis
atggaactagtttgtttgctcacaaccctttttatattcgttcttaaatttgttgccatagcagcaaaccaggacaaaaatttaacaaaaagtgttgcttcaagcttacccttggttgaagtatctagaatttcaaaaattgcaacaaaatatgtttctggtgcaaatatacctgaagtagttaataagcctggctggggagctaagatttctgtaattaataattataagtcggcaatgttcagaagacaaatatggtcacaagtgatacaaactttgaatgaacctgttattgggtataatgttacaatttcaaatcattacataaaaaatccacctcctgtccaggcttttatgaaatctgaactaccaatagaaatgaatagtcagtgcttaaatgcattcaattatttttatgtccatccaaacttaataacctgtaccccatcaccttccaaagagttgttggagattcttttcaggtatatttgtatgaaatccgtaaaaaaaatctttttatcttggacaggttttattttcgtccttagggaaataattgaaaaagcaatattttcaattaaaaataataaagttcctaagtctgttttcaacagtttgatgagcgagtattatcataatccatataaagactttgttccaattggaaaaaaattagggaaacacataaaagtggatatagaaggacagaatatctggcagttcatagtttccaggagtaagctcttatataatattgattcaccaacaagggctgctcgtcgtggagaatgggcatttgtagttatatccggtaatcaaactccagcagagtttttgtatatgagagaaatacgttttatgaatgtcgactctgtgcaattaatcactgccatactatttaccatgattatgttcaaggtaaagaacccttcaaaattcaagtcatttgaagtagttattgaggatcataacaaaaaaatgaagaaaagtgtaaattccaacctcctgttggcattttccgctagaattgccacatattattcttatattataaacgattggaatgatcaaattgataacctaatggaaattgatttggaagaaaaagaaaaaaggagaaatcaaacatttatttggcactcaaagcctctactttctttagcttttgagccagatattacggtacctaatgagctagtttctaactgcgtaaggtattgcgaagacttggtttcaagaggtattgtttctgttgttggcgttgataatggagcagaatcttcttcatttctgcaaaaaaaactagaaaatatttgtaaaaaattacaaaacaaaatcctaccatacaccgaaatttatgttgaacctgaaaaaaatgtacctaagtctatattaaaaagttcggtgaagcctagtagtccaaaaaagaaaaagttgagatttgataataacgtgcaagtttcaatatacaataagggagagcatattagcgaaaggactcctattggtaacttcacacttggttcatcattaaaaacttctttaatgaagccagaaggaagttcaaccgcaaggcctgaaatcccaattgataacattggatcccaaacctctcaacgcattgagaatactaatgcagcccttgacaatattgatcttgaataccttcaaaaagaagatctatttgaaaaaacgccatatccatttgaagatgatgaatcttccattaatcaaagcaattctgaaaatgttaagcctgtaaactcattaaatatggttaatagtgaaaataggtcatcaaagaaatcctga

SEQ ID NO: 3237 - DNA, 2253 bp, Cryptosporidium hominis
atgagtgctaaaaattcttcaataatttacaaattcaaatgggttctaatttatttaattctatttatattctcagtatatattcaacttaactgtgtgggatgctatgaaatatcatcaatttccaaatcggtatacacaagtattaataaatctttagaaatatgtattaaagatgtttatactggattaacccataaatctgaaaacttaggggttatttatcaagttgtgaaaaagaaagaaaactataatataaaaattttaatttatgagtcttttaatcaggtagaagaccctaatactgctagtgattattgtaatttcaagagttgcataacaaaacactattacagtgaattagaccaacttattggcgacaaaaatgagataagttattcaacaaattttaaatttattttggagttaccttcaaaagaggaattagaggaaattgaacgaaaagacaaaaatggtaaattagtcgttgtccggaaaatgtttaaacttaatatagctagcttaatacaaaattctaataaaagtgaaatatcaaatcctagcgagcataatcttccagcaaaaagcattacttctacaaccacaaatgctacaactgcggtggcctccacagaaataacaaccatgcccagcaaagataatcaaattaatcaagtaaatacaaattttataagcttcaacgaaattgttaatttaaatatattttgcgcagaactttcttcagaagaagtaatagatgccataaaatttcaaaatacatttatgctgccagatataatatacttagaagttgcaatgttattaagaagattggcaaaaaggattgatctttttagatcagctgaagaatcattatcggctattatgcctggaattggtgggctgttagtttcagatacccactgtgaagagtctcttagagtttctctggtagctggagagttaacaattccaggtgttggaccaaacgaatttccagtaatatgccaaaaattacaacagtgtttaagcgatcaatctttccacaactctgctttagtaagcttatcaaaatcaaaaaagtacgtagattttgcgttgagtagaaatcgaaattttatgtgggaaactttaaataaaatggtgggaattttgggaaattctagtggtttaaaatcatatcagttatggatggaagtggagattttgataaagaatacaactccagatgaagatgtactacactctgatcttccgaaagagatgatactaatcgcagatttgatgaaaaactcgaaatctcaaacagtagaatgcacaatatcaatcatgaagattggttcattgtatgatatcaggctttcacaagtttctgaagttgcaaggatatgcaatcgaattttctctgattcatcaagctatttgtcagttgatgagatgagactcatttcagataccaccattctttctagaattgctgattggatgatcgggacatttatactagaaaaacatattcctcctggtgttaccaagccagctgcatgcatgtatctttctgctattacttcgccaatggattactcgagtataaccaactttctttggcctagaatagtttttgctatctcgtcttcttcttcttcagcattatcatttacaaccaaatcagttgatccagaaaattgccgaaagtctttagttaaaatcttaaaaataattggagataaaatacaaattaatattgatgaaacatgtgggaaaatggcaagctgtatattgaacggacgaattggaagaattagcgtagacgacaccataagcaatgctttaagtcaaagtcaacaaacaataaattacgattttggcactaattctgcatctttacgattggcaagatttattttcgaatcaaaagcccccaaaaaaagtaaaagaaatggcttctcgaagctctccgcacctttaagagcctcggtattatttgggcatttgcaaaccataatgcctggtggttttagtattaatgacgttgtaaagtttgtgcatagcttcaccaaagaatctccccccaatgggccagccaaaaaatgttttaaagtccttatcaaatacatcccagtgtttgtttcaagtgacaacgaattaaaaacaatttgtataaatgcgttcgggccgtggatcatgcctgatatacttgtttctgatgtaacattttcacaatctacattttcaaatgaagttgtcgtataa

SEQ ID NO: 3238 - DNA, 714 bp, Cryptosporidium hominis
atggaattttcttgtcaaaattctcaaacacaaatttgtagaagggcatatattcctaattactcaaaagatgaagtaaaagatttaataggctgcaataatatagaagagtccaatgatagcattaaaagaaatgtaggaggttttagatctgatctttgttcagaaaagatttataagattttccaggcaagtaactggaaaaatgacaacgttagtaaaaaaaattataatcacgaagaaactcctaaagttgggcaagtctctctcaaaaggagcatagtttacgactcttcacttggctgttgcgttccattatatactaggaagccaggttgtagtagaatgaaactagatattattggatatggtgaatcagagaactacggtacccaattagaaagagcatcggataattcaatgggcactatattgaataattcaaatcttcataaaaactttaatcaacacttttcaggatgctcaacaaatattattggggaaataagagatagttttggaagattgccgagcaaagcaagttataaaacatctaaagtaaacagaagctcggtacatattgaaaatgatttctatatgccggaagaaggtagttcatatgaaaacaatacaaaaactcaacacttagtaggaaagaattttaatgggagccatctaactttttctggtggattccttacatctatttcttaa

SEQ ID NO: 3239 - DNA, 3780 bp, Cryptosporidium hominis
atgagttacaaatttcagatcataataacccttataatatatttagtaattcttgattactgtatttgtgcagaatttgttgagtcattggagagcattattaacggaggatataatgaagatgagtttaacccactttttgtggaagagttaaatgaaataaaaaacaatcctgaacagaaaaaagataacttttacataaggcttagaagcgggcaatggtttgctttaaaacaacaagttgagtacgactcttctgaaatgggtcttaagagagtgtatggagtgcttccagtaaatccatttgcgggaaatatttttactccttcattgtctgagcttgaacttgcagataaatattgtgaggctcttcttgatatgagaaataagggtatttctaccaagataggtttaaaaattgcaaaagatggactaataagagagaaattctgctcggatgcggctgaactctactttaatggcttacgtccaagacctgcaacattggcacagaaacaaaatgaaattgaaagtttgggtaatattgaatattttgactatgctaatttaggaacaattactagtcaaattgatattccaagaatatcaactggtgccagagcaagatacggtggtaaatacgcctcagtgtcaagctctcaagaggcagaactcattacaaagcagacacttttgcgtaacttcctgcatgttgtaaagcagctccatctgaatactctcagaaaggatccattaaggcttagggaatattttccagggacattgttacaacttagggatgcaatagaaagtgatgaccctgaagttgtagctgtaaaattacttcgacttggtccaacttctgaccttctggagcaatttattaacaaccatagaggaaggagagatattttattgataaagacaaaaaaagggtataaaaagaaacgcaatgctatttttgaagaatggatggatctcatatcaaatacagacctctcagttgtaacactacctaatctcgaataccttgcatataagcatgtagctttaacaccaagtattatgactcaaataaaaaagctctatgatctaatagtaaaagaaaaggagaagaaacaaaattattatactccgcaaattattgaaactttagacttacttccagatatagtaagggctgaaattcgtatatttttcgagttaaatactaaatatggttactacagaataaacacgttagagaaaattagatcaatgataggggttattcagcctttagtaaagactgtaaaccactttagcgaagaagaatttaacaaagcgcttgcaaatactggcctaagccagaatgaaatgaattattttagtagaaacctctctaaaatattattaacaattatggagagaagaagacttaaaataaaggaaaatgatgatgatgatgatcttttaaacaatgagccttctatctctgttaattctttgattgagatgattcaaaagatgaacaatagttcattgggagcaattatggaccatatagaaagtattgttccaaatttcactaataaaaatatgcatagtgaggcaacagagcaacaaaagaaggaaattgaagcatttgttaaacttcctacttctccagtagtatcgaggcaattgtatggggaatcagttttgagacctcttttatctgatgcaattccaaatgaatatggaactcttgataaatttatcaaggggttttatattttaatggctgaaactggggtccgtttgcaaatttatttaagaaatgggtttgaaggccaagttccgaataaatatgaaaattattacaaacagaatgtctttttggaagataatttgaggcataattctgaactttggcaggcttcaatgaaaagtttattagaagaaacactatttccatatgaattagcaacaagaagacttttacaatatttaaaagaatgcaaaataggagtaaagtttggatctaatgaggaggaattaaagaaaagatcatcagaaattgaccagagctacttacaaactctacttgataactttgagtcgataaagttgacagaaaagagactaaaccctatttttataggggaaaaaggtaatatgctaatacttccaaatagaaggcaccatttaatcaattacatctttcaaaaagatggtgcctcattatacagaattcttaaagatgaaaagctacatcaaatattagttggtttagtcgatctactagaagagatacagatccccaaaaaagaagatgttaatattcaaggcccatattgggatagagaaaagaatgaatgggttaatgcggataaaatgaggaaaaatgaagttgagattatttacgagcctcagaaggtaacagacctcccaattaatagggaacaagaatgggagagaattgcgctattcagtaaatggtcagactttgttaaaggaattcctataaattccattccaaatggatttaaattttcatttggactatattctaactttattcatttttgccaaagaggaattagagagcttgcgtatagactaattgtacgtgacaaaccaacaaatacagagccagagggaaaatactgggaatatcttccaagaaataaattctcgattttaattaacgcagataattcaaaagcacgagaagaaaaggttttgtcattttgtagcgctgtctatatttcaatttactcagaaaaaggagtcccagaagaatataaagggtctctccctaatgtatggtcaaaagaaactgacaaatatgaaaaagaagcttttatcaccccaaaagacaagtccaagcaattacgctaccatttggacgatgttaatgaacaatggtcattcattgccagtgaggcaagaaaacctgggatatttatggcacctacaatgccaactgacagctctttattgggagatgtttggagaaagctttatgttgaccagcatattgcaaccagctctgtaaatgaagttgatgcaaaaatttctattcttactgatatgtgttcaaaagcaattaggaacttaatgcaaaagaagaattactacggtgagcaattatataagatggtttatgatggggaaaattctattgaagtattttgtcatgatgtctcgagaagatggtttagcaagtggccatctgatatttcaaatgaaatgcttttgtcaagccagcatgaacatgagaatcaatctttcaaaccgttcgatagaagttatttaaagagtaaaaaacctgcagaaagaaagattagagaaggattttcaaaaacaaacaagaaaatctcccctgtagttatggaagaatttaatttcaacaaaatttcaagaaatgctcgttcctttgaagaaattccaacagaactttgtgatgaaagtataaatgagagttgtcatcacaaaaatactggaagctatttgacacgctctacatcatctattaatttagcttccgggagtatgttattaaattctgacaaggttaaaagagtcaatagcaaagtaaggtcaacaggaatagaacgaacaaaaaacccagaagtcttatcaaggaataaaataatgaatattagagatatcctagattcgtccgattctggctccaaaggccacaaagaattagtcagagccattcctacaaaaaaaataaatgattctggaattaaaaaaaagcctacaaaaaatacaaaaatcgataaaactttttcagaattgattgactag

SEQ ID NO: 3240 - DNA, 4998 bp, Cryptosporidium hominis
atgaacagcaagaggctatttagtaaaagaatgccaaatcaaatagatgggtctattgctttatgttttcttgcatttatcatttttttggttgtaaaggttggaggtacaaataatgaaaatttatcgcctaatatgcactcaggggacagaatgttgtggggtattataaagagcgagcttttaacaaatagttggatgaacttgagtaaaataccaacagagattactgaaagtgacatgggtatttcaattggggtgataaatatttgtagctcaaataagattaagattaagaaacaattatctttcaaatgtataaacaagcttcgaacattattggattatacaaataaaaaagataaggggtactcaattagagtcagaaaaggagtgagctttaatgaagctctggcaagactttgcctagatgctacaaacaaatatttgaataattcaagtaagatttgtaaagataaagaaactaacagaacttcaaccaaaggcaaaaaaatgactagagaaagagaaaccaacgaaaaaaagatatctattgataggcttactaaaattacagaaaagtcagaatctagtgaggtactaaagaaggaaaatttattaaagctaattcaatctgtattatttgactacgaatcatctttaactccaagccgacaactaatcagccaaataaggaagccaaaacagagccaagtatctagattgatagtaaatagggatttaaaaggcttggcaattttactttcaaatgaaaagcaagaagacgcattatcgtttattaatgtgttgatcaacggagataaatcggaagaaactgataatttgacatttaaagatattgaaaataaaataaattcaaaacacaatttgtccaaaattactaataagtacaagccatttggttttatgccaagacctgaagatgaatgggatgcggtagtaagctggattcaggaaaatgctaataaaatacaaagaccaggaggttggatgataaagaaaacgtatgggaaaaaggttttaaggtttccagagaactttgtagcaagcaaaggagttgaaactattttcattgataactgttttaaaagtttaagaaatatggcttatacagtttttactgctccaaatggtgacaaatattataaatataataaagaaaatgactatggattaatgattgaaggggaaaatcaaaatgagaggattttaaacattaaaaatgcatgcaaagagatttttgaaaggtattacgaatatttaggaattaaaacaaaaagggaggagtataggtttaagattcatggtaagctcaatttcttattacctttgaaacatgaccgtctatttttgaataagttgctgacatccttttataagtcaataaatgatagggaaaaggaatggcacgcagtggtaaatgaggcaagaatttctccacttgtgagttctaaggatcttaccgaggaaatcgttccatatacttttattgatgagagaataaagagagaatcaaatttagaaaaaaaggaaagcctactctcagatatttgttttaaaactataaatattttaagaaaagaaaggagtcaaggatcttctgatatacctttatataatattgaaattggatctgaaaatgaagtcagtattgcaaagttttgcaaaggtctatttgaaaggtttatcttaaggcacatagagtggttgagaataacaattaaaagtattgaaagcgataatattaaattaattgacattaatgatccatacttagaaattccagaagtatttctatttcctgaagatgcaaggttaaaagaaaattgtattactagtttaattgtagtctttgaaaaaaatttacaggcaattgagaatggataccctgttaaagtttaccctcaaatggattatcttggagatccaagcgatatgattgagaatataacattattttgtgagtctttatcaggtaaagtcactccaaaggcgcatagaagcaaaattcctgtaaaagatgaacaagaaaccattaaaataatgagttctgaaccagaattgattaaattaatcagaaaaaatatagagagtaatttattgttgagctttgaaactaaaatggagactagaattgacaaaattacacaaaatgtttccaattctaatacatttagactcgagaactggaagtcacattttgaggaagtttcatccttagattctcatgttgaatccatgattaatatatttaaggctcaatttagtgaatttattgattatgaagggttgtgtgaaaaaaaaattagacgatatatagcccacattaattcaaaagaagatgaggtgagcgatataagttggcttgaaggttatctaatggagactgatagacttaagggtgactgggcaactgaattgcagtccatagagaacttacacaaaagtatgttggcagcagagggtgaattagaaagatatgtaaatacaataagaagcgtagtatatggggatgagaagcaaaaagagcttcctcaagtacgcaagatgctgaatgggtggccaaaggaactaagtaataaagaaagagtttacattaaacataaaatagatagcttattatcaaagcaaaggcacgagtataatattgaaagtttgagatatgaacaattagagagaagaaaggtgtttagagacaatttaaagaaatctttactggttcaagatcaaaataaacctcttttctttgatatggagaactgttttaaggaagatgatgaagatttagttccaatttaccctgaaaaagagacaaaggaggaggaaaaaataaggcatgacaggattgcaagcatagaaactgtgctaaatgaattcaagaatagatttgcactaataaatagtagtttgaacgcgcaacttggagggctagagagctttctaactaaagctcggaaagattttcaaacagcttggacagagagctttaacactgcgcttgcgttacaactacaattaaggaccagagcattggtagaagagtatgtaagagcttcggagcgttatttattgattaaaagagttaaagctgattatgagtatagaaaaagtattgtaagcgagttccaagcagatccaagttttgaagttatgttaaatagagcatctgaaatgattgaaagggcagatgaagaagaggcagaattagaaaaagagctttcaagtttgcatgaacagaaggataaattacatttattggtagaagaagatatgcagacaatatattcccaaagattaaaaacaattagagattcaaaggagttgataagggctaaaattgatcatgagaagaaactattaatgcaagaggaaaaggtgtttgaagatcaactaaaaagagatttagagtattataatatcaaagaaatttcggaagcagcgatatacagagcagataaattaaaaatgttatatgatgcaacaaattggttattgaactttaatgaaaagttaactatttcttctgaaactcaatttagagaagatttagaaaaattagattatgttataccactcaaaaaacttacaaattcaagaagtgaaaatgatgagagatttaattttgatgctttaaaagctaatttgagaagacataaatatactcacaatgaagggttcgatccaaacgatatagaagatcagcaggaactaaaaaaggaggcaggaccattttataatgatgaccagactcaaggacaaattccagtagcagctcaaacccttcttagaatgtttaaggaaaagcttgtaatcaggttaaatgacattgatgaaattaatcagcaaatattgcagcttaacttaaatgttgtaggttcttttcagtattatgattataacagagaaagggcatacaagtcttttagagaattaaaatattccaagggtgcatctaatttgtttgcaataattttatctcactttgaatgggagcatatccagttaagatggagagtactagacctcgccaaacatattttaaatgaaaaagaaaacaaactaaatgaaatttcagagctaagatcttcccttgataataaaatgagagaatttgaagctatacctctttccagaaaactagttccaattggtacttctgtcgatatgatgactaatgaaatatcaggctcgagaaaaaacgaagaagattcacttgaattattgccaagtagtattccatactatttactctcagacgaagattttagtcaagtaagaagttatgatttaggggcaaagaagatcattttgaataggatattatttatgttaagtgcaaatgaaagcaggtatgtagagttattaaaagacacaataactgaaattaataataaaaagaaggcatctgagctcgagatagaaacaattcgatcagacttagatgaacttaggaggaccgtcggatataaaatgctttcgaaggaggatagagatctagaggaagaaaagttcaagaaaaaaataactaaaattacagaatcaaagaatttagtacctttattagcaaagagagagatattaattcgtaaatcagaaaagatcgattcttttaggcataaggttcagcatctatttcaagatccaagcttcacatccgagcaggctagagctcttgaaaacgccataaatgagttctttggaactaaatcagctcaatttgatgagataactccaagaatcaaacttgcagaagaaatcaataaattacagtttgctgaagaagaaattgcagaattagaaaagtcaatgaataatatgaaaaaacaggaaaattatgctaggttacacggtcttaaaataaaaattgttgaaataaaagagaatatttcaagattgaatgaaaaaattagtgcactaaatgaatttatacaagaattccaagataagcattttagcaaggttttcgaggttaattag

SEQ ID NO: 3241 - DNA, 1884 bp, Cryptosporidium hominis
atgtctcagtttagggatacttttacaaaagaagagaagagcgattctctttatgacgataccgcattcttcttcttttttggcacaattgtaatttgtattttgattttttggacttataatgtactttctaaagtcctttgtccaacgagaaagtttaataaaaaggaatttccaaagtctactccgagtggatcccaaattcaatattgtaaatgctcaggctgtgtaagtaatatagaaaacattcgtaggaagcaccgttcattttctaatcgcttctcgcttaaaatgattttgcaagttgcattgctaggtataatgtggtcactaacttattatatgctatctaaatattcagaaaatcgtcaaattgctcagtttaatccatatgaaattttagaaataactccatcatcaaatacgatgagcattaaaaaagcatatagattgatgtcactcaaatatcatccagataaaaacccaaatgatccaactgctgcagcaaaatttatgttaattgccaaggcttatcaagctcttactgatgaagttgcaagaagtaactatgagaaatacggtaatcctgatggcccaacaagcatgaaggttggaattggccttccaagctttctcgtctcgaagaaatatcaactgttcattctttgcttcctttcgctgataattttatttgtaattcctttggcgttcattatttactacaggaggcagaagaagtatgcatcaaatggtgtgtatctaacaactctgtacttttattcagcagctatatcggactctacacgtttcaaagctttgccagaaatactcgctcttagcactgaattccgctccttgaaaaagaacacttcagaagatgataaagtgatttctcatcttgcaaacattctcccagaattcaaaaaaagatctttcaacaataattccccaagtttcttcacagcttattatcttattctcgcacacttatatagaaaacactctgagctaactccttctcttaaaaaagtattggaagatattctagcaaaatcaatttctctaacatcatctatgctggaaatttctattagccgcaatttcttccatacatcaacttcaatcttagcctttagaagatctttaattcacgctcttgacggagggcccaacgcgtcatttttgcagattccatacattacagaaaatgaagtccaacatattaaaaaaggtaaaacagcagtaaggaacttggttgagtttattaaacaagatcctgctaatcgaaaaggtttggctgagtttaatgagtctcaaaagttggatattgaagcattttgtaacttaatttctcccattagagttgattcaaaagttatcgtggacgatgaacaggatattgtcgttggagatctcggtaccatcgagattaacattgaccgtgcaaacttgaaagaaaatgaggcttgtgggcctgtccattctccttatttcccaacaacaaagtatgaagagtggtggatatttgcagtaacaaaaggatccaatccccaaatcatcggatatacgcgttgttcttctaacgaaaagatagtagatgcaaagattcagttccttattgaaactccaggaagcatagatatttctcttcatcttattaatgattcctatgaggggcttgatcaggtggttaacgttagttttgttgctaaaactattaaagaaggcataagacagatatatgttcatccagaagatgaagccttagacaatgagccaacattattccagcacataatgaatcaacttgatgataatcagctttctactgacacagaagatgaagatgatgatgctgcggagagaagttccagtaccgaatag

SEQ ID NO: 3242 - DNA, 1374 bp, Cryptosporidium hominis
atgaaactggttactttggtcaaaatctttgcattaatccttcttcaaaactgtatcctatccaatgctgaaggaggagatgaaggtattgcatctagatttccaatacttggtgccctgtttagtgcagcaagtaaagctttcgacaaggtaacccctgatgagtgttatcaacttaataaaaggggcctaactggcggatctattggtcttattctcgcagctttaccttataaaccaaactatccaataatgatttttaaggatggttggcaacaaccagattatctaatttcagcgttcttgattgaaatgtggcatcgctttcgagctgctgaatcattgtttgaccccactcgttataaggaagcaagcaaattacttggagcccaagcattttggggtagcaacgaaaaacaaatctcggagggccctcctcaatgggatacatggtggtctgaacttggtggtttcttcactggtgtaggtgagttgatggaaattttgaataagggaacaattccgctttttgtttctacaagaggcttacaatacaatacgagatttttgctttctacattgaatctgtatgcaaaggaaaagctagaaacaattgaatacttaaggggaggaacttcaaaggatggaaagtcgttctcttgtaaagcctgtggttcttcaactttgctgggaagccttccttcacacttgggaatatttacagatgtggaaggctcccaatcttactcagctctaaatcacttgaagcttctatacgaaaggcttgaaaataatgaaaaccatcaatatgaagatgaagactacgtagaatctccttctgtggacgaatggggttgggactcggagcattcctatgtcggagcatttatcatttatgtacgtaagctacaacaaaaataccatcatacctataacagtgcaagcaggagcggtaggataatgtgcggagttcatgttcatgacatcacacaatgtttaaagaatactttcaaatacggaaaaaaagtattgaatgttccgttatcttcagattcgaaaacaacagaacaaggagttttgacagagttccatcccccatggtttggggatgatagaatgtggagggaagacccaaggggccagattacaagaattttgcaatttctagacgatgaggatttaaatactacaaggtgggatacattagattacgttgtagcggcagcatttcaatatcttagaattaggagacatttatatcaggtttggtctggcggatggttgcgaaaacaaacatctcccaattttatcaagcgactattaaaagctattctgagaattttcaggcttggaggaaaagtccctgtaatttag

SEQ ID NO: 3243 - DNA, 1074 bp, Cryptosporidium hominis
atgggaaataatacgtcagcaattgaaaatgtaattcaacaaagttttggagtctgtctaaatgttaaacagtatattaacaataataatttcaatgaaagatatagaataggtggaattattggaactggacaatttgcagaagttttctattgccatgaaaaaactacaaaccatccatatgcaatgaaggttatttatagtacagatgaagtgtcgatagatcgaataattgaagaagttgaaattatgaaactcttgaaagatcatcagaatatagtaagcattattgatagcaatattgagcatatcgatgaggataagtatgaggttaaaatggttttagaactttgcaaaggcggagatttatatcaatatgtacttgcaaatggtgcaatggaggaaaagatagttcagaaaattatgataaacctactagatgctctaaagttcattcacaaaaatggaattattcatagggatctaaagcctgaaaatattttgattgatgagttcttttgctgtaaaattgctgattttggattagctaaacggtgtatatcaagtgatagttcaaataaggtagcacgttcaaaatccctctgtggatctgatttctacttggctccagagcttgttagacaacaagaatacggacctgaaattgatatttggagtataggggtattatgctatgtttgcttatgcggggggctacctttccatgataacagagcatttgatttgtatcataagattgttgagagaggtgttaatagttatttatttgcacaaccagcttggaaaaatgtatcttctgctgctcaacattttgtccaatggctattagagtctgaccctaaaaagaggccaactgcagaaaatgcacttaatcatagatggttacgaactagttttgcaaaacaaggcattcagacaagtaccaatccgtttaataaggctggacacaagaactcactttcaattggagttgattcaagtccagttactactcaatcatacgaaaataaaaaccatatttcgaatcatgtttatgatatatataaatattaa

SEQ ID NO: 3244 - DNA, 660 bp, Cryptosporidium hominis
atggaaattcctgatgtaatattgaaagagtatttatacttgatggcattagttgatgactcaaaattcattgatgtagataaggcggaggaaactatttcaataactaatgaacctatagtcgtcgaagataatgagcacaaagaagcaaatattgactcactaattgtagatatcaactcaacaattactcagaccagagtaatattattggaggttgaaaaatttggaaaaatactggagcagaagaagactcaactcaacacccgaattaaggggcaacaaatcgtagaagtctttagcccagtaatagacgacttaaaaataaagtatgaacatattaaaagtgaaggcactatggaaagcttccaaaaattgattaatgagttctgtagtgcactagaagagagaaatgaactaagatatagacttgttcatggagaggatagaattgagatcccagattcagccgacaaagatgaattaaatcaggatgtttctattgatcagaatgtaaatatagattcaaataactctcagaaccaaattattgatagtgtgaatagtttacaggaaaaatccaaaagatacacttctgttgttgacaaaaatgcaatgaagttatttgcaagatggagtcttccaaaccatcctggctaa

SEQ ID NO: 3245 - DNA, 1698 bp, Cryptosporidium hominis
atgggaccaaaacagaggaaatcgctctcttcggtgtcttcgcagtcctactcaaattctccttggaaagcattgactagaatagagctatatcaggttcttgatcagtgtgatattcccgtttcttctgagaagcttttaaagggagagcttattgaattgcttgaaggcaatcttgacgaagaagaatgcagaatgtggctagaatactatgaaaagccacttcctaattcagactttggtctcagaaaaaatgaaccatctacctctgatataaaaaaagaagttgtagttagagaaagaaaatctgtacctgcatatattgctgttgccaatacaaatccagatgttttaaattctatccaaggttcaccattaaatgaatttagtagaagtagaactttaagaagacggaattcaatgtattcagatcactcagaaggagcaaaggaaagttgtgaacaaaaaaatcttgaatctttaaatggacttaaaaaagacacgttatctgattattttgcagcgaatggtactgaattctacagtagggacaattactcaaatgaggatatctcaggtgaaatgcatgcatcatcgaatgacagaccaaaagctcgagcatacaaatctttagggcagagaataatcggcaagaccaaaattgctttgaaatctattaactcaaaaatgataatcatccttgtagctttatttatattcttcgccttatacaaccactactactactttttccatgagccaaatttttgtaactcaaatatattgagtgagaaaacgctaaatccctcgaattgtattaaatgtccgcctaacggacactgcaaagatggaaatttgaagtgcaacactcaatataaaaaagcaataaaatatctaaataatagatggcagattgtttgtatatatgataacgaggcatttgacctcgcggaagaaatgctcacatttattacaaataagctcagaaagctacgcggcaatcgtgcatgtagtgggaatagcctatatgatgtattttttcctgataaaagaaaaaatagtaagattcttgattttgatagatctgtagctttaagtgagaaggagatcaatgatatcatacatctttctttcaactacattgagcaaagtactgttgaaagcgctatttcaataatgtggaactcaattaaaacaggaaattctttaactaggtatggactaaaagtagttaaacacaaaaaccccaacttaaattcagattcaacttctaaaaatagtgataatcagtttattgaagaaggtagctttattgaagctttagattccgagacttcacttatttgtgaagctaaattatttattcagaaatgggtgattattttaattggtattattgtcatatttttaccattatatttcagaataagaacaagaagaagaaaggcagaattaattcgaaaaattaaggctataatttgtagggaaaatagaaaggatactacaactggtttatttgtgggccccgactcagaaactatattgagattattacgtgtagagttccctaagtataagaagattttaaatgaagaacttgtgatagagtattgtgatgaacttgaacataatgatccaaatatccacaaaaccttaatgtctgaaagtaagcacccattctattggtcttcctgttga

SEQ ID NO: 3246 - DNA, 504 bp, Cryptosporidium hominis
atggatttatccgatagttttgatatagcaaagcaatctggcgttagagggggagccgagcaatttaattgggacagcttaagatcaatttctagaaaagaaagggaacactatttaggacacagtttgcattataatcgttcaagagggaggggtagatttagtaggaatgattggtttagtaaagttcataaatcaaaacctgaaaaatgtacttcttcagaatttcagaatgaacgtgaacgtataatgaacaaagagcgagaaataatgaacaaattgcttggcattccagataattccgaagttagcgaatatataaaaaatgaggtttccgaatcagacaaaaacgcaggtactcatattcaagaatctcaagaaatgcgtattattagttgcattggaagaggaagtaagggaggaattcaagtaaacaagaatcaaatttgtaatgagcaaagaagggcgaaaagacgttcttttagcagatcattatcaccttga

SEQ ID NO: 3247 - DNA, 627 bp, Cryptosporidium hominis
atgaaccccttgacaaagatttacactgcagatcaggacgaaaccgatgtcgagttattttgtgaaagttgtttaaataagacaaattatactggaattgtggcttcattggatgaggaagtaaatatgcttaatgcaaagaatattagtaaaaagtttcaatcgaaagacacttttatttctttttcagtttcaattggtactaggattttccttttttttaataataatactattacttttgatgaggctttggagtttaatatagataaattaaagcaaatacttcattcagttaagaatttacacccgtatatactaattattatttgtatgcttagagaaaggtatcaaaaagcagtgaagaatgagtctcacagttctgaaattgatgaaatattaaaggaaataaaaactactccaagtattgatattgagaaggctctcgaacttgaaaaaatattcaacgaaacatggggaaagacaatatctccaattgcttcaataggaggaggattgctttgtcaggaagttacaaagttttgtattcatggtgttggagagtacttttgctgtatttttgatatggagctgtgtgaggcagtcactgctacagtcaaaatgtga

SEQ ID NO: 3248 - DNA, 1188 bp, Cryptosporidium hominis
atgaattatgttgaaaatgatatagtagtatataattcttcagaggagtgtaaggtttataatacattcgaagagatgggtctgaaagataacttgcttagaggaatatatagttatggttttgagtttccttcagcaattcaaagacgagcaatagttccaataatacaaggtagagatacaattattcaatctcagagtggtactggaaagacctgtgttttttctgtgggtgctttggagatttgttcgaagagtaaagagaatgttccaatggttttgattttatcgccaacaagagagttggcagagcaaagtgaaaaagtatgcacctcaatcggagattatctagatattaggacacactcttgtattggaggaaagaagttaaaggatgacattaaagcttttaatagtggtgtgtcaatcatctcaggtactccaggtagagtattacaaatgatagagcaaggatatttatctacaaaaaaaattaagcttctaataattgatgaagcagatgaaatgtttgattatggtttcaagactcaggtttatgatatttacaaatatcttcctccaagaatacagactgtgttggtttctgcaactttgcctgatgatattttggtaatggctcaaaaatttatgagaaatccactccagatattagttccaaaagaagaggtttctttagacaaaattaggcagtaccatgtccaggtagaggaagaaaaatggaaatttgaaaccttgtgcgatttatatgacactttaactgttactcaatctattattttttgcaacacaaaaaataaggttgaatggctgagtaagaaaatgatggaaaaccattttacagtatcttttgtgcatggagatctcccacaagttaccagagaagaaatattgagagagtttagagaaggaaaaacacgagttttaattacaacagatttatggggaagaggtattgatgtacaacaagtcaatttagttgtaaactacgatctacctattaataaagaattatatattcatcgaattggaagaagtggcagatttggaagatctggaattgctataaacctgattactaaagaggacgaaagtatgctttctttattagaacgcttttattccattaaaatttccaagttgccaggaaacgtcaaaaatttgttgtaa

SEQ ID NO: 3249 - DNA, 1296 bp, Cryptosporidium hominis
atggtcttgaataagaatgaagcgattcaaatcataaagaaatatcttgagggtgcagaactcaactctaaagtcagatgggatgaggctgcaaagcttttgggaccagatgcaccacacgaagcactcaaggtattaagtactggagaaaaacgtcagatatggtctgaataccagagccaatcaaaacgaagaaaaagggagagggaaagacaaacaaaatctgagtcaataaacacctatcgcggcttactgaatgactgggtacttgaaaatcagggctgcaatcgtatattattatttcgtaactttgcagaggaacactacaagtcagtttggtggaataatattgaagacaaagaaaaggacgagatctttcaggaattagttgaagaacatgaaaagaactttatcagaactcttgaaccaaattatgaagaaaatgtgaataatttttttgaattattgagattagaaacgactatttttccgtttttggaatcaaacaaggcagaaagttcaataatcaggaatgatgagagtattgaaaagaaaaaattcacaggttttggtatctgggaagatattcaaaaaaagtacggaaaagagcaattgtttaaaaaggtatataaggatgacatattagatatttatatccgtttattaaaaggaaagataaacatttataaacaagaacatttaaagacagaaactgaattttgtaaatatagaaaaatgttttgggatataatttggagtgatattctttctggcaaaataagtccaattacaaagaatagaaagagctacttttttacaaattcaaaaattaatgatgaaaaaatcgaggccttgtgcagattgatatcaaaaagaattagatatcaacaatcagagagttactttgaatattttgaagattttctaaaatttattggatttcatttatcaatcagaaaagatcagaaagtaattttggctcttcttaagcaaccaataaataatggaatgaatttatattgtattgatatgtttgaatatatagcatatttattacaaaaattatatgatataattctatcagagtcgtatacttactttaaatcgtctgaaaagtttcaaatatcctttcaacaatttaaggagattacatataataataagaatattatggatttcaaaacgaaatatatattcccattcagttttgaatctgtactagacgcaatattatataaagcgtattgcgatgagtttaaacattattcattaacttcctcattaaagaaaagctag

SEQ ID NO: 3250 - DNA, 1263 bp, Cryptosporidium hominis
atggctgattattttcaagaagttgtactaaatagactaaactttttttcttcagaacaagggtacataagaaacagcttttcaaaacaatatggaaatattaataagctgctaaaagctcgtaatgaatactgcaagtcacagcttgaagatcaagctagtaaatccatgccttgtgacgctttagctccttacagagccgagtacaaatacaattctctaaatttatatggaaatactgaagcaccgttatttaaaaagaagcgtacagacgaattaaacatttctaatattaacaagtatttatcaagagaccgtagcataaaatgggcacccagatttaaattaaacaaggtaattagtggtcataaaggatgggtaaggtcaattgctgttgacccaagtaacaacttttttgtttctggaagttctgataaactcataaaattttgggatatcaactcaggaatactgaagcttactttgacaggccatgttgctgcagttagaaaagttttgtttagtgaaaggcatcctttcttatttagttgtagtgaagataaaactatgaaatgttgggatcttgaacaaaatagaattgtcagaaattacgcaagacattcttctggaatatattgcttggatattcacccacgtttggatattgttgctacaggatcaagagatggaagtgttgtgctttgggatattcggaccagagagtcaatacatttgtttaagaaccataaagcagcaatatcctcgatactcatgcagtccatagaacctcaattaatatccggtagctacgataggaccataagaacctgggatattgttgctggtaaggcgagagatattcttacacgtcacattaagcctattcgctctctagctaagcaccctattcactattcttttctttcagcaggtgcggattgcataaaaatttgggaaggagaggattcaacttatttgagggacctttcatcttctcagtcaattattaatactataacaatcaagtctcaggaaaataactcgattgtgcttgcaggatgtgataatggtcagcttcatttttgggattatgaaacgggaactttatatgacacaatacaaagtagtatacaaccaggttctgttgaagctgaaaactctatcctagactgtaaatttgataggacagaatccgttcttattacaggagagtgtgacaaaacgatcaaaatctggaatttaaaaagtgccgagttaatataa

SEQ ID NO: 3251 - DNA, 1779 bp, Cryptosporidium hominis
atgaatgacactggcatctccacaaaatttattggttggaaaactgttgatggaaaggtgttatataggattttagtttgttgtaaaaacagcaaatatgaagttcaaaagcgatttagtgaatttgtattactccagagcctgctagttgaaagaggattgagtttactcccttctcttcctcctaaaactctatttacaaagaatcaagatatgaattttattaatgaacgaatgaaagggttacaatcttaccttacaaccttaacttcaagacatgatgtattactttctccgttatttattaatttcttagagtttccgaattctgaaaatttgcccccaattatgaaaaaacttgtaaacattgaagtaacggcggatattgcatcaatcagacaatcagtaagcggaatttttattagtgattcagatttattatcagcatcaataatgtttgtttcacaccaagaaaactcttctctttcaagattgggaagagtttggagcataatagattcagaagaaactggatccatttttgtttggtgtttacaaccatattcctcaaaaaacacgtcttaccactcagtgaatatagattatgatacgacgactaatgcctttcataatttgtgcaactctaatacaattgattcttcaaaattttgttgcttaattcattctggcttctcagaaaagtgcaagaatattgtattcattccgaaaagagattctctgtgcatttttttagaacatggagccatagatgtattcgagggtgtattttcccatctaaagtcaagaatagcctctggaaacaatagccctcttgtactaactgaatgtattaagccaaatagaatacagcttcatggctcaccaattacttttgtttgctcgccattttcaatcgattgtaaagttaggcataaatacacgctttctgttggaatagacaacagcatacgtttgttttgtttcgaacaaatgaaaattatatccggtgggaacttgaataagcgtgtaaatggctctcgagtaatttcatgttatttagaagatgaatttggaagattgggtttctttggtacatcatcagggcaactattagtcttagatatggctagccagccgccatacctaataacaaactttaattcccaagctgattatcaataccctattacatcaattgtagcaagtaagaagttcctagttgttgcctattcgaatattatcaaggttttcggaatggaaatgaatcctaagcaagcaacatgtacaatcaatgataatcaacatatacgaagtattgatacaaactttttttcagatatggatattggaacaattagttcactttatatttatgaagatgaatatctatttgttggtggtacagacactttctcattattcaaacttaatatcaatcaggaacttacacccccagttttacttttttcatatgcaattcacacaggtaaaataaactacatttcagttgttccagacaatgtattaaatattggtcaattctccagacaatttctgaaactgcttacagccagtgaagatgggagaattattttttggaaaattttcaatttgcctatgaatcaaaccgtcaatgttagtacatacgaagaaacaataaatgaggaaaactttgaagaaagtaaagtaataaatgagcaaattcattcattagaaaatatgaggtctatagaattaagcgataatagtgatgatgaccttagttcggcatttagatag

SEQ ID NO: 3252 - DNA, 252 bp, Cryptosporidium hominis
atgaatatgttggttggagaattcaagtatataattcataagcatattactcaatcttctaataatcaaaatagtggaattaaaatacctgtaccatacgagaagaccatatatttatttgtgaataatacgatacccaaggctgggtcgttaatgcaagaagtatacgagcaatatgtttctgatgacgggttcctatatgtagaatatagctctgaaaatgcatttggtggatatcattccattatctag

SEQ ID NO: 3253 - DNA, 1113 bp, Cryptosporidium hominis
atgtatccattaagtcctagaaattgcttaggtactaaccaaaactcaagagctgcatccagtgaaattatatccggtttatcatttgcctatcctaattcatcaaatgaatcctttattaatgtaagggatgaaaataactcaaatctatcagaatttgactcttttaaagtgcaactaaatattgataaatcaaattctaaagttagtggtgaagagctcaatgaaaatagaactacattaaaacgaattaccactcattattctcataacttagactctaatattaaggatgaaagctctaataatatacgagttaaaaataatatatattcagatatccccaccgaaaataatttttcaaattttgaattaaaaacagaaccttatattaacttgagtaaggagcaactttacaaaataatttaccaaaagcatgatgaactacaacaaatgaaacttcaacttaatgaggcaaaaataaaagaattaaatttaggaaaaaactatgagctcagcattgcaaagcaaaatgaactgaaaactataaattcaaatttggaaaacttagtaaatcaattaagaactaagaaaagccaccaagttaattcaattgcaagtcagctaaagcttggaaattataacgataaaatctttgaaaaattagataatttgcttgattctattacaaaattgaaagaatatgcttcattatttactattgaagaccaaattgacataaatgaagtcaaaaaacttaaatcttccatagataatcttactcccagtaaagagataaatactgaaatagagtacctcaaagaagaaaggcaacaacttatccaattactaactgctctatcatcaaataataacttctatatagataataatttttgtgataacgaattaagaaatgaaaatgttaaacaagttaatattagtctatgcgatcaaatacagattcttgaatttaagttaaaaaggtcaaatgaaatacataaaaagaaattgtctaaaataaaaaatatgatagaattgcttgaaaaatcagaaagtattacaagcccaattctacaagatataaaaaatgaagttaatactataatttag

SEQ ID NO: 3254 - DNA, 2676 bp, Cryptosporidium hominis
atgaaggcgaatactgaatctactaaagctttatataataaagcattctatgtttggcatgagaattttttaaaaaattctgacaatacagtaaatacgtcgcctcagccattagcgtttatttgtaatgtaaatatcgttgacctttcttccagcgaaacttttgctggatttattactgaccaaggatatttatattgctggccatggccaggaactattagtggaagaagtgaaattaaaattaaccctattgcagtaacatctgttgaggaatatgttcataatttatcgtgtggttacaatcacatttcatgtgcaactgaaagcaatagtctctatatttggattttcagtcacgaaaatattaaatccaacgagctaaatcaaaaaacgttagcaagcccaaaaactctttctaattgggagttccccattaaaaaaataaatagcggttcaaaccatgttttggtattactctcgaacaatgacctttatttcgtgaaattacctgagtactctgagtttaaagagactattgattcaaaacttgaaactactaggataaatattccagaaaaaatcatcgaaatacaggcagggacaaatatttccttatgtttatgtgaaaacaacaatctttactactggtttctaaacaatgaatgtggttttgactctaatttaaatgaggattttattaaaaaaattgacattgatgcagtatctcaaagtcatacttgcagtaatgaaaattgtaatttaaagattgttactacttcagtcatgaataattttgctgcattgggagttatttttaactgcgaagttccccaatctcatgaatcaactgcttctaattatttctcacatatatttatctataactttgatgagaaaactatttcattggttaaatattcggatcaacataatcttttcaaatcctttcattggctattaaatcatttatgtgcagtatttttagatgatactatttggttcagagatagaaatatgatctatgacgagatgaatgacatcataattcgtcccaaaggcgatacaaagttactcttcgcaaatgcaaatggaagttgtctaataataaatattttgcaaaatatttgtgataatagtccaataagcaatacaggagaatccaataatgcaactactgagacaagaaatggaatagtggaaattaatagtgagaaaaacattgagaacctaactgaagcctttaatgaaaataaaacttttgctgaaaacttaattgattctaatagaaaggaggaggttaatccaaaatgtatagagtcaaactctgtgaaaacaataggctcttctgaagtatctaatattatgttccccagtaacacaacttttgaagcaagcgaccaggatggagatcatatccgtaatgaattaagtggatgtactactcttgaggatgcaaaaattaacgatgaccaaccatcctatcagagaccaactatttcttcaataattaccaaaaaacctcaaaaacatacgtttttgcgtaaaggcgaaggaaagattaaggccttcaagcttgcaaatttagaaaagtttgattcaaaattatcttctaactttcttaataataaacttgaaagtaataccagcaattcagtgcgttcaaatgcttctaatctaaaccttagtaaaaaaaaattacaagaatatgagactcgaattttcaacttagaaagtgaaaatagaaaaattttggatctcctaaaggaaacaaagaagagatatttgaatgatgtgaaggctctatatattcaattaaaagagaaaagcgatgagaaatttccactaaaatcagttgttgagcaattacaaaaggagctatttgttgagaaagaggaaaaggcaaagcttaaagaagactacgaatctgtcaagctacaacttcaaaatgaaatttgtaacaaaaatatcaaaaaggatttgttaaatacgcaattggtcattgaaagagatcgtctttcaaaagaaaagacatatattgagaatctttatcaggagcttaataataagagtacaaatttagagattcttgtagctgaactgagctccaaatacaataaattggaacaagatcatgaaaagttaacagataaatataatgaaatcgatcaaaatcatactctaacagttaaccaattatccaaatcagagctagaattatacgaactaaagaaagaattggaattaaacaaaacggataaaggtgtgtctgtcaatgaattatacgagtatatagatgaactagagaaaagtttgaaagaaattaaagctgaaaatgaggttttatccaacaaatctagtactatggaattatcaaatacagctggtcaaaattctcagcaagaaaataatgaaattaacaatataaaggaatatcttttgggcagactggaaattttaaaagaaaataaatatgatttaaaaaattctgaatctagccaactaaactccgaggttagtattattattaatgatatatttcaaatttttacagaaaaaattaaagattcgcaagaaaagaacaatttactgaaaaagaaagttaatattctagagaaatgtattaaaatgagaaaagatgatataaatatactagtagaaaacaataaaaattag

SEQ ID NO: 3255 - DNA, 1014 bp, Cryptosporidium hominis
atgggatgtttcctcagttgggagttggttttaatgggattccctgatatgtttaatagatctgggtctccaaattttcaaggtttggatcctgcaatgtggcaaatggtaacaactatagcagcaatttgtagtactgcatgccagaatggtggtagaagtagtagacattgctgtagaaaacatcattctagaaagcataaaaaagaagcagaattaaaagatactaatagcaatagcagtaacaaggaatcgagcgaccttagtgaaactcaaatagaccaaactcccaaagaaagttctaacgacaagaacaaaaaatcaggtgaaaggaagtcaaaccaaaatgataatactgtaagtggaactaagtggcatggaatagaaaaaaaaattgctacaattagaggattgagagatctagaaagtactgattcgaaccttgatgatgacgatgaattagctgcatctaatacattgtcacaaggaataggacatccaagatactctgatgtggtcgaatttccaagcgaaatttcagcatttaatggtaattcaaggaatagaagatatttagcgaaacagggagtctgtaatggagcaaagttttcaaagagcccatttgtaggtggactttctgcagcaaggagaagaccatatagtagtctcaccgaaatggcagcctatttttctaacattgagcctcaagaccaaaatgacgttattgttatgcttttagcatgcagaaagcttgaaaaacaaatagaggaacaacagactgtaatgcaacttttagaacatgacctaaaagaagcgcagtctttattgaggtttcccccagaatggaggtctcttaataatgaagaagtattgggacattctccacttcctactggacaaattccatcaactaacgatcctccatacgtctcaaaccatcccaatattgaaccaccttgggttaacaaaagacctaaggatggactaccttcaagggcacctacaaaattatag

SEQ ID NO: 3256 - DNA, 321 bp, Cryptosporidium hominis
atgagtatttttgaaaatctgataagaaaatcaataggtttgaacagtgagaagctagttgggtcaatctgggatgaaaagggaataagacttccacttatttcaatttttttatcatttcttttcccaccgattggttgcataacttttttgataatgtcaagagctccaaaatcaagtccaaagtacaaaatatcaattatagccttatattttgggtcgctcctttctgtagtttacacgttcttaatagcaatgtttttacttacaattactggacctaaaagagcttcttatgtacatactggagccgcatactag

SEQ ID NO: 3257 - DNA, 240 bp, Cryptosporidium hominis
atgcccatccaaattacagacttgagagattttatcaatacttctagacgtgctgatgccagatcagtaactgttgttaaggtcaagaaagataaccacattacaacaaagttcaagattagatgcagccgttatttgtatacattggttatgaaggatttagagaaggcaaagaagttggagtcatcattacctccaactttaaagaagactacaatttctcgctctgtaaagaagtaa

SEQ ID NO: 3258 - DNA, 2043 bp, Cryptosporidium hominis
atggaaaaggttgaaggtttatatcaggaactacagcttttggtaaagtctgagcagtacgaggcagcatcacatatttgtgacaaaattaggcttttaggatgtatggacagcgaagttttgaggacaaagatatactgcttgattcagagaaagatgtggaaccaggcactttttcttatcaaatctcttgaaaaagatgaaattgagttaccttttgaaaagtcatattgtctatatagaactaacaactataaagatgctttggagactttggaaactcttggtgatccaacgaaagccttaagtaaattggaaaaccgtgcaatcacccatttgaagatccagattttgtatagattaggtcaatttgaggagtgcgaaaggctttattctattatggagcctatcattgctaaggaaaacaactctgtagagctggaaatgcttcaagttaaccaattagcagtattttcctcaattcgcaatattaacaaaaatattgaagatttcgacattcctgactacttaacaaattcaatcgagtactggtttaatcgttgttgtttatatttatccaataatgatattgacaacgcaatgacatctttagagatgtcagagtccctctataactcattattggaaaatgatgagtcagaagatcaacaatctccagatgtttctgatgagtgttctttggctctcatgagagcctatattatgcaacaaataggccaaaatgaagaagcaaaattgctttacgaagactcttttaaaaagtttggacttgatggagtaaaattagaaccttcaatggtccatttgggtgtagttgcctataacaactactttatactttcaaaaaatgataatcctcatagttatattgatggtcttaaacgtctctctattacttcgaaggatcaaattgaacataaaatgacagttaaccaaaattttattatctctctaaataaagctctattattatataatgaaagtggatttaagcaatatattaaacaagcagagaagttttctgtagataaattaaaactggatttattcaaaatagggttattccttttacaaggaaagacaaaaaaggctgtacaatatataaattctgtatatagcaaaaaccaagataatattgaattttccatttcggttcttaagatattgctcaaattaaaaatgatcaataatgccttcaaaattctggattcaaatattgatcaatatatatgtaactttggacagtggacaatttctccagaattatttaacgaacttttaattttgattcataatattctaattgaaaagttttccaactccgctattgatatgattaaacaaaagctgaaatttattctgaaacatgcaatatcaaaatctactagcaataaatcaaatagcagacttccttccttattatgtgtacttggaaagcatcttttgatagccaatttagcctccgaagctgctgaatgtttccgcttcgtacttgaagatttaggtgactctaataatgattctgcattgtctggatatgtttctgcctccacgctatgtggcaatgaagtcccaaaggtttatctgagacaattggacaaaaagcttcccagcaatgtattttcgatagatgctgaggttcttgaaaagatggaagcccctactagagctccagaaaaggatagtcacgattctaaatctatgtatcatggaaatttgacaataaaaaccaaatccaagcacaaaaagagaaaaccaagatatccaaaaggatttgacccacttaatccaggccaggcaccagatcctgaaaggtggttaccgaaagaacagagattatcatttaaaaaacttaacaaaaacagaaactcgaaaaagggtcaaattggaaaaggaggacaccaaggagccattccaaccagtaatattgaagccaagcccgctgccccctcgacagctaaacaagctgcactttcctcaagttcaggcattagaaggtctcataagaagaagagacgataa

SEQ ID NO: 3259 - DNA, 852 bp, Cryptosporidium hominis
atggaactggatgcatcatatcaacaggcagtagagttcaaactaaaagaggaaaatagtttgttttcaaaattcctcccagatttaatctctgcacttcctggtattgatgaagcactgggttttgccactttaatgcagtcagttaagtcaatgtcctatagtgtgatagtatttgacacagctccaactgggcatacgctgaggctattaagtttcccctcattattagaaaagggtttatcgaagttgttttcaataaagcaaaatatgtcaggagcacttcaactaattaattctgtaagtggaaatgcgatagaagaagagacactgaattcgaaattggaggatcttaaagctatcacaacttctgtcaaggagactttccaagacccatctaaaacaacttttgtatgcgtttgtattcctgaattcttgtcagtttatgagacagaaaggctaatccaagagctagccaaacaatccattagttgttctcatatagttgtaaaccaagtaatgttccctatagatcttcctagtggaaatgatcaaggagagtcagttctaaaagactcgtcagagcttttaaaactggaggatatcccttcagaccattcaaaattggttgaattcactaaaaaaattgtttgtagttataaccaactactttcttattcaaagttattatattcaaagtattatagtaaaaggaacatgcaaatgaaatatttggaacagattcgagatttgtatagctacgacttccatgttgcatatattccaacactaaataatgaggtaagtaaaataagagttttaataagcgaatttatcaatattttatgctaa

SEQ ID NO: 3260 - DNA, 1293 bp, Cryptosporidium hominis
atgaggaatcttctgaaactcatcttaacgctttcctttgctcctctatttgtgacatgcttatatgatagtagctcacaggtaaaagttattaatggttcacaacttaagaagttagttaaagaaaatcccgttgttatagtagaattttttgcagaatggtgtggacattgcaaggcgtttgctccagaatatgaaaaagcagcaaaagctctcaaaggtatcgtgcctgttgtagctatagatgatcagagtgatatggctgaatatggtattcaaggattcccaacagtgaaagtattcacagagcactccgtgaaaccaaaagatttcactggacccagaaaagctgagtctgttttaaacgctgctctttcagcacttaaagatgtaacaaactcgcgtctaagtggtaaaacttcgggtaataagggatcaaacaagactaaggaatccagtaaaaaatcaagaaagtccagcgttgttgaacttactgatagtaactttgacgatctagtaattaaggataaggagaattcttggttcgttaagttctatgcaccttggtgtgggcattgcaaaagccttgcccctgattgggaggagcttggaagtatggcagatggaagggtcaaaatcgccaagctggatgcaactcaacacacaatgatggctcatagatataaaattcaaggatttcccactttgttaatgttccctgcaggagaaaagagagaaattactccagttaattataacggacccagaacagctaatgacctttttgaatttgcaataaaattccagtctagctctgcaagtatcaaacagatgatcagtcaggaagtttttgagaacacatgcacaaagggattgtgtgtaattgcattcctacctcacatagcagactccagcgattctgagagagaaaaatacttgaagatatacaaggatgttgtttcagcctcagctgcaatgacaattcggttcctttggtcagaggggggatctcagttcgatttcgaagaaaagctgaaccttgcattcggatatcctgcagttgttgcaattaataacgagaaacagagattttcaacacatagagggagcttcacagtagaatctcttaattcatttattattgcattgaccacgggacgcgctcccgtggatcccttacccaagctaccaaagatttctaaagtaagttcctgggaaccaaagaaatcgaaagaaaattcacatgctgaagaaaatagaaataaatcaaatcgtcagtctgacgaactataa

SEQ ID NO: 3261 - DNA, 2076 bp, Cryptosporidium hominis
atggacgaaaatgaaatgggtggagataacactgactttttacagtttagattaagaggaagaggaatatttagtggtggtccaaacagcccagataacaaaaatttttgtagtgaaatcaaaagtgaaaatgagattccagaatcaaaaatagatctagaatcccaatactcactttataagataattcaagagttttcactcgaggaattagcatactttcaggagtgggatgtcatattttcggactgggtggagtttcttcattcaaggagcaatgtagctgaccttattaattatatcttaggtgttttagaacatttgacacgaaaaattgagcaagaatgtacatgtaatactgaaggctttggtgaaattattattgaaaaaatactgtcaaatttgttgtgtaaacatttaataaccagcaaatcgaatgattctgaaaattcaggaaagattattttaaatacaaatatgatatacgagcttattatgcatctgagtgattcatgtgtgaagacttattctgaaacaatgaaatgcattcaaaagataatacatttctctcagctcgaatttagtcatggggatttttcctcttcatttaagaataatggttctggaaaatcgcgagaatatttaattgatgggttaattatgcagctatgtaaattagttcaacatcaaagctcgataatcagaattgaagttgttggaatcctaatctatgctattttggcagtgccgatgtcatcaaaatatccatataatccaactagaatcgtccaagcacttgtatggtcaatttacgatgatgaggaggaagtagtctgtcgttctattgacggcttaagagtttacctttcagtagtaggcaatgaatattttaatacagttataaatttggctgttgatgcaataccacaagaaagaaggcaaaactccgtttataatcccttaagaatgcttcaccaaaggattttggaaaatgctcagctaccagatatagaggatggttctataacatttgcagattttaatctttcttatagtgatagcttactaaacagccaagagtgtaaaattaacacggaaattactaaagcaaacaaaacttctgagaacacccactctggaaataatagtaaggtttcgaagttcaagcaaaaggagggtaaaattggtcagacagacaacaaatctatgcctaaatctaccctcaagattcagctaagcgctaaaagaacagaaagtacaaatttggaagatgatgtcaatattggagatttcccagaggcatgctcaatgaataatgagcgtctggaagttattacaaaaactgccattgatttcttattgaacaacgagctttacattgagaactggagtcgtgttgttgaagaaattactaatctgagaagaattattatatatcactcgctgtttctaacaaaacctagcaattcacgtcctccatcaactaaaaaccttatctcaccaactttgattggggaaagcattgctaaatggatcagttcactcagatcttgcgttagcaagagtgccatgcaagggatagaagacttatatctgcattgtggatcatccctagatctcggtaagctattggatatttgtctggaaaagatcttgaaacgtacaaacgacagaaacaaattcattgcaaacgatgcaactaaaaccttgatagcaatttgctcaattaaagcaggtgataaattgctaggcaagttaattaatcatggttcaaaaaacagaagcacaattgttatttataatactcttaaggctactgcaattgtattggaaaaaatagggccaaacattgcgaaatgtggcaatctacttgcatgtttggaattcattcatgggaatattaacggtccaacgcctgatattagaacatactcgaaagtatgtattaagatcatcctgaataatgtagattggaaatgcgttacccagttcctacgtaaatctgttgctccgtttaagctagcaaatatgcacaaggactttgagaatgcagtgcaaggatccagaaagcaatag

SEQ ID NO: 3262 - DNA, 2181 bp, Cryptosporidium hominis
atgaggtttggttcaaaaggaagtgggatttctgtgttgatagagtcaacaacatcgtctggagaatctcatgggttatatgattatgagaaaaaaacaaagtttaatcagactctatcgatagatgatacgcaatgttcatatataatttttctagaaaatgagaccggacaactcattgttcagccagaattagatgaaactataaagccttgtaacaatttggaccatgaatcagatcagaatatgaagcatggaataaatagaacaataataagtaatattcaggactttggcaaggagtttgtgccaatacttaggttatatttatttaagaactcctggtttgtagaagttattaaagatattaataggcaattaagaacatcgggttttcattgttctcaatattcatcagcatctggtcatggtacaggcacttgcctcaatcctctcccaaagtctagttcaagtaaaggaagaaatcaatataaggaagataataaagtttggttagtggctcccaaatcctcacctggaatactgcttaacaagggagatcttcttaaattcggtcgttgtaaaatgctggttcatgacattataaatacatcttcacttgcgaaagaagagtcatctaaagcccctttcttaacgttaatggggcaccaggattttcagacgaattttgaatcttttttacaagcagctcctttggttgaagccgataaagagccagaaatcctagcgtattccacaaactacattctagagaaagtgctgagaaactattcaaaaaatgatatcaaattagttagtgacttccaggataattctttggtcaagtgcgaaaacgatatttccaagtttatggcttcaagccccacatcaaataatgcaactcgcgaggatctcggctcgcaaatcttaaacaaccaagacaaccaagcgctaaaagttgaagattgcgatccaacagtattaaatcctagtgtaaaaactcaaattcaaactaaattggaccgagtaataaattgtgaccaaaaatccaaagttaatagatgttgtaggatatgtctttctgatgatgctgatggttttactgatacaaatgagcctctaaatccattgatttgcccctgtgattgtaaagggtcaatgcaatttgtccatcttcaatgtcttcgaacatggcttgaatcgcgtctggagatcccttctgaatggttcctccatactggaagagaatataatactattgagagctttataaataattctatccaagttcaggatggaactgatgatccttctcaactacattttcgtgaccgaatgagatttaaagttatcaatcttttcaagaaatgggcatcacgcttttccaactccaactgtaaggtcaattcaccagcatgtttacacttgaagaagttcgaatgcgaactatgtaaagtttatttccccactcaattgagactcatcgataactatgcttccagttcaacacttattccattatttagagttcctcgacctagatttccatacctggttcttgttcctctagagggagacttttcttcaaaaattggtcagattgtggtttcctttggtggaaccagtacatcagtttgtattggtaggggtcataactctgatattagattgggagaaattagtgttagtaggtctcatgctcaatttcagcactgctattcctctggttcttatcagatatgccttttagatatgaagagtaagtttggatctttagttgagttcacacgcccaataaaacttggaaaagaaaacttatccgtacaaattggtaagactctcgtttcatttaagactttcaagtcaagtggatccacttccaatgcacttcctttcttctcaggttgcatcggtcgtagagtgactatcagtgattctcaagagttcaagattaaaagccaaaaaatttcaaaaagtgttaatctcacatttgattcctcatatgagttgggttgtggggattctgaattaattagttctttaagaaatatttcaaacgtaaccaacagccaccttgaagaatccgataatttagagggagacattaaacagtcacaaaatttcaggaatgtttctagttgcagaatacctcggaggcacagttatatttttgagccttga

SEQ ID NO: 3263 - DNA, 1587 bp, Cryptosporidium hominis
atgatggctgaagttaaggatgattttaagtttggaaattccagtaaatacagacgacatagctcattatctagtctaaaaggcctcaaggacaaaaagttgagaagcaagttaagtttgcagcaacaaatattccacacagcatcagaaaggctggccaatagtgagatacttttacctgaaacaccaggctttcttgagactgagggtttagagaagagtttttcaataactcaaaatgagttgggtgaaaacattagtataggggcaataaacaagcgtttttctttagacttatcctccgggccttattctataaattattcaagaaatggaaatcaattattaatgggtgggagaaaagggcatatttcaatgcttgacgtatcgaatggagctcccaatatcctacttgaactgcctttagaggctgaacaaatcaatgatgtacactttcttcatgaccatacattatttgctgtagcacaaaagaagtatatttatatttatgatcgtgaaggaatagaaattcattgtatacgtgatcatgtaatgtcgccttataaattggattttcttccctatcactttctactttgcagtattggagagtttggagagcttagatatcaggacgtctccaccggtcaagttgcagccttacacaaaacaggtagggggccttgtcatattatgaaacataatcaatttaatggagtaatacatttagggcacagcgatggagttgtttctctttggacaccaaatgtatcaactccagtaatggaaatatttgcacaaaaaggtggacttactgccttggatataagcaataatagcttgattacagcaggtaatgataactcttggaaggtttgggatatccgaaagtgctctgagtatactcctctatatatctataagtcttttggaagctcagtaaggtccgtttcaatttctggtactggattagtagctttgggctttggtagtcacattcaaatctggaaagatttacattcaaagtcaaagcaaaaaatgccttatattactcataaccatcctgcagcccgtgtttctgaggttgaattccagccttggaatgatgttttatgcattgggcatactcacggcattgaaactataattgctcctggtgctggatatgcaaactttgactcgagagaatgtaacatctttgaaacatccaaacagagaagaaacagagaggttaggatgttgttagaaaagcttcctgcctcaaccattacactgtatcctgatcttattggtaaggttaacaaaactcctcgtgcagttgaggacttagaagaaaacacacaaggtgagaataagactaaaaagaaaaagaacaaaaagcggggaaggtctaaaataaccaacgtcctcaagaataagcaaattgcctatgcaaatatggttagaaccaaggctagtaaaactgcaactcaaagggaaatgaagcaaaattcgcaaaaagctggcgtcaaatcaccagctagaacagccaaagcatctaagaaaactgttactagaaatgcactagaaagatttaagtcattctag

SEQ ID NO: 3264 - DNA, 1518 bp, Cryptosporidium hominis
atgtcaactttgtatttagaagctgccaaagtattgaacaagatagagaagaagaatgttggaattcgttcagtaatttattctgaaaaacaaaataagtgtaatattaggaaactaagcgcgcttgttcatggagttagtgggaaaagaaaggagcttgaactcattcttcaaaaaagccatttattagaggattcaaatatcaaccaaatttcaaattattggctattactagtgttagcttatgaacagctatttgggaatttgaagattcagggtggaggggccctagcaaggttggttcggaaaaataaagataagctttatgaatgtttttctaaggagtatccagatctaatcaatcaagttaaacattctaaagtttatgagcaaattccaaggtatctgagggtaaacactactattgaaagcgctgaatcagtattgaactctatattggatcaggttaaacagacaaatcaatttgcaaatgatgatattcaaaattatatttggattgataaacatataaaaaatgtgattgcatgtaaacatgaggtagccaaactgctatgcttagatagaattccaagcagtaatgagctcattaaaacatctaaagtagttttacaggacaaaggaagttgcttttctgccatatgcgcaaagatcactccgggagattttgtattagacgcttgttctgcccctggaagcaaatcactacatattattgacatgttgaataaaagaggacgcctagttgccttagataaagattcaactagaatcaaaactttgattaaacggatatcagaagttccatatctggctggaccttttgtttataaaaagaagaattttgaaacgattcaaattgaagatatttcagatgaatgcttattaggcgaaataggctgtatatttttggataaggaatcaaaacttattcgaaataataaattaataatgattgattatttggataattttaaaccacccgatctacttattcatgttgcaaagtgtgactttttgagtctaacaccaactactgaagatcatctcttaccttggtatcactataaaaacaccatatccaatttacgtgtaattgttttagatccttcctgttcagggagcggattacctcaacatggtaaagttgaaggtgtaaatattgaaaagaggcttaaaagtttatcagagtttcaaactaaaatgttaattcattctttatcatcgtttcaatcagttgagactgtttgttattcaacttgctcaatcttcacagaggaaaatgaacaagttgtcttgaattcccttgaaaagtgcaaaaatagtggcaatttacaattttcactagaaattgcgcttgaaaactgggaaaaccctaatagatcatatcaagattcttcttttggagaaatctacaagaagtgtatattcgtaaatccagaaacccataattgtaggggattttttctcgctaaatttgtaaaaaattcatctagataa

SEQ ID NO: 3265 - DNA, 1227 bp, Cryptosporidium hominis
atgtttacacaacacgacttcatacctggtcatgattcttcggaggaggcaaatttgctgagccatagagcggtttatcggccagcagtggacagcaactctttactggtagactatttggattctgggatttacaataacaaaaaaaagagctgctttactctaagtaacagtaatccgctggatattaggacgattggatttccatttgaattaaataagtacagaagtgacctgatatgcactcaacaagcccgtgtatcattacgagcaagagcaccatgtgtaacaattgaatggtatcctgggggaagaaggttggttgtaggtactgtcgggggagagctaactctttggaatggaacatatttttcatttgaggatctcaagagtgttccatcagggcagggagctgttttggctttgaacttttcaaaacaagatgactttattgcatgtggagacggaagtgggaatattgttttgttaaccccttctttagcaccaattgcatcattcagacaatttttaggtcatgttgttagagatgttacaatctctcccactggaaacaaagttgtagcagcagccgaaaatgtacaccctataataattgatgttggctctcagaaaattgaaagctcactaacttcaagaggatacgatataacttgtgcacagtggcatccaattaaaggactcattgcaacagggtctcaaacatatcagcttcatctttgggatcccagaactgctaatgctattggaactatttttggtcatagacacaccgtcgtacgaattaaatggagctcttctggccaaatgcttgcttcttcaggaaaggacggtgcgttaaaaatttgggatattagacagttatcaaagccaataacaacttacagaacaaaatgtgatgcagtaagtatttcttggcatccagaagttgagtctctaatggctgttggttttttcgatggcgacatcgcttattataatatagatgttaatttcggaaatccactcggattaattccttcagcgcaccaaggagctgtttggggagttgcatggcatccactcgggcacttggttgtttctagtggtcaagactcgagacttaaaatatggtctagaaatttgtgtgggagtcctggaactataaatgagcatgaaatactacctcaattatcgcttccacggcagaatcctactaatactaaatga

SEQ ID NO: 3266 - DNA, 1887 bp, Cryptosporidium hominis
atgaactctgcatcccttcctttaagggcaccagcatcctctatattaacaagacctggatatgtaatgaggtacccacgttcttttaaagagcaggaaacatttacaaatggaggtgtaagttcccaggtttcaatgcatctgcctagcgagaactcacatcttaattttgatttttcaagagggatgagaacgttatctgcaccaagcatgtcaaccccactaaatgctttccaaacgacgaatactcatttgaatcagcctgatagatttggtttcgctacaaagtctatgacatcttccctgaatgtctctgctgctcctcaaaggttatcttccttttctcagatgccatattcaagtatgaatgttccattacactctgagtatagttttaactctattaatactcatcctggatttctacgttctggaaataatccggcagttcaaggaatggtaagaaacaatgtgttccagaatcaatcacagtacccaattcagcctcaggtgatacctccgcaatacatgatgcaacaacatgcttttcagtttcaaagccaacaaagtcagtttggagcagccaacgaacgacacgtgggatttgctggaaatcaagctggttttaattccattgctccaaatcaatattctaattcaaagcaaattcctctcaatcccgttgaccctcgtgcatttgaccgtaatattgtgcgcttaaatacctttagtcctggtgtacaaccacaagtaatgcatcctaaatcatttcagaacaataatggaatgcaaattcctcacagaagctacgaattcccgcagaaatttgcccctgatgttagaggaaatgggcaatccttggctggagatcgctttccaactctgaatttgtcccccccagtcactggaggggttactattaaaggatataaaccaactgtagtcactgagaatcaggataagtccttgatcattgatctcggtccaaatgcatctgcatatgctgttttcgatggtcacggaccccatggtgacgttattgcagaattcgtatcgaacaaatttacctcttcaattacgcaacttttgtcctcttacgttggaaacctctccaataacattactcctcccacaagacaacaaattaagaacttcttcatagttctattccacaacatggaccttcagctctctgaattaaggtacggaatctcaatgtggagtggatgtacagctgctgtttgtgttagaatctttaacgaagctcacattgcatgggtgggagactccagagttgttatttacaagttcacaaagcctatctacaaaggtttagattctttagataaggattctacaacaaattcctgtgagccttctatttcatggtggacaacttctgaccatgtccctaacaggccagatgagctcagtagaattactgattgtggggcatctattactgtctactccacgccttggctaaacaaatctaccaccaggatccgtgagcatgggattgctatgagtagatcctttggagacaaagctggctcgcagttcggagttatttgcaagcctgacatggcaagtgtcaagcttgaatcagataataattcttgtgaatctgaagataagtgggcaattgtagttgcatcagatgggatctgggactctatttctgaagaagaagttgggtacaagattatgaagaatcttatttggaaggagccagagtcttctgaagatttcccttcaaacaaccagcgccccacacaagaagaagtaactgaattggcaaactccctttcttccgaagcttggagatttagggcatctgtagagaattatagtgatgatactactttgataatttctattatatga

SEQ ID NO: 3267 - DNA, 327 bp, Cryptosporidium hominis
atgtactttaaaacctcaaaacactggatggtcacgatcaatgacgagtcgtgtattactgagaaatttaagctggactggtgtaatgagcactcctaccattgggacgtggaaataatatccaagagtcctctgacagctttgatcaagcgtagtaactcatgtatcacagcagtggatagccaacttaagctcacaccttgtgagacaaacaacaagttccagcaatgggaaattgagtcttatgatttgagtaagagagtccttccctccccagagaatctccttaaaaagaaaggatttagaggtactagcgattataactag

SEQ ID NO: 3268 - DNA, 1107 bp, Cryptosporidium hominis
atgagtttctatctcccaaatgaaaatacgggagtggatgaggagctggggatttcatggacagttcacttagagccagccgaggaaattgaagatgttattaaccagtcaaacttcaggagacttgaagatcctgagactcaggcaaatattacattcgcaaatgccttttcagccgagccatgtgaaggatctactacccataataataatcaagaatatcaagtaataactgagaatggtgaagccgataataggataatgctcgcgattgcggttaacatacttattatggttgcaatatttggcatattcaccacaattcttgttcaattggtcagagattggggaaacaaatgcgatatacagctgaaaacttggtgtattgtttggctatctcgtttcttgttaacctcagttattagatcaatgacaataattatctcaaaagtatatcagactcagtcaccttttatactggttcttattgtaaatgttttacatatatttggcatagcatggtggttttatgggattaatttaatatattcaaatccaccagaattaacgtgtagaaagaactattctatcgcattattcctgttctggttccagtttgtccaaatttttgtacctattttactcccgatcatactatgtgtgcttattctctatattctacacagaaatggaattcgaacggaaaaaaagaatgttccagaggaattattgtgcaaaattcaggcaattcctttcgttgaacatattagaaacttaaacaatagtgctcatgtcacaattttcgacgaaaatcagtctgtcgttgaaacacaacattatccaggtagcaaatctgaaacgcggctaaacgtcatgcaagatgatagtactcctagttttaataaggaaaaaagtatcacaatcagtaaatcctgtccaatctgtgtgcaggagattgaagatgatgcaactattagagtacttccatgtgattctaggcacatctttcacttagagtgcatcgacggatggtttaaacagaattgtgtttgtccaatttgtaggtcagatatagttcaaattctaaatgagactcaagctaagtga

SEQ ID NO: 3269 - DNA, 321 bp, Cryptosporidium hominis
atgtttgattcgatagtagggtgcattttactggatacagatgggaacagaatagtgtccaggtattatggaaatttagaaaacataggattggcagatcatgctgctcagcggcagttcgaagaacagcttcactcaaaagggcagaagctttctgggaagaccgaggcagaagcattgtttgttggtgaaatgctttgcttggtcagatttgctggcgatttttcaatatatattgtttcttctccgtcagaaaatgaacttatactttttgatgtattaaactgtatatataattccttatctataataattccgtaa

SEQ ID NO: 3270 - DNA, 3390 bp, Cryptosporidium hominis
atgataagtttactggaggacccacacgttaaatcgtgtgatgagatccttcgacattataatgtagattgtgatgtaggcctttcaaatgggcaagtagaacaatatactcaattatttggcaagaactcattggaagaacctgagaaaacatcctactgggcattgatattggctcagtttgacgatttacttgttagaatcttgttgggtgctgccttgatgtcattcttcttcgcgttaattggtgataacgcatatgaagagggtatttcagcgtttattgagccaattgtaatactatttatcctaattcttaacgcgttcgtgggggtttggcaagaatctaatgcagaaagtgctttggaagctttaaagaagcttcaaccaaagcttgcagaggtattaagatgtggtatatggagcgaaattacagctgaagatcttgtaccaggagatattgttagagttcgagttggagatcgcgttcctgctgaccttcgtgttattaagcttctgacttcttctttaagggttgagcaaagtcaacttactggagaatctactggagtattaaaggattccaattccctggacatatcaaagagaaatattgaaatccaatcaaaaactaatatcttatactcctcaacaactatagttcatggatcttgcattgcatgcgttgtctctacaggaatgcaaactgagatcggagcgattcaatctgctgttcaaaaggcttctgagaccactgaagacactcctttaggaaagaagattgatgagtttggagaaattctcagtaaagttattgctgtgatttgtctcattgtttgggttatcaattttagaaatttccaagatcctgctcatggatccacaatcaatggtgcaatctactacttaaaaattgcagtagctttagctgttgctgctatcccagagggacttccagcagtaattaccacatgtctagcccttggaacaagaaagatggctcaaagaaatgcaattgttagacgtcttccatccgttgagacattgggatgcacaaccgttatatgcagtgataaaactggtactcttacaacttcagaaatgtgttgtgtacaattttttgtcccaagaagttttatctcaattgacaaatatactgttgaaggtcattcatacactccaattggagctatttggatgagtgatggcgttaagacaccaaaagaatttgagaacattacggcagaagatatcaatcttcaatggatggcaaagtgtctagctctctgtaacacttcccaactcaatcttgttgaggataaattcaaaattcaaggtgaacccacagaaggtgctttaagagttttagttgagaagcttggatgccctgatattagattaaaccagaaatatcaaaataaagaaggctcaaggacatcaaaaacttcaagcgtttttaacgactactggtgtacaggtgtaaatctaatcacaacattggagttccatagagaccgaaagtccatgagtgttttatgtagagatactggcaatgttaatgtacaattggttacccatagaagttctggagaaactgatacatatgagagttcaaatgtattatatgttaaaggcgctcccgagggtattcttgataggtgtagttcctttatgatgcctgatggtactattgaaccaataactgattcattcaagtcactagtcttagataaagttgttaatatggctgataatgtacttagaactctagcatgtgcagtaaaggttgataatcttggtgaattaagtacttataatggccagccaaagtctaaaggagctgctcttctaagcgacccttctaattttgtcaatattgagaaagatctctgttttatcggtgttatggggatatacgaccctccaagacctggagtaaagaatgcaatccagagatgccagaaagcaggaatcagagtattcatgattactggagataatcgaaacacagccgaggcaattgcatcttctattggaatattaagaggatcaaaagaagagtgggatatttcaaacttcatcaatgaaaatagcaatcatttctcaagctcttccacaattccaagcaccataggagcatttatgttagaggaaaataatatttctaatggccatatgaattctgacaagagaaatttgcttcgtactggtagcgaggttctcaaagctcagtttactaggtactgttcactaacaggaagggaatttgaagaactttccgaagcagataagcttaaagtattgaaagagtcttacggagttgtttttagcagaacagagccacgtcataaacaagttattgttcaacttttaagtgagctaggcgaaatcactgcaatgacaggagatggtgtaaacgacgctccagcattaaagcaagcagatattggtatttcgatgggaattactggaactgatgttgcaaaagaagccagtgatatggttttggctgatgataattttgagacaattgttgctgcggttgagcagggaagatctatatatatgaatatgaaagcattcattaggtatcttatctcgtcaaatataggagaggttgcatccattttcctgactgctgctttagggattccagagggtcttgccccagtgcagctcctatgggtaaatttagtaacagatggtcttcctgcaacagctttaggttttaaccctccagatccacgcgttatgaggagacctccgagacgaaaagatgataatttgatttcagcatgggtgttcgttcgctttttgattgttggactttatgttgggatagcaaccgttgggatttttgtttggtggtatgtttggggaatagatccctcagatggaaataccttagttagcttctcacagttgagtaattgggcaaagtgcaacacatggataggtttctcaagcaattctgtctttggttccacacaatcagagccatgtacttatttctctataggtaagaagaaagccagtaccctatcactaacagttttggtagtcatagagatgctgaacgccttgaacgcattgagtgaagacaactctctactccaagtgcctccatgggccaatcctttacttctcgttgcgattttgatttcagtgtttgtccatctagtgattctctacgtgcctccaatctcagtcatattcaatgttgttccactcactatgattgactggttagcagtattaatttgttctttgccagttattttgatagatgaagttctcaaagcgttttcaagaggttataaccaaattgtggacttcccagagcaaacaagctccataaattcaaaggaaagtggaaagaagatgaattga

SEQ ID NO: 3271 - DNA, 405 bp, Cryptosporidium hominis
atgaagcctaaattgtcaacttgggttccattaagctcatctgaggtttatgaggcaatttctaaaactgactatgatgaaatagataaagagtttgagacaccatctctcgtattcttcaaaaaaagtctgaaatggtatttagagtcatttcactctgttcatttaataccacaaaaggaattcttttctttggctgaggctctttattcaaaatatgacttgtcgcaacaggaggttatgcaaattattgacattaggccaaagaaacaggtagaattacattgcattattccagactgcgaaaaaaggttttcagaagaagatatttttcagattttaaaattggtaggcgaaatcccaatcaatcaggaagaaaagaagtgcccagaagagaaattatga

SEQ ID NO: 3272 - DNA, 1599 bp, Cryptosporidium hominis
atgtcatcagtatcagtactgaatccaaaagcagatgttttgagaaaatcggctgcctttgctgctaattgtcatgcagcaaagggcctccaaaaggtaatcaagacaaacttgggtccaaagggaaccctgaagatgttagtaggtggaggtggccaaattaaggttactaaggatggatgtattttattgaatgagatgcaaatccaacatccaacagcttcaatgattgcaagagctgcaactgctcaggacgatatatccggagatggtaccacctctattgtaataattatcggagaaatgctccgtcaagcagaacgctatgttacggaatctgtccatcctcaacttttatgcgaagggatagatttgggaagatctgctttaatgaagctattggatgatatgagagttcctgttgagaaaggagatagggagactttgaggtgtattgcaagaacttccttgaaaacaaaactctctaatgctttggcagaaagtttggctgatattttaactgatgctattcagattatcactaatgaggattctaatctcccagttgatcttcatatgatagagattcttccaatgaaacatggcttgacttctgagactagattagttcgtggtatggttatggaccacggagcaagacatccagatatgccaaaagagttaaaaaactgcttcatcttaactctaaacgtttctttggaatatgagaatagtgaagttacttcatctttcaaatattcgtctgctgagcaaagggagcgcttggttgaggcagagagagcattcactgatgagaaagtcaaaagcattatagacttgaagcgcagagtctgtgagcaaaatccaaacagctcatttgtagtacttaaccaaaagggtatagatccaccatctcttagtatgtttgctcaagaaggtattctagctctaagacgcgtgaagagaagaaatatggagagacttactctagcttgtggaggtaatgcaatgaattcagttgaggatttgtctattgaagacttgggatgggctaatcatgtctatgagagaagtattggggacgataagttcacctttgttgaggatcttaaggattgtaagagttgctgcgtcttggtaactggtccaaacgatcatagcatagctcaggttaaggacgcaatcagagatggtctaagagcaattaaaaatgtaattgacgatggttgtgtcataccaggagctggagctttcgagttcagagcttacaacacactcaaagagacccgtaaatctgcaaatggaaaggcaaaattcggtctggatatatttgcagacgctctcctcgctatcccaaagactctcgctgagaatgcaggtcttgaccaacaagagactacccttaatatcctcgataaaatcgaggattctaagcaacctttaggaattgaccttactacaggtgaagagttttatccgcttactgaggggattttggataattactgcgtcaagaggcaaatccttagcattgctcctacccttgcacagcagctactgcttgtggatgaggtcattaaagcaggaaagcaaatgtag

SEQ ID NO: 3273 - DNA, 1827 bp, Cryptosporidium hominis
atggagaatcatgctacttatgggtatcgccactatggacacttggagggttctggtccataccctggggttggtggtataagccaacctcaagggtttgggagtaatcacaaaatcactcctccaagaggcggaacctcggtatgttttggttttggaggttttttagtcctatgccatgcaaataactcttcacaaattttgagtataagtaggactttgagggaaagggtttccagtccagacttaaaggctagcattagacacgaagccaaaactagcgcagggcggaatcaactttctcaagaagataaatcaaaaataaatgcatttttaagctctgagaaggccaagatgagccctctccaagggtctcgagactatttagggggatttcgtaggagctgtctttttgagttgctctctttgagtgtgagccgtggttatatcgtaagtaatccttcagactacgatacactatttgctggaattaagtctttttcagagcttggagtgtggaggtgttgttgtgaggctaatggcaagcctatagaatttgtatcgagtcgttctttgttgggtttattttgtgggacttttggagtttccagaaccctggagatgcatagacaaggaagagtagaacctaataacagcttaaagttggaaatttcttggagcgataggtttgctctgagtgggttttgcggagagagggagttaagtagctgttacctcgattatctcaaatcctgcaaagaggaatctcagacaagctctatccgctccgggctggagtgtaaatgctttgagggaattttagaggcactttatcttagtattgctcagaaagcagaacactttgaagttagcgataaagtacttgaactatggcctcattatgtctattccttggtctcaagtcttggagcctctcatgcagggtccaggaaccttttgacatccatttcaaatggacttttatctgacattatggatcaaaagtctagtctgatgcacgatgaaaaggtttttggttggcagttttgctctctaattttgggagagtacagagagattccaacagggttaaattcttttaatttggagacttacatcacctgtatggatattgtagctcttcttttccatgtgacaagtaaaagcagttccggtattgtttcaagccaagattctgtattaagcaggtactcatcatctctttactttacagagcttggatgttttgagaggtcagaattttacattgattgtatatctccgtatttgtccaagggtattgggtctataaaaagtaatttaagcaaagagtgcgaattcctcaagattaggatccaagagcggaacatgaaccttagtagaagtggcactaatatgggggccagcaaggctccagaatttgcaactgagagctatttaacagaaagccaagtttcaactggaacaaagaactcttcttggatagtgggttggatctcagataatattaaaaaggccattggtacagaagaagatcgttggcctggagtagaaaatacattttacttcgacaaagagatcaaccaatggtgtcagagggggcctgacggcaaaagaattactaacgagactcccaaagttgatgggtcaagtcttttgacttctggaggtgaaggcaatggagggctacaagcctctcagacactagtagcacctcctcctcctcctccccctccttcctcacaagggataacatcgaacaaaggagccaacacgaacggaggaattaggtctagatatgtagatatttttcaaagtaaaaaataa

SEQ ID NO: 3274 - DNA, 558 bp, Cryptosporidium hominis
atggttaacctctctctcaggcttttatttaagccatgcactgagttccttccaaggttacatcaaaatttgggtccagattacgatgaaaaggtacttccctcagtagggaatgagatccttaaggctgtggttgcaaaatacgacgctgaaagcctccttactcagagggaaaaggttagcagagaaataagggagtcaatcatgcaaagaacaaaacaatttgacattattatggaggacgtggcaattactcatctaacttatggaaaagaatttgaaaaagcgattgaagagaaacaagttgcacaacaggatgctgagagagtcaagtttgtggtgcaaaaggctgagtatgaaaaacaagctgcaatcattagagcttctggagaggctcaggcggcggaaatgatttcaaaggctgtgtccaactcagggtgggggattgtggatgtaaggaggttggatggagccagggacataattgagaatctaagcaagtccgacagagtgacattaatccaaggagaccaacaacacttgcattttagagtctag

SEQ ID NO: 3275 - DNA, 1788 bp, Cryptosporidium hominis
atgaattttaatacaaatgtggtccctcttcccattgcggattgtagtatgtattcatccacattacttaatgaaaatggggagtttagtcctgaaaagttgcgaaaagaacttttaagggctaatgaagccatattgtcattaggacaacagaaacgcgaaggcaaacagattaagagtcgatttggagagaaacctccagattttgatgaaagtgcaagaaaaggatcaagttcttcagcttctggcggatttaccgaccaaattgttgatgaaacatctccttatgaggatgattatgacccattttcagacccagtatgcataggagatcaagtaagtgggagccctgttggccaatttccctctactagtaggtttacaaattctaagtattcccgcgagctagattctactggagctgttaattcaggtaaattacaaacttcaaatgcagttttacctgatgatacacatttagcaagcactgtaccaaaagattatttggcacaaaataagttggttgcaatacttgatctagataatacacttcttcatgcctataactcaaccaaaattggttgtaatattaacctagaagactttattagttcttctggagacccagaaatgtataagtttgttctaccacaggatttgaatacaccttactatttaaaacttagacctggtgtaagagagttcttgaatactattgctccttattatattatgggaatatgcactaatgcaaccagagaatatgcagatgtaattagagcggttttagatcctcagagggataaatttggcgatagaattgttgctagagaaagtgttgatggacgtgatacacaaaaagactttagaaagatttgcgttgatgtagagacacgcgctattgtattactcgatgaccgttcagatgtttgggacagctcattagaaagtcaagttgttaaagctcagacttatgaatactttgagcaacgtaaggatgctttaaagtctcattatcccccactatcttccggagcgaattcaatttcagcgaattcaagcgctcctggcgacattctttctgctgcactgtcctcattatccaatgccagcggtggcaatagtattgcagactatgatcgccatttggactatttaattcgagttttcaaagagcttcacacaagattcttccaaaaccctgagactgcatgtgttggagatattttaaagaagatgagaagcgagatacttgagaactgcatcgtttgttttactggattcttgaaggctgatgagaagcctattgttaaaggcctcccctccaattggggagattcacaggctgacgcagaatcagcagctattaggttaggtgctggtattgaggagaatttagaacctctagctacacatctagttgttcaaaagacaaatactgccaagttccaccaagcaaaaaataatccaaatgttaaaattgttcatacactctggttatgggcatgtgatggacaatggcaacgtgtatcagaagatctttttgaaggagagtctctatctgataagtttaaccaatcaacagttttaagaccttggaatgtgcactgggaaatccttgctcaaaaagagggtaaaactgggattcattccttaaagtttaggcttacatcagaccctagttcaaacactaatttaaaggagtaccagcaccctgctgcatggaggcagagctgtggagctcgtatttggtccccacgcgaagtggtaactttggtatttacttaa

SEQ ID NO: 3276 - DNA, 1986 bp, Cryptosporidium hominis
atggagcgttgttcttttattagaatgaaaaattttcagttatttaatttaattcacttttttttttttttaaaagtaatttgggtagcgggacagttatattttctctttggcataaccggacattacccaacaggaaagttaccaatagaggaaaaaaattccatgagtaataatgataatttaaacactaaagtttgcgaggacggagatgtattggaggatatcttagttgctctagagaatgataaaattgcaagttccatcaacaataagaaagtagcaaatacaattaagagggagaaatatgtcaatagaagcgtaccttatttgagtaatccatttttccatgagttgatgagaggcaaagaaaataaactaagtgatcttgaccaagaaataccaactcacttattagcaagaattgcacaaaaaagagaatcagcaccagaactatggaagaaattgtgggcagaaaagaggatttctgatgtaataaagaattgtggtgaagaagagattccaacaatggagaagatttttgtctcttgtattgtgggagaagaaaccaccatagtttcaccggagcaatattcttcagttactgattggtcatattacatttggtggttattttcaagacgaccagagatttcaaagatttctccaaagcttccagggcatgtagtgacagcagtagcatcaatggagtggagacttctacctaaagttaggccagacattttgaatttatttatctcaaaggtaaatacatacaagtcctcaaacccccctccaaaagcaaatgacaagggtatcactcaaagagattatttcaggaaattgatgaaagaattgaggtcagggttagaaaacaattttagtgaatggttattaccttttcttagatcaaagaagattcagattgaaggttttggacaaagttcaacgaaacatggtaactcaaattccattaagggatctgagctgatcaaagagtcaatgccagttgagaatattcccaaattgatttgtcgtgatattgatagatctcttgtgaaaaagaaaggacatgcaaatttggcccctactcatttatttccacatcttaattcctcggattgttgcttgcagaatcaaatatatcaaaacgtttacgtagaagagtattccaatttggcttggtcaatgttaaatacactaccaaagattgattttaaggttggaattcgtgtacagtttgtatataatcctgaaggattaaacgatgagttgtattgggtaaatggagagattgaatcaatttcaacagaaactggagaaataattttaaagtcaatttcttcaatagaaggaatcactccagtttctatttcaacttctcttctgaactttcttcctccttcaatccccacttttgaagttaagaaagattggtggagacttattcctacagaatctacaaatagtgacttttctaagggttcaatagttgtctataagtctggtggctcagatatgaagcttctggatggggttttagttgatattgtaggtgaaaatactaaaagaataaaaattaagagattaattgacggaaagtgtgaagaagtgagttctgatgcagttttgaaccgtattccgtatgacatccatccatttgatggtaaatatgatactgaaagttcactttcttcatggacttggtgtattccgaggcatttccaaggagagaattccaagggatcaaagggaaagctattgctatggtttgtttcaggagaaattaacatgataagtgacgacccacttctatgcgtatctattcaaccagatattccgtttaatcacggctatatttgggggccattgcctattacgtgctttattgatgtcataaatccaaatggaggaaacttagaacaaggttacaatttccaagacatagattctatcttagacacacctctaagcttgctagtttaa

SEQ ID NO: 3277 - DNA, 750 bp, Cryptosporidium hominis
atgacttacaagctaacattgattcgtcatggtgaaagtgagtggaacaaagaaaataggtttactggttggacagatgttagccttagtgagcaaggagtaagcgaggcaattgaggcaggaagaatgcttttagagaaaggcttcaaattcgatgtagtttacacttcagtattaaagagagctattatgactacatggactgtcttaaaggaactaggtaatattaattgcccaattattaatcactggagattaaacgaaagacattatggagctttgcaagggctcaataagtctgaaactgcctccaagtttggagaggaccaagtcaagatttggagaagaagctttgatgttcctcctccagttcttgaaaagtctgatccaagatggccaggaaatgagttaatctataagggtatctgtccctcatgtttaccaacaacagaatgtttgaaggatactgttgaaagagttaagccgtactttgaggacgtaattgctccttcaatcatgtcaggcaaatctgtcctagtttctgctcatgggaattcccttagagctcttctctacttgctggaaggaatgacaccagaacaaatccttgaggttaatattcccacagcatgtccacttgtattggagcttgatggtgatctcaaggtgacaaagaaatactatttgattagcgaggaagaactcaaggctaagatggaggctgttgcgaatcaaggaaaagctaagtaa

SEQ ID NO: 3278 - DNA, 3333 bp, Cryptosporidium hominis
atgagaaatattttgattctagtggttgagttggcattgataggaggatgtcttggggcaggatatttatctagaagtggaaacattgcaagaaatatggttaaaaggcagatcatggattctgcaagaactccacagattattagtggtattaaggttagcgatagaatgatgaaagatccagaaattgcagctcagattaagctggctgaggagcagaagaagatgtttgattctaagctaacatcaagtcctccttcattacccagactagaccgtcccaactttaacaattttttgttcgctccatctgacttgaatttagctggagttgaggaagcatgggatgagaaggtacatcaggtagttgttcaaactgatggagaagtttcagcaaaagttaagggaagacttagattacaatttttgaagaagagaggcttttcagcaagagaaggctctttagaggagattcatgcattgagaatcagcccaaactaccatcctgagaagtatatgttgaattatccaggtggtaagctttccattccaactcatgatgagaagggaaggccattaccagatgatcatattaaggctttgatggcaagagccactcaatttgatgctcaaacaatgctcggtccttatccatccacattctctgagttggagagtgtaagactatcagcaggagttccagggattcctccagctttaggttctcaagtttcaagattcggtgttccatcaatgatgggaccatccggaattagaggatatgctggcactggtggaaaggtttcattaaacgtttacgggccaatgggaccaatgggtccaatgggtagtccaatgggtccaatgggtagtccaatgggtccaatgggtccaatgggtccaataggaggtccattaggttcaatgggtggccaaatgggaggaccaataggtagttcaatgggtccaatgggaggcccattaggttcaatgggtggccaaatgggtccaatgggtccaattggaggtccattcggttcaatgggtggaccaatgggaccaatgggaggatatattcatgataagatggtttctggagtaggcccggttggaaccatgaaggctggattgtacatgccaggaagtcactcaaaggtaagacagtttttggatgagagcaacccaaagaacccattcctagttgtttgggacccatccaagctttctgcctcattacaagctccaactgacatgaacccagttcatgaacgttttagaaaggttaagagtggggggcaccaaatgtggatcagctccaagtcaaggaacacattggaagttcaaggaagagccttggatttagcatcaagaggttatcgtgtctttattactccacctattacaatgattccaactccagagcatcctggtttaggaggacttttacagagtagcactggtggctcctcttcaattgaaggtaaattattggtcgaaaaggctgcaggattttggccagttagtgccattagatttgcaggtggagatttggttgttcaggctattggatggcaaggatctagaatgttaccacccatgttggctgaaagtgtccgtactttacagagattcagaccacaaagaattatcatccgcgatattggagatacgtactggcatttgattggcccatacaaggcctccaagatcccaggatatgtcttaccagagaagattgtttccggaattccaagcttccccactcatcctattgaatctggaaagggaccatttgaaaaagcaagccgtttcagaagacacgttccaactgatgcaccattatggggtaaatctgctactttaactggcccagtattaatgcaacgcactgatagacatggtgctagcgaattaggaagagtacttccaatcaaaccaagtggcttgttcagagatactaacgaatgcttggcacttcaacagtatggaagagaaccttacaagtttggattactttccactatgggatctggtaaattgtatgatatggcagttcgtgctgcatccaaattaagagaaagaggcagatttgcttttgttgaggatgcttgtttaggattaagaatattgatcactatgtatgatgaaatgagaaacgatgttcagtgtgcatccgttttgagagctactgttgctttgagaaatgaggcaggattagatgagttcattagaaaggaaatatgttcaggaatcttcaaaatgccatcattaccagccattgatttgagacctttgaacttggctttaatgaacccaactgagattgctgctcattataacttaagatccttcccaaaagttgctccatacacttcaagattatttggagctgctatccacaagtcagaagctcttcaggaagccatttcagcatcccctctcgcaaaaggcgttgattctaagatttatcgtgatgtttgttctgaagtttcttacactttacaagaactcaatccattcgagaattcctctgctcaacagtgcgctgagtcaattaaggccgtttttggtctccatgtacaagaatgggaggatgttgcagataatgtcttggttgatatttgctccaaatctggttacagattgttaccttcaagtgatttatcaactacaaagatctacggatttactgagatcagagagatcttcttattagaaaaagatcatgccattcatagaccttatttactcgaggattcagttatcttcgaatccaaggttaaagcacacagtgcatggtgtaaagctactactccagaaggcaaatgtgttgctactgacttggcaaagaaatgcgatggattatcagttcctttggttaatcgttcccaattatttgcttacttctctgagcaaatccttaataagatggttaagggatcaaccattccaatctacacaaacactatttgtggtattttctcagcagtttcagcattttctgatgatgaacaaaccatttcagatactttatctaaacgattaggttcagttttccctgtatttgctgatcaccaggcattagttacatggaaaggattcttgtcacacgaaaagaagattttgaagattaagaatttagcttcaatttaccaattatattcaaagccaatgaaatacttaagcgcttcagaccaatctttggttgcagaacatgagaatgagggaaattacaagtcaaagacatcctctgtacaaaaggatgaagaaagtttttctgattcaacagttgctactgagggtgatgaagggtctgaggaagagcaagaataa

SEQ ID NO: 3279 - DNA, 1566 bp, Cryptosporidium hominis
atgaatagccctttaaacaattcaaatcaacccacatccagaaatgtggaaaagatttatattgagatcaaggatgcttcagaagattcctcgggttctgagaatgacattttaatcagaaatggcatgcaaataaagcaaaagccgtttctaatttggaagacacaaaacctaacaattggtcattatattctattttatgggtgtatccaaggatatatggagcagttattccctgcaaactacacactttttgaaagccttttatcaatggatcctgttgctattggtacagcagctttcttacaaaagcttatgtttactattgcttcaccattttggggaatgataatagataactcggacccaattaatattatgagattctcaattatttcattaacaatttcttcacttctaatatgtttttcacatacaataaaccaatttttcttttctatgtgtttttggggattattttccgcagtacttggtccattatcgcaaaagatagcctcagataagattttagatggtggaagaggaaaatactttggacaacttatgtttttccagacaattggaagacagtgtgctctactatttacaggatttgtaagcaataaacatcaaattgaaacttcaaagcaatttggactctggatgtttccatttcttctttcaagtttatctggaatagttctttttacattattaaaaatatttatttctagtactaacaaagactatcagcaaaaccaaaaacacttatttttaaaatttaatggaatttcatctatcaaaaatttaggctacgttttcaagtcaaaaactgtaatttcgttatttatcctgggaatggtcaatgcaatccccagaagcgctttgaactttattccaatgtggctccaatcaactggactttctcaatttagcgcttcattcattgtttcaattagctgggttgctgcaatgtttgtatcgcctatagttggttttgttagtgatatattttacaacttctctccttccaaaggaaggatattgatggctcagctttccctagtttttagatccatattcctatactttctaattgcaagagttcctactgcagtttcttatttcgattccgaacaatctaaattaatggtttattctattatttcgttcattattggattatttgcaggatggcctggaattggcgcctgtagacccatcctctgcgaagtcattctacctcaacatagagcaacagtttttgctctatcatccacattcgagggaattggagcagcattttttggaactagatttgttggagatcttgcagtttctatttttggatacaactcaagcaaaaaactctcaggttctacttcaaattatgttgcactgggcaatgccattctttgcatgacaattttcccttggataatcagcattttacttttctacttcattacaagagaaggtcaaaagattgtgcacatcactaaggacaaatcaagcatggaaaagattcccgatacacattcattcattgaagtcaaagcagtatag

SEQ ID NO: 3280 - DNA, 954 bp, Cryptosporidium hominis
atggctcacaaaaagaagacgaatgtaagaaaaattatagagaatgccaaaagcaaggctggaaatgtgacaagtgctccaacttttgtagagtcttatctcccttccaaaaataaggatggaaaggattcaaatactaagaaccagaaagcagacttcccaagggtctccattgacccattcgaccctaaagaaaagaattttgttgaggaaattggtcaaggagttgctgctgagagacttgctcaatatctgaatgccacaggctcctccttagcaaaggaaatcccaaagtctaatgtgtctaaagtggaaaaatctgcaagtaagaagcctgaagataaatcaatatcattagatgaaatctccaagagtctcctccctattcacttagatattgtcaaactttctcaaattccaccaattcttgggttgcaactagaagtttccatgggtcaacttacaaactggtgcaaccaagttgaaaaatacatcgagattaaaggacaaaaaaaaggtttatttagagcaaagaagaagtcccttctgactaactttgaaaaagttctagttcaatccagagaatatattaataacactcttcgtccggaagtaaagaagtgttctgcaatttgttcacttcttgaacagcaattcaatgaagtagagtctatcagaacaaaagttaataatatgtcaagatcaggatcatactcagcaactgagacttctgaattggcttcaaaatataatgaaatctcaaagacctttctacgtgaaattgttcacaacaataaaaagaaattgttctggaatgcaacagttgaggagatccataaccaagtaaaggaaatggtcaatctatttaacgagcagatagatatgttatctagagaattcaactcgaagatgatttttactctatttttaccgcaaaaggttattttcatctaa

SEQ ID NO: 3281 - DNA, 4998 bp, Cryptosporidium hominis
atggaacttttcaaaaaggtttttctcttggcaatcttttactttggactttctgcctcgcaggatttgagcattttaagcgacccagctagtaatcaaataggtaatactgaatcccacacagaagatctagaaaactatgtcagcatagataatgatgttgagaagattaatagaaacgtaacacttgagctattgaatggtgaaaacacaaacaaaaatgatatgtctgaaacctggaacttacatcttaacaatggtgaaaccttcaaagaaagtgataacacttactactccaaaattggcaagtcacctgagaatattgcaaaaaatatcccggatatcagagctgctattttgaattgtatgaatcaaatcagatctgtagaaggagagaaagctgcaaatatgaacatgttagcttgggattacacaattgaaggatatgcaaccaactcagctcaaaggatatgttctactggagaagttctccaaagccctaatgtatggccatacaaaggagctgagggagaactaatagccacttctcctcaactccatactgcagatcctaggacagtaatggataaggtctgtgatcttgttcaacagtggaacaatacaagttctctcttgccaagacaaacagatttttcaaacatttttaaatgggatattggaaattcttaccagtatgcagaaccatacttacagcttgttttagccaagactaccgttgttggatgttctttccaaacaaactgtcatgataatgttggaactgttgttgtttgccaatttagtgataagcctgacccagaagtccctccttatgcacatattcacaaggctttcaatctcactgaacctcaacgtcagccatgcggaagatgtggttttggagccaaatgttgttatcaaaatttgtgtgttggaagagacattggatcatcctgtccaaaatgtactttttcagatccaattaacgaaaataatgatgatctctcctattgcttggataagtattaccaaacctgttcaagctcgaactgtcctgatgcatgtgtagataagcatcaagttcctgaaggaattcttataaaccaatgtttatgtacttccaaacaacttattgaagatatgcttctctttgatcaactacccctcgaccctcagttatcttatactgagggctggaaaaataagaaggtctatcttcacggagtctgcagaaacatcaatggagatgctccaaaagttattgaaattccagatgtaggtggaaatcatgaagaacaagagcctgaagaggtgaatattggagccaaaattatctcttcagatagcatcagatcagcagttttgaataatttgaatactgtcagatcatctcaacctgctgctgatatggcaatgttaatgtatgactttactctcgaaggttattccagagtcagagccaaacaaatctgtgagtctgaagatcaattctcagaattcttgggtatcaatggaaccttcccaccatttgtcaaatggccatacagaggaggatctggtgaaacattgtatctgttaaatgagacatcctccattccagttgatattgacgatcaggaaatggctaatatgcaattaggaaatgctgatccaatccagattatagaagatgcagtacaaagttggtattctgaaggtgaaacctttgatttctacaatgttacaaataactatggaaaagacttctataactatagaatgattctaagagcagaagcaacaggtgttggttgttctatagcaactaactgtaaactaaatggtattaagacagttcttgtttgccaatacaactatccaaactttaaagacccaatgcacattaaagaatcaatttcaagaagaaagcttttggatatcaaatatttagaatatgacttaccttatctccatattgaagctgatccattcctgctcctgcaacaaagaagaccttgtggtcgttgtagaagaggttccacatgctgtgaaaacaatctctgtgttggtattgatatatcacaatctagtattacttttgttcccccaattctggaaaaccgtcaaaatggaggttgcagatctgcctttgtgagaccttgtaaccaactaaattgtcaggttaactgcatgaatccaagtagttcatatttagctcaccaatgtttctgtgtaagtccagaaaatatgagtaaacttgcttttgcaaatcccgaggctttagaagttaacaaaactcttattgaggaaatttacaacagaaatactactactgatggatttaaccgtatgttaatgatagatggagtttctactccatatcccatagcaacttatggttacttatttggtttggtaaactctcatggtttatgtctcaagcttccaggctttgaagaagaatatagtgagacagtaatggattctattgagggtaatataactgctaacattgaaagaatgggattctcaatggataacgacaacattacattattgtctgacgtctttatggatttaccagaagatgattctttcactcaaaaagatttaactgacaaatttagacaagagtttttgcttgcaatcaatagtttcagaagtattgtgggtaaatttgcaacaaacatgaacaaattggcttacgatttcacgttagaaggaattgctaagtcttcagcaaaacaatgccaaattgcatctctaaataggttctttgaaatcaatggagttcctcctctaacttacttatctccagctaatgagacactactcccaaataatgtagcatccatagtagctagctgggccaaaccactaatctcaacaaatggtaatattcaaggtgaaaatttccttgaatctttaaataagcatggaaaatccattccagattcagcaaaacaactatttagtgctcatgctacttctgttggttgttcaatattttcaaattgtccagaaggaagatactttgtagtttgtcagttcaatcatcttgacaaaacggaatatccctttaagccaatagaagatggattaaatattccaaaagctccatgcagttgttgtggatcaaaagcaagttgttgtgaaaataatctttgtgtaggtggaaatagtattggacaagatttctcagtatgtaatgatatttccctcagtaatgaagatggaaagtcatgtagttcctctttttacaaaaactgcaaagatctgaactgtaagggccaatgcctaaaaccattggaagaaagtgatcctttctatgatcactacatttttaaccaatgtacatgcagtaaaaagaagagtggaagttctcctcagtcaggattactacaggatggaaaagccttgattagaggaagttgtataagtgtaaatacgactagattggattctccaagtgttcttgtaacacataacaacttgttagatttggagcttatttctaatggaagaaatggcaatacagtttctcaagctctttcatcagctttacaaactgaactcaagggaaaattaacaatactagattcaaggcctattctttatgctttgaataagaaacgaagcaaattaggtgagaatgcagttaatatgaatatgttaaaatgggattattctctacaaggatatgctcaaaactgggctacagtttgtttggcaggaaagaacaataatagtcctcatgaattcccatacagaggtggagagagtgaggttatttattcttctgagataggtgaagaatacgacgagcgaaattctcctttgaagattgtggattcctggttttcagctgaagaagtatatgaaagaaataatggaacaattccaattactccaagagtcatggatttcattacggtgtctcaagcaacagcctcttctgtaggttgttcggtcgttaaaggatgtccaaacgctggatttgttgtagtttgtcaatttgactctgcagttaatctaagtaagtatccttatataagaatttcagaagccaaggaaaatagtgtacctgaatcacaggctcatccctgcggaaaatgttcttcaggatcaacatgttgcagtgaaaatctatgtgtaggaatatctcagaacccaagcaaactcgcagctccattgattgcaaagctttcttccagtagaaattgtatttcgtccatttccaaaaaatgtagcccaggattatgctcagaaggttgtattccccaggtaacttctgaggaatcagaaaagattactttatatgatgaggataactcaattcaatttacaattaatcagtgccagtgtgtctccggagaattcttggaaacgccaactgatgcctggaaattcggaatggtacgtagaaacggaaattgcgagaaagtaagaggttatagtgttgaagcaacaaaaactcaaattcattactataatgcagttacaaacaccacaggcagttctaatcaagactctaccattgataatggcagctttgaagggaaaaaagataaatcaaaacaagaattctcgcaagagtgtattgatcgagctaatgagaatggattgtccttgaaatgtatcgaaaatccattaaaatgctctagccacactttatgttatgcatacccaagtagaaagaattgcttctgtagagacgagagtagtgaaaaatgcgaggcattaaagctttgcagaagagatttgcaaaatccagttgactttgtaaatccaaattgtactggcagacacgccttatctgaaggctgtccttgctcaaaaaatatattcagtctagagtgcagctgcagtgtctacccaaaaaatcccggatgcccttgtgataaggagccaaaatctttcatatgcaaggatttacttagaacatcagaagcagcccaagagaaaataagctttgccttgtccgaagttaatcgcgtttctaaaacactaagaggttag

SEQ ID NO: 3282 - DNA, 1032 bp, Cryptosporidium hominis
atgactgacatacggaaaactagttgcatttctttatttgtatcaaaaattttggtacttaccttttttttggtgattttcacttccgattttgaaattcagaatagactgggacattttcaagagactagtttattaagattgtcggaagggcctataaaagatgaagaaaatgagagttccggatctgaaagcttgaatttgaaagctacgagcattctcttggaaatagataatcaagaagtagagaatgaagtaaatcccgaagcaaaattaaaaacaggtaatacaaatgttattgggagtaatatgtcagaatattctctagatgccgtggatgagctaatatcgcccatagttagtatgtgtttgattgaactaacaaatatttacgacattcttgaactagaatataattcaatttcatctgtttcaatcttggataatttagaagaatgtatcaacacaagaaataaaattaatgaaattttgaagataattattaaggccaaagaattgctcttttatgaaaagaatagcaatcttttggatagcaattcattaaatgaagactcgagaaaggaaaccaataacaaaaaaagtaaaacttctgatttattcttttaccttcaagcaaatatgtcaatattgaagaaaacaatttccttttataatatcaaatacagggtttattcaagccaagaacagattcttgggcgaattactaaactaatgaatgaaattaatactttaattcatagattcaaaaatcttaccaaaaataataaaaatacatttgaaagagttatttttgaaattacaaaacctgtttccaaggttattaatgaatataaatccattttgaagaaaacccacttatttatgtctaccaaatactactcaaagcactctaagaatattgagcattatgtacagactatttcatgcatgctcaaacataggcttcagcgttcatcagcctttgacgaactattatttatgttgaaaccaacttttaaattatgtcagtag

SEQ ID NO: 3283 - DNA, 1785 bp, Cryptosporidium hominis
atgggaggaagcagcggacctcctgaatggtgttatcttagcaaagatggtcaatgcgatggaaggggtggaacttatgttaatgtaattggaaatggaggtcgcattggaaatggaatggcaatgactatgattcctaacaatgacaaagatgtaacattcaacttacaaatgaaaagcaaagggactgtagctacttttagttgcaagggaggagtttctgagttatcattttctggggcctcagcgaggtttacaactccatcaatatcaggatataatcgatgtgctgtaattattggtctgagcggagatagaattcatgttagtccttttggctccaaaaatatctctttaggaagtcttccaatgtctccagattcttcctttaatgagatttattgcgtcccagaatatgctagatacggggctattcattctgggtacagtccttcccctcaagttgtttctacgccaatatcacagggagttactaacgttgatagctctctttcgcttccttctactactactactaccacaacaactactaccacaacaacaactactaccactgcgcctccaaagctcatagttgaagcagaaaaatacgttattgttccgagtatacaaagtgcaacagcatctatttctttttcaattagcaagtctttattatcctcatcatcgcttactgttactttatcagatgttgactacctaacacttgctaaagtcaagcttaaatcttgttgtttagagctaacttcagataatgaagatcactttgataagatgacgtataatgcagaaatgaagagttcatcaacactaaatctcacactagcttggactaaagcattcatatacttgattctagtctccagtatgactgttttagcctcagtaccaaggtttgcaaatcttaacacacctgcaaatgcagtccttgaaaataactctggagcagagcttacaactacatggaggtattcaagtgagtttgaagttccaagcctatcttcatgtaatctcattaattatgatagctcgtgtaaatcagcatcagtatctataatttctccagttgagtggaaacctgatgtatcattcctaagatatggttttatctctccaataagcagtaattaccctatctccttctccttaacttctagtgggaccctctttgcttctattaacttcagtcaaacgggtatttctatctcaataccatcttcatctcaaactgcttccatgagctatatgaaaactccaaatcctggagaatgggtttctggtgatatctttctattaagtcccaaattttttaatactttagatagaactgaaagtactaagacttgcactatcattaagtctacttgcactgcaccatcttcttggtcttccattaaaagttctgaattaattgccagatatgcaatattgtcaaagcttattttggattctggaatagaagaaagtgaagaacaaccaaaactctatgttacttataaaggagtttacgcactaagtattaatgttcccagtaaagaactgaatggagcaacagtacaagatagtccaacataccaacctctagtttattggagagtatataaaggcctttcaccttctattagtttcccctccgatgaaatttctaaggttattcaaaatgttacaaaccctgtaactaccacaacaactcttttcactacaactactacaaagtctacaagctctggatcatggatggatagctttttatcatggttttaa

SEQ ID NO: 3284 - DNA, 213 bp, Cryptosporidium hominis
atgtataagttttatttttcattaatttctttcttcactttttcattaatatttactagcttttatttcaattatgaaaataactatgcaagatttccctttaaaatattccaagatttaaggatggattccaagagtggaatctacatgtcaaaaattgaccttgagacagaagtttttgatcaaagtaagtttaacgaaaatataaggtga

SEQ ID NO: 3285 - DNA, 1029 bp, Cryptosporidium hominis
atgagaattaaatatggtgcaagttcaaatccaattaaaattattttcataggaagggacttgaagaatttattaaacattattatcaaagaatgtaagatatatctcttttctaaagacaataagagtagtggcttcttttatgatagttctcctctatttatatcaaagaatagcacagaagatcttcaattgataatggattggactgaaaatacattcagagtttccgcagttagacctgataactcccaggtggctttaggggggattgtaaaaacagattctcctttggtagcttttggatctgcttttataggggaagcattgaatccactccagattggatggagcttcaagaatatgcctggaaactccagatttgaatgtttgattagttattttgaggagagatgtaaaagtaactcaattcaaataaccaatatattgtatgagagttttcctgggataaaagcagatggggggtttcttaaggttgctttccaattccctccaaaggagaggctccctgttactttaagaattatggaagataaagaattagtaatgagtattcaattttcattggaccagatggtgatacatgaaggtggaaaatccttcaagcatttcttccttaataaatatcaagaaggggaatggttaaatctagacttggttcctatttcgaatttgagtttgaattacttaatttttatactaaaaactttatgctctaaaaggatttttgatctgaaaagcacaagtagttgtttagaatccagtcaagaaggaaataatccggccaaagaatacagaaagcatgattcaaaaaaagggtcttgcaaaaatgagtttcttcaaaatatagcaagaagtggaaagattttaggtcgtgaatatggcgttccagaaagtcaacagtttgacgcttttcattctggtaatggtttcaaacttttatttgcaatagatgaagaaattataggtaagtgtaaaaatttagtcttttcaaccaaaataatttga

SEQ ID NO: 3286 - DNA, 1470 bp, Cryptosporidium hominis
atgattgaaagattgactcaacaaattctaggaattaatattagacttgtagagaagattccaagttccatgcataagtatcaaaatattaaaatggctgaaaatggagttgatatagaaaatttaatttccaaacttgataaaaatggtccaatcagtatatatatctctttaaatgattgtatttctgaaacaaataaacaaattaacaatcatttggatttatcttattctgccatcctttctttttgtgtgggaattatcaatgaaatatcatataagaagatgtctaatttaaatgaaaagagtcaaaatcatttcttttctaaattttcggatgccaggaatgaactttattttgtgactatattttatggactccaattcgccttaaacagaattttccaaggaatcatctcaaagaatatcattaaggattatttattacttatgagacatcaattgtatcagttaaataatgaacttggaatatttaactttgtaactggatttattatcaaattcagacttccaatagatccacatattctttcatattatttgaaagaagttatattaaacttgaatcctggaattaatattgacaagtctgatgaaataaagatttatcaaaatattcctgatatcattttatccaataaaggtttttataaattagtttatgaagccacaaaacaactctttgataatgttggagatgaattagaagaaaagcatttcaagcttttattcaaagaaaagaatcttcaagaattgattgaaagaggatttaatcccattaatattcaagaattcactaataagattactaataagggacaaaaaagcataatttttgaatttggaaaaaaacttggaatgaattctctaagctttaagctagtttatattcacaagatactacaatcaaggattcttgagatattaaaagataaagaaatttcaaagattcaaagacaatttatcacaaaagttggttttaatctctcaccaatggataaattagtatacgaattaatttatacatacaaagaaaattgtgttgtggaaatgatcagaaagtacacgtctgaaacaaaagaaatcaataatggacctcattttgagtatgcattcaagctttgtgaagaattactaactccaatagaaaaaataactcatgatattgacaaaacctttggattcgactattttggaggaattgttaattgtgatcgaattaggattaatgaagatattgaaaaattaaagaccgatataagtattatattaaattatttaaacaattttaatttaatcacatctttttttgaactaaaacaaacaaaagacttaaagcttgagaagactattcaatatgttgataagaagattgaaaggaggtccaataaacctaagattcttcgtttctttaatagttgggatcaacctattaacaagaaattttga

SEQ ID NO: 3287 - DNA, 1269 bp, Cryptosporidium hominis
atgattactggtttcattggtaacaaacttgatggtaatactaaaaagttggatttcgattttattaactggcttggagattattctggttattacttaccattccaaaaccatccaggtttaaaagaaaacatcctcaagctttttgcagaagaacatatggaaaaagaagactgtattaagaaagtaaatgaattatttgataaattccaagttcctatagatacaagtgtcgacttaatctgcgatgaatggggaaccctctttgaaaactatccgagaaagaaatcctataggaaatttatcaacttaattcgccaaaacgttgatcctgtcttagaaacccaaaaagatacaattagccttcgaattacgcgtagtcatcctataggtatttctacaaaagtgactgttggcctcagaaatgtaccaatcatttcaattatccctactcttgctaacagaggacttttagacctcacaaaggaagtgttcaaaggttttcagacagaatcccgagcatcattatttgtggaccaagaaaatgaaatggatatttcagccgaaactcttggtttaaatgatggagatatccttactctaatagtgagcgaattggaacctgaagtttttgatattgaagtttcttggaaggatgcaaatacaaggaaggaaggaagtttgcagtttagtataaaagatacacctcttagacaatttctcgaggagttgtataaaaaaaaggatctcaatgatagaattattaaacttgtattgtttccaaatgggaagatgttggaccctcagtcagacaatttagaccaaaacatttcaaaacatggaattggagcttcaaataaagtagaacttgtaacattgttgaaaaatgtttcactgcttaatttgagtcttatttggagaaatccctcattattggaagttataccttccatagatgatcaggataaccaaaaagagaactttataagtaaagaaatacaaatttcgtccaatgaggttttgaaaaacttatttaccgagattaaagctactctaatggatgaaatgtttagtaatagagatgagtttggggttgaaaagtttgaggtagtttctattgaaatacttggagatactcagaaaactaatacattggtactggataatgttcaaaacattattcagaatgaccttgaaaaatataacttacctatttccgactataaaatcagagatcacgacaaaattcttggtgaatctaattgttga

SEQ ID NO: 3288 - DNA, 411 bp, Cryptosporidium hominis
atgtacctcccctcttttgaccgaatccaaaccgagatttcttggatacaagcttcgcttatttcattaaaatctcctgaagagcaggaagaaaactttggaaggtcatgtcctgggttatattttaaacatgacgctactatagcaaatatttccccaccagggtttgcctctagaaaatttaaatgtattgcaaaagtaagaaaaaatgacagaatgcaccactttgatagtgggagaatcatttctgagattctaatttaccaattccccaatttattacgagatacacatttactctttttgaatcgattttccatagttttcgaccaattacatgcaatttacgacggagatctaggcgggcttttgctccgaatctttaaaagcactagtaaagtgggattttag

SEQ ID NO: 3289 - DNA, 3831 bp, Cryptosporidium hominis
atgattaaaaaaaataatcctcaaaaggaaatggagctcaaaaggaggtattccatggtagggaatgatgagcttcttattgatactccagtttgggttaaatgtccagaaaatgggataaatcataattataaggtaggtgtaatcaaaagctttggcgaaaagactatacatgttagtattgaaggtgaaggagaaatagatgttgactttaatatgtgttttaactataatgttggaattgatcctatgcaaatcaatgacctaactaaattacctcatgtgagtgaagcctctgtattggatgtcatcaacaagagattcagtatggacttaatctactcttatgctggtagattacttgttgctgtgaacccttttaagatgattgaaggactctatggtccagaaaaaatcagactctataaaggagctgattattctatgggcttcccaagtgaccttcctcctcacacttttgctgttgctcagagatcgatgcagctcctggatactcaaaaaatcaaccagtcatgtattgtatctggagaatctggagcaggaaaaactgaaactgcaagacagctcatgacttattttgcttcttcaggaatgggatctgataataaggtccaggaagtcatcttaggagcaaacccactattggaagctttaggaaatgcaaaaacacttaggaataataactccagtaggtttggtagatttatcaagttatgtctagaaagatctaatggtattgttggaggtgcaatttcaagttatatgttggaactcagtagaataggtcaccaaattgaaaatgaaagatcttatcatatcttctaccaaataattaaatcctatacttcccaggctgacatttctaaatacaaattacgtggaatggactggtataaatatttgaatgtatcgaattgttatgatgttcaaaacattgatgacattaaagagtttaaaaattgtgtatttcctcagttggaaagaatcttaccaaaccaagaagcaattgatcaactcatctctctattttctgctattttactaatgggaaactttgaacttggagaacacgaatccagaggaatcgaagatgctgcttgtattgaaagtcaagatatattgtcggacgtctcggaactctggggaatcgattctaaacaatttgaagagcttttacttacaagtagtattgaaatcagaggcaacgtcgttgtttcagcattaaataaggccaaggcacaagaacaaatagaaagttgtggaaaggaagtctatttaaaatgtttcgagtatttgatagatctagttaataaggcaattgaatttgatgataataaaagacaatggattggaattttggatatttatggttttgaagtatttaaagttaatggttttgagcagtttctaattaactttgcaaatgaaaaacttcaacaattcttcatttcttcagtttttcaggcagaattacaagaatatgaaaaagagtcaatttctcatgataatatcacatatgaagataattcctcacttgttcagctatttgatggtaaaggaggtatctttgatttacttgaggaatcttgtttagtatcaaatggtacttatgagagtttcactaatagtgctcataagaattgtggaaaaaaaagtggatataaacttccaaaaggaaatgtcccagacaaattcatcattgaacatacagcaactacagtagagtacactaccagagagtttgttctgaaaaataaacatagaattaggccagaaattatccagctttttaaagaatccaagaattcaattattaaaggttgttttgagaaagttgaaattcttaattctaataagctcaaggggaagttccttgcaagtatttttagggtttctataggacatctacttgatacattaaaagctaccaatgctcaatttattagatgtgttaaagcaaacgaaaagaaggtacccaatctaattgaagctgatatggtagttgatcaacttcaaagtctatcaattatggaagcaatattattagttcaaaaaggatatgcatatagagagacttttgaaaactttatgaaagagaattcaatgattatgaaattgatgggacaaaccatatcttcaggatcagatttgaaacaacaatgtaggcaagcaatgaatactatgaagatacctgaatcagaatggcaaatcggtaatacgaagatctttatcaaaaaagatggttggatagcagtagaaagattctttagatctgtgacaaagagtttagctccattggcagaaactttgagggagatatttagactttcaaaacttagaaagcaattaaaggaattttcattatctttgattagatgtcagagtctggtgagaatgtatatcttgaacaaagaaggagtagcaaagaataaacttttgaattaccttgttggtgtttcacttataatgaaccttccaaatgctatgaggaattataatagatcaatcataactattcaaaggatatatagaggacacagagtaagaaaggagataggaacaactttaagaaggaaagctgcatgtaagaagtttgtatcttttgtcaagcttttagtgaatgttttgaaagcaaagaatacctttatggatatcctccgtagaattaaatcggaagctgcagcaaaaaaacttcagagtgcttggattcattataaaaagaagagattagtcattcttttgagaatatactctatcaaacaagcaaaggcaataaaaatccaaagagtttggagatattattatttgagacaaatcatgattcattatattcgtatagcaacaccagcaagaaagattcagagtgtatggagaggatattatgtcagaaagacgatccaacattctcacttctttgagaagatcagaatcaagctttggaagagtgagtatgtaatgaaaattcaatgtttaatcaaaagatattggatcttggctcaccttgatagactattttgggttgcagacgttctccaaccacgtctacactcagctttgaccaggttatattggaaaaatatgctcaaatccataaaatgtattcagagttggtggagaggagatagagtcagacaaataattcgagaggaaaaactatttgttttactaatggcagagaaagtgagaacagactttatgactcaaagtgaatgtaagatactagtacaatgggacttagaaagaagaaacaagaatagagttgtgattggttctaaattagagaaatctccaaagggactccaaataattcagatattagtagatgtagataccagtagagagtatccagcaggatggatggaatcaataacgggtttacttagatcaggaagttcaatccaagaagttggaattggagggttccacacagttgtcttaacttgtgaagggagcctatactctttcggaatgaatgataagtctcaattagggcttggaaagcctggtagcgagcttcttggaagagctttgattaagccagcagagagtttgaatattcaaaataagattaagagtatttcatgtggagtagatcacaccttagccttaagtgaaatgggttcagtttactgttggggagcgaatgagtatggtcaatgtggatgtgacgcaacagagtatcagatttcaactccaactttgatttctctgcctgctgactggaaacaaacaaggattacattggcaagagcaggagcattccactgtgtagcagtaacaattgagaatgaggttcttggtttggggtag

SEQ ID NO: 3290 - DNA, 435 bp, Cryptosporidium hominis
atggatccattagaatcggatgggaccgttttactaccccaaatttttgtcgatggcgtatgcattggaaatgatgtttctcttcaagacttagaagaagataatgattttgattggattattaatagaagagcatgtggagcctgtctttctgacaaagaagaagacatggaagtttgtccaaactgtaaccaggtatttaagaccattgtcccacctgagttagtatactctggtggaattcagcaaatgtatagagggaacaatactgctgcacaagaaggagttctatttgaacatccaacaaactttgttaaaaataacaactccaacctaaacttgaatagaaatgaaaggtatggagattaccaggatgaggaagagtataatattgctgaggaagaatattcagaacttgatataaaggatgattaa

SEQ ID NO: 3291 - DNA, 600 bp, Cryptosporidium hominis
atgggttcttcaccagatgaatatgaccatctttataagatcatattagtaggagatgcaacagttgggaaaactcatttattatcacgatatacaagagatgctctgccaaaaactccacaaccaacaataggagttgagtttgctacaagaacagtgcctctttcaattggaggaacagtgaaagctcagatatgggatacagcagggcaggaacgatatagagcaatcacaagagcacactatcggcgatctgtgggtgcattattggtgtatgatataactcgtaaatcaagctttctgaatgcttcaaagtggctggaggatattaagcagaattcggaacctgatattgttgtgatgcttgtagggaataaattggatttagttgaaaaggacccaagtaaaagagaagttccatttgatatagctgcaaactttgcccaagaaaataacttattcttttcggaagcatctgcagtcacaagatgtaatgttaaacatatttttgagcatttattgcaggaagtatataatcaaaagatgaaagataactcatcaaatttagatatgaatggtaagtttatcaaaaattgctag

SEQ ID NO: 3292 - DNA, 924 bp, Cryptosporidium hominis
atggatgaaagatttgattcacttctcattaacttggctcaaagtgcaaatggaatcgagaattttttggatgtaatatttggtttcttgctgaggaaaaccgattttttcacagcaatgaaccagggagaagaagagaaaattctaatgaaatactttagaaaatatcaggctctctctgcagataaaagaagagaagaaaaaaggttaatgatggaaagagaagaagaacgaaaaaagaagattgaagaacagaaaaggagagaagaagaagagctgaaaaatatgtctacaaagagtgtaccgaaaattgaagaagttttttctgacgatgaaaaaggtcaaccagcaacaaaaactaatgaaaagatgagtgatgaggaagaatctgatacagaggctccccctcttggtaatggagggtcaacagataagtatacctggactcagacactgggaactgtggaggtacttattgacactattccaggactcaagtcaagagattgtaatattaatattaaaaccaatagattgaaggtagttgtgaaaggagaagtaattatagatggtgaactaaactcaaaagttaagccagatgactgtttatggtcaattatagatgggaaaactattcaaatagtactagaaaagcaggaaaatattaattggtggtcatgtgttataaagggagaccaagaaatagatactaccaagattgtaccagagaattcaaagctttcagatttagatccagaaaccagagctacagtggagaagatgatgtttgatcagagacaaaaagcgatgggattgcctacaagcgataacttaaaacagcatgaacttcttgaaaagtttaaggcagctcatccggaaatggacttttcacaagctaagatcaactacggtagtggattttaa

SEQ ID NO: 3293 - DNA, 1392 bp, Cryptosporidium hominis
atgagtagaattgtacatgacagtaaattccgaaatttgtatggagagtgtatgcaagataggttttcaggcttacatattgtaacaagcagacatacagttgatggatgtggaatagcagcttcaacagagtttatagcatttccagcagagtgtagcggaggaggaagtgtgggtgtaattgataatagttcatttggatacaaaccaaatgtagtatactttaaaggccacaaagcagcagttagtgatgtggagttttcacccttttattcttgtttgttagttagtgcatctcaagataagacaataaagttatgggaaattccagaacacgctgcacaaaagagtttaaaagatcctttggcagtatttcgtggacatacaaaaaaagtctcacttgttaagtttaacccctcagcagagtggatcttggcttcagctagtagagataatacaattaagatctggaactgtgagacagttcaggatgaaattaatattgggttaccaggtttaccaacatcgatcaaatggagctatgatggaagtcttttagctgtttcttgtatggacaaagttaccagaataatagacccaagaagtgaaagaattacatatcagtggcaagctcataacggaagcagaaagagtagatgcgaatggatggggggcacaatgggaaatccaaattggttattaacaacaggttttagcgataaaggtgagaggcagattggagtttgggatgtaagatatttggataagagtgttggggtggagtttgtggatattgaacaaccatcgttaattccattctgggatgaaggtactggactattttatttggcaggtaaaggggatacaaatattaaggtttttgaatatagtaagactgatggctgtgtaagaaggctggaggaatatagatcagtaaattctctcaaaggttattgcttgaccccaaagcaaaatgtcgaagtaatgaaatgcgagattgatcgaattcttagattagagtcaggcggtgtaattcagcctgtttcatttattgtgccaagaaagacgaatgaattttattccgatttgtatcccgataccattggaaatgaagccgcaatgggtccagaggaatggattagtggccatactggtgaaccaatgagaatgtctttaagaccagatattgttcaaacgcagagtaatatgttcaagagaatgagatctgttgttaagaatgcaagagtaatattaaagaaagatttagccaaggcagagatgcaattaagtacaatgcaggatgaattgtattctatagagtcactcaagtatcagttaaaagagaaagaaaatgagattgctcaattaaaagcaaagacttcattagtttaa

SEQ ID NO: 3294 - DNA, 978 bp, Cryptosporidium hominis
atgaatataaatatatatgagaacgaagccgaaagattaaagcaggaaatcggtgcacttaggtgtatattttcagagaaagatgagatggttgttaataaggagctggaatcatggcttgagcaagaagtgagtaatgaaggaagccatggggatttacgtttcagagtcttacttggagacaggaaattctactcaatgcctctgtatcttgaaataacattggatccagacaataactataaatcaggtttaaaaaaggtaagtgttgtggcaacaaaagagtgggatggagataacgaacgcccattttttttatcagaatcccaaacaaagtacatagaggatgtggggataaatgcatttattcccaatatggaatgtatctatgaccaggtgattgcctccagggaggcaacggaagatattgttcgagatattccatgtgaagtattgaatactagtttagattccgagatgcaatcaataagctcagaatcagaaagcgaaattagtgtgttagaacaagaggaaatgattaagtatgtttggaatacttctgggacctcaggaactataaaatggggacagagagcttgttacagccaccatattaggagcaagataaagagaaggctaattgtggaatgggcaaaagagctttgtcttggtggttattgtaagattggatatcctggaatcattattgtagagggtctggaggactgctgccttgagtatactagaagactgcaaagacttagatggaaacatttcattgttagaggcgaaattatcaaaaatgtttccattgataaaaattgtacaataaacttagatacaataaattcactaagaattctaccaaataaaatgatagaacttccaagtgacggtgcaaagattcttgctagaatctgtgaggatttgggaattaaagatttattcttaacaaccatgaaaatctactctaaataa

SEQ ID NO: 3295 - DNA, 2481 bp, Cryptosporidium hominis
atgtccaagctaaactacgtactactcagggcaaccttgatttgtttattagcggtaacaagatgtagttccgaaccattaagctggatgacttttggtgattggggtgagcctactgctattctttctgcagtaagcagatcaatggccaatcttgcgtctataattaagccaaattttatcatttctgttggtgataacttttataggtggggagtaagttcggttgatgacccaatatgggagaatatgtttgaatctgtctttgatcaagaatcattacaggatgttcagtttagatgcgtccttggaaaccatgactggtggggcaatgctacagctcaggttgatcgtcattatagtctaaagtctccaagatggtatttaccaaacttttggtactatacaattgaggaattcgaatcccctgtgaattcacctcatccttatttaaatgtaagctctagtccaacagaagagacggaggaaatggtcaaaaccaaggcaatctttatttatactgattcttggatcatatcttccccaatgggaactgatattactccagaattgtggaatgagcagatggaatttattgagaatactctaaaggctgcaattatgagagatattgactggatctttgttattggtcatttcccgtgttattcaagtggagagcatggagataactctgatattcacaaaatccttgatcctttacttaaaaagtacaaagttgatgcttatatagctggccatgatcatcatctagagctttctaggccaaaaggatcctgtacatcccattttcttattggatctgcttgttgtccgaagaagcacgactactttaacaacaaacacaggatctttagaactggaagaggaggatttgcttctcacaaactgacttattcccaattccattcgacttatcacaacatagaaggtaagcctatcttcactactactcagagaagacttaataggaagaagattaaggatagattaattaaggaagcaatggctaagattgatggaaaatcttttgatattaccagtcccattcaaacaggggctattgaaccagttatgaactttatagagaacaaacaaggagagctcgaggttctagatgagatagaaaacgagcgagagcaggaggctatagagaaagttcaagacagtctagacttagaacaagatttgcatattagtactgatgagggtagcaattcaaaagtttcctgttccaataggaagtcaccttgttcccaaatgcaatcaagtctttcttctataactagccaggaaccagagcctgtagaggtacacctttcccatattgatgagtcttcaggccatactactttagtagatgctataatatctcctaaagtgaataaagaaagccctggattagaatctaaagcctcagcagtgaatgagtacctgctgcaaatatatgaacttcctccttcctcaaagaggtcttttatagatgagataccaactagagacaaattttttggtgtcaatttcccttttggagcgagattaatgcgttttagaattgataggaagactgcaggacatccaagacatgagtataaatatgctccagttctgaagcattcagttggtgtagatggctctgaagtcacaaagttctcagtttttcaaacaattgcttggaatgaactaggagaattaatgaagagtagttacaaaattcctgaatctacatggcagatgatgagatctccaaattggaaaggaaactttgtcccttggagatttgttgaatcatgcaccaacatcctaagaactttgagtgttaacggacttttaaaatatagagtttcaatttggggaatcccactttcaagttacaaaactaataataaagatattggagctacaaaagctgggttatactgttcagaagttgctaataagctcagcattcatagactcctccaaggcgctgtatccagtaagcttctaaaatgggatagatgccccagcgatgaacaaattcccaataaaaagtcaaactcagacttaaagactattgtagccctctcaataataggaagcgctagagataattgtctttatcctgcgaaattaaaacctaaaaagtccagtctagactcattctcaaatggattttataaactccttagaaaaatgaagatgattaccaaagctgcaaatgacccagatatagttgctggaattgaccttagtagagttatcgtcattcccatgaatgttgcctgcgacatagctgcacagcttatcaatcacgatctcaatattgtaagtaaccttgaagacttagtctatgatcgtccagatgaagcaattaggcaatgtactcaaatagttagtagaatagccacctttattcctgttgaagaggctgagaaactttgcagtaactttagctcgtatgagctagtcggaccctaa

SEQ ID NO: 3296 - DNA, 327 bp, Cryptosporidium hominis
atgagtcccttaagacttttggtatttgttagtcttttcttaggggtcttcacacaagaccagatgtttccaggaaaccctagatttactggaggcctgcaagagagaatcttctcgtcttttccggcaatctttaatagggctgacaataggaacagcaactctactgaggagccgggaacaaagccaacagagcgtccgggggtaccaagagtggaggaaaagggtgaaccagaagatgaatccaaaaaggaagaggcccagaacagtgaaggtaagttcgagataagaacgaaagaggaaaagggaacagtaaggaaagcctaa

SEQ ID NO: 3297 - DNA, 879 bp, Cryptosporidium hominis
atggaattagtagaaaaggaagtggaggctgttggacaagtaccaatggatcattttgatccagatatctcagttgttattccagttgcttttgatgacttaaggtcattccctgttctgctgtcagtacttagattacaaaccttgagaccagaagaaataattatcgtatttgattttccagaacacgaggttgaagccagggctaaggcaatggaagaagttaagaaatacagtagcagtctgagaaatcttagaccattcttcagaatccctccacctcctccaaaccacagagcaggatcaaacagactttatggagcatccaaagccaaaaatgaaattataatattctttgacagtgatgatctaatgcatccacaaagagttgagtatgtctccagagcctttaaagccaataaagatatggatgcctttttaactgagtacttcgtggagcagatggatacaacagaacaagccagagaaatgccaaaaaaatccatgattgatattaaaaccaaattcgaccttgaccaaattgaaagagaaggtaaactcttgaggaactcttacgaggaggaatttaaagaagctgaaaaagctgtcaaagagtatggattaaaatgtccatgggatcccaacgataagctaactgaaattaactggccagaaactcacggttggtggctctactgttgccataatgggtggttaacaatcaaaaggagtgttttgatagaagttccatatcccgataaaccatctggggaagattcattgtatgtgtttagactcctaatgagcagaaagaatgttggtcacagtactgttcctctgggagtgtacgtcctaggaaacacatatgaagtcaggtaa

SEQ ID NO: 3298 - DNA, 1149 bp, Cryptosporidium hominis
atggtgtacacattatttggattagattcatgtccattggtatcaatcatcaaatctgttgctgagatcacaggagataagatcagccacaaagtgagtgacggcacagaccacaaagacttggatttccatcttacatttggaactccagtgctcgacactcaatttggaaaaatatttggaacaagcacaatattgcgtttccttgcaagaggttctccatatactaacttatatggaagaactgactctgatgcaacccatgttgacatgatcttgcagtacatcgacacaactttgtcatcacttgttgtgccacttttcaagaagagtggggatgttaaatcatatgtatctgaattaacaaagatatttgagagctttaacaagtactttaactaccgtacttttgttgctggtgagcgtattactattgctgatatcttattagccactattattgattattcaattaagtgttctgctggtgctctttcattgaagagttgtgtgaatctacaaagatatgttgacacaattcttgctcaaccttcaatcaagaaacactatggtgaatatgtaaagaaatgttcagcatctaaggattctcaggctaagccccaatctggatctgctgatgcctctgaagagaaaccaaagaagaaggataacccattagataatctccctccaacctcaatgagcatggacgagtggaaacgtgtatactcaaatactaaggacttgaaaggagtcgcaatgccctggctctaccagaactttgatgccagtggatatagtttctactatatgaaatacaacaagctcccagatgaattggatgttgcattcagagcaagcaacatggttggtggcttcttgcaaaggctcgacaacaacttcagaaagcactcctttggtgttatcaatatcgttggagaaggtaataacttcgactatcaaggagtgttcatgtttagaggagcagatattcctgaggagatgcaatcccatccttcttacgaataccacaccttcactaagctcgacatctccaaacctgctgacaagaagctcattactgattatttctgcaatgatgacgaggttgaaggactcaagatccaggattgtaaggtctggaagtaa

SEQ ID NO: 3299 - DNA, 555 bp, Cryptosporidium hominis
atgacagaaaaaattcagctctataagccacgtgatcgtgtcaaggttactcttagaagaaaatactcttctcgtcgcaaggcatcagtagttgccccaaaattgagaagctccttacaaccaggtgttgtttgtatcctattagctggtccatacaagggtaagagagtcgttatgttgaaggctcttccatcaggtttggtagttgtgacaggtccatacgctttgaatggtgttccagttagaagagtcaaccctgcctatatcatcgcaaccagtactaaggttgatgtctccaaggcagacgtctccaagttcaccgatgagtattttaaggttgatagatccaagctcaagaagagcaaggatgcttttatggaccaaggtgaggaaaccaaagtaaacagagtcgtcagtgaggagagaaagaagacccaacaggctttggacgcttctattatcccatctatccagtcaaacccattgatgatgagctatttaaagacaagattcacattgaccagtggcatgttcccccataagctcaagttctaa

SEQ ID NO: 3300 - DNA, 1362 bp, Cryptosporidium hominis
atgaattctcgaaagaaaattaataatatcatccaaggctctcttaccttgatagaaaataagttctactggagtttgtgtactagtaatgtaccaagtacaagtgttgataaaaaaggtactaattattatttctgtattgatgatgaacttgtatacgagcctttcttccaagactttggaccattaaatctgagatgcatttataagtattgcaaaaaagttgataaccttctcaggactgttgaaagtaccggaggatatattgttcaatgtactagcgtgtatgatatgaaaaaaagaaccaactctgccttcttagcatgttgttatatgatgatcagacaaggaaagactcctggaagttctcttgcactattcaactctgtacccttgctttcattcagagatgcaacatatggaccatgttcatactctctgactgtaggagattgtttactaggattatattatgcaatgttattgaaatggtttgattatgaaacatttgatattaatgaatatagtacgtatgaaaaggttgaaaatggagatatctcatgggttattcccaataagttcatagcttttagcggtccaagtggaacaagcgttgacgaggatggctatttttcccttacacccgaattttatattccaatctttaaaaagctcaaagtctcaacggttattcgtcttaataagaaacaatatgagagcgaaagatttacaaataatggaatcaaacatgaagaactcttcttcatagatggttcctgtcctccacaaaatatacttaacagattcctggaacttactgaaaacgaaaaaggagtttttgcagtacactgcaaagcaggacttggacgaacaggaacacttcttggttgctatgccatcaaaaactatagatttacagcatctgcatggattggatggaaccgaattgcaagacctggaagtgtattaggacctcaacaacagttcctacatgaaattgaacctaatctctttgcgagaggctcaatcctccctccagaaatgagacttgatacaaaaatcccacttatagctaggaaagtccaagatgcagttcaaaagcaagccaaaatcagacaaatacagtgtattagttcacaatttatggaaaacaaaaattcggatcttagtaaatatcctattactatgcaacagaataaaatatcgaaggatactaccaataatcatgacgatatttctatagaacaagaagtcatacagatgatgtcgaacctcagtgctgtcgacaatattgctatcttaggtgatgctggccaaggtgaaaggttggtccatgcgaaaaaaaatatcatctcaaaataa

SEQ ID NO: 3301 - DNA, 1152 bp, Cryptosporidium hominis
atgacgaacaaaataggagctaaaaaagaaagagacatggaatctaaagagatgttaagtaattgccagcaattaccttgttctgctcttgaatttttgacaggggaatatgagctcgaggaggatggtatagttgaatttagaaacgtcgtttctctgttatcaaaagagcagcttgttgatattttaagcaaatctgcttatctttataatattattggtaatgcttgtaagttaattgttgaaagaagccctgttagcagaagagtaatggttagaaacatttccttccagacttcagataaggtatttttgaatttattcgaaaagtttggtgagattgaggactccaccataattcgagagaagaatgggagatcaagaggttatggatttgttacgtacaagagtagtgaatcaattaagaaattatttaacgaaaatttaattcttaatgggagacaattattggtcaaattagctgctgatcctttttctgagtttacatgcggccctattgattgtaataaacaggtgttggaatccaatcaacgcctcacatccactatatttaaaaaaaagctttttattagaaatttatctgaatcaacaaccaatgagagcctgagacaagcattttctgagtttgaagatattgaagagtgttttgttatgcgtgatcataatactgggaaatctagaaagtatggtttcattacttttaataacctaggggacatgatgaaagttcttcaacatccagaaagaattgtggatgggaaggtaacatttgtctctcttgccttcaagcaaaaagatacatcaaatgctaataagaagtcggatacacctgcaacagagcttcagggttcttatcctctgtcattccctgtacaatcaggatacttttatgattattataatgcattacctcaaatgcagcttgacttacagaatacgaatttaacttccgaaaatgtaagaaaccaacaccagatggaggtttatccttacgttaatcaatgctattactcctcaaacccgtgttttacaccttatttcatcccttatactccatacggtgtttattccaatctctatgctttacagaataatcaagaacataattcaaaggaggaaaaggagaagtaa

SEQ ID NO: 3302 - DNA, 1893 bp, Cryptosporidium hominis
atgagaaacaaacagttaatttcatggttagctcttttcattttggtagttgtggcattatttgaagtaaaatatgtaggatctagtattgttactgaagtgaaatcaggtacaggacatatattagaacaaaggggtttaggaacagaaataggagaatcacttttaactaaatccagttcaaagacgttacagaaagctgaaaagaaaagtgaaattaagaaatcaaacaaaaataagccttcaagtgatttacctagttctatttcaaggtatccagatttattgtctaaaaaagatcaaaatgaaaaaattagtcgaataaatattgaggatgaaattgcaagtgctcaatactattcaaaaatgagtaaaatatactcaaaaaatccaaaatctataaaaaacacaaaatatcctctgtatacttcaaactatttacctgaagaaaaacgtattgagggcttttatacttctggatcaatgttaataatggaagataggattgatgatgaatgtgctggtcatttacttgaggctgaaggaatctccaaatccaaaatgattagttttaaatgtccatctggatcagcaatttcctatttgagattcgaatataaagagttaaaattcaatgcaaaaaaaaagaaagattcaaacgatctcaaacatattgaaatagcaattactggtttgggatttggatgtgatgataatcaaagttttatttattttggaagtcttgctaaatctaatattagattatcaataccacaagaaaagaaaatgtggattcacaaggctaatgcatttatagaaagatcaatcactggacaagagtatcttgcaggattttcagcttcaggaattgatggaacatttggagttaatgttccaaataatgattttcatattgcttatgatttaagagaaaatccgccttttataccaagatctcaattctcaaaacataaagaatggagtggaagctttatgacaggaggttgtattgggttaaaaacggacaaaaaaatgaatcttattaatagaatagctttaattccagttactattcagcctattaaaaccattccaattaattcttctccagaatcatatacttttgagaattttagtgtcaaaactgataaagtacttgcagttcctaagctttggccagaatgtcaaatgctttttggaacatcttcaggtaaatatcaaagcaatttctttctctttaaactaccaaattcaatcaaccagttaaatttcaactttattgaagtttcatatacctcaaaacatatcccaatttcaatcgaatttagggaaactgtctcaaatggctcagtcctacttggaagaagagttactgatccttcaattattaaagtgtctagaactggatctatatcccaaattacaattggaattactgaggaaaatatgagcagactccaattaggatttgtctcatatttggaaattgttattgatggaattagtactatatttatccaagaaagagttccaagctttaaaagaactttctctggaaataatctcaagtatatctgtgctgaagtttctaatactggagctcttttaggatttggtgcttactttacaaagaaactttatgtattgcctttcattcaaggaggagtacaaactcatttttcagatctacaaggaatcttttcttcagaaatctttgattcttccaatcctaatcttgaaattgaaaaagttcagtatttacttccaaaacataaaaaaagatcattaattccagttgttgacttcatttctgatagaactatagatgtttaccaagggaaaagtattacaaaaaatatctgtaactttggtgcttcatccaaaattaaatga

SEQ ID NO: 3303 - DNA, 2424 bp, Cryptosporidium hominis
atgaatttgactcctctacattttatttttttgctttttctcataagctctccgtttggatattcagtttacgttactagagaagaattatgggaaagaattaagactgaatcaaaaagtggctcatcatctccagcatcaagaatcgttaaggatgtgggtggatcctgtcctactgatataaatagaactggaggaatttctaaagaagatttagaggaactttgctttgatcttgttaagagtgtaataagtggttgccaaaaacctatctttaatgctgaatatattctttatacatcaaatggaagaacggctaaagttcttggggtcagagctaatacaagatttgtggttgataaattggttgctaaattttgtaggttggtaaccagtatgatgaatattgactctgtctctcaacccggtccataccagacaaatgtgaaaccaagaccaccttatccattacctcaaacacctcaattatacccgtctccatccccttatccttccccaacaccaatgccaatgccaatgccaatccatcctttacaaacaccaccacactcaccaccaccactaccatcaccaccaccaccaccaccaccatcaccatcaccatcaccaccaccaccaccaacttatccaatgccaacagtaccatctactcttccaatagcacaaccactacaaagacctttaggaccgcttcaagcggagtggaataaaattgtaaatgctgccgcatatggacctgcaagtcgatacgtttcttcagttccaggaactctattcccatctttcgtcttaggaaaagatacaaatgaaaagattgaacagtgtaacaaggttttaagagaaatggttagttcagctattagctcaaataaaaggtcgtatgaaaatggaaatcttgttttggtagttgaaacaatttcagatcaaagggttactgttcaagaaagactagttctgatgactaatagcgataacccttcttatatcaaggaattaatcaagaacttctgtgaaagtgtgtattccgtcaaagtttccaaagttgaagtcaaggagtgggaaaagatttatagacaatccatgaaaagcgttatagttcagaaactaccaactgaagctcctagttcctacactgttactagtaccgatacttccagtttgttcaaaacttgtgtcaatgctttaaagtctttacttaccactagtaatataagaagtcttactcaaaattctgcagctttatcaagtattcttaattttagcggagcatatacaacatcaagtggtactagtcaatcatttttctcatcactcttctgctcttatccctatagtcaggtaggaattgaagaagctattttggccttctgtagtgaagtttactatggagcttcaacgcaagattttaaagtaaaggcagaatttgaaagtgtttacggcgttattcagcaagcaacaagtgggcctaattctccctttggtaggctccctgctacatctccaaaattcaaaatgccatttttatctcgattccaacttactcctcatggaaactttaattcagttgacttggtggatatttgcaaaaatttatttagagaaatttttgagaaaagctatagcagaattcctgtaaatactatgactgtaagacctttaatttctggagtctctcccaaaacagttcaaaggcttacactcaattggggtggtaatttgggtgatgttagtgtcgacttcccttttgttgaatccacagctggttcaagcgtatctttgcaaactattgttgaaggattctgtaaagaaatattccaatccaacattccaatacctagaggtctaaatctaggattaccccaactttcaccatatttgccatccccccagtcaactccacaaccaatttctcaatatcctgactcatattcagggtcaagacctccatcaggtttcccaaatcaaataactcaaaaagctgtaatggtacaacatgcaggtacttcaacattaagtcattcacgtagtatttggaacaaaatttaccatcattccaacttcgggcttggatctggaacaattacgggtcttggacctcatagacatgctgatttcattgtatcctctatgggagaagctctgtacaattattgctataatctatttgctgatttctatagcacaggcaattattacaaactttctggggataaaaagagattgagtgtcagtaaacaagtaaatatggatcttggtaaaggtaacgagaaggagagattaacttcacaaagttgtactttgacgtttattattccaagtaatactcaaggtggtaattcagaaggaagccaaatagtgaagcttatcgaaaagttttgtagatcttttgtaagcatgtcataa

SEQ ID NO: 3304 - DNA, 3330 bp, Cryptosporidium hominis
atggcatgtaatagaattggagactttttggtcatttcagaacaaaagagagttgataatgtcaccaaatcgactccaaatttccatagatctaagatttttgagattcaagataaagaaattcaaaaatataataatatgaaaggatatgttaaattccaaaatgttagacttcattggccagatgggaatcttatgcttaagaatgtctcatttgaagtcaaatctggagagattgttgctattattggttcaattggaagtggaaaaactggtttattatcagcaatcattggagaaatctctccatctagtggacaagttattaagaaaggaaaattagcatacgttgctcaaattccatgggttcagacaggatctattcaggataatatcttatttggaacaaagatggatcctgaatggtatgatgcagttattaaagcttgtgctctttggatggattttcaaatccttccagatggagatcaaactctaattggagaaaagggaattaatttatcaggtggacaaagacaaagaatcagtctagccagagctgtttatcagaaatctgatgtatatgtattggatgattgtttaagtgctgtagatagtcatgtagcagctcatatctttaagaactgtatatgtggacttctaggtgagaaatgtgttatactagttactcataaattggatataattccaaatgtggatagagttatattatttgatgcagaaaagaagaaacagttatatgttggtaatcctatgggtttatcaagacttccaagctttactttacaaaacatttcttttgaatctttacaatcagcagaggaggatggttttgagacagagattgaaggaagaaaacctttttatggtaaagtttttggaaatttggataaacctcagcctagaagtttaccattaagaggatttccctcaagtctggcaacagactctgatagagataatgagattacaaatactcataatgtttacaatagacctataactgctcccaaagactgttctcctttgggactagatgattcagagactggaaaaattgtggatgatgttgttgcagtagatttatttgatgaacttgttacaaaaactgaaaactcaactccaagtactcctagagttccaactcaagatctgattaataatacaataagctcatataagcttggaaaaaagtcacaaaagtctattagaaaaggaggaacttgtgaaaataatttagaaaaagggaaaaatcccaaattagaaatgaattcaaacttacaaactatttctttgaatgaagaaaatcatgtatcaccatatctaagagctaataaggttggttttattaaaggtcgtacagcatccattaggatgagtggagaaaagcttagatctcattataggaaggaaagtgactctcattttagtgaaagttctatggactttcttcaaagtagctcaagtgatagactagtttctggaggaggactgtttaataacaaaaagagagctgaaataattcaagaagaatcaatagaacttggaagtgtttccaaggaaacctattataactacttttcggaatggggagttcttaatatgattggaattctggtttgtcatattatttccggattcattttttcaaggaatatgttttggttagctaattggactggtagaaaaaaacatctaaattcatcagaaatttcagcctcaacttcatcctcatctatatgggaacctgatgtgtttatttatattcttctgatcatattctatatcttatcccatattacatccactcttttggttagaaatggaggaattaatgcatccagagcttttcatgaaaagttacttagtagacttagatatacaaaattgagcttttttgaatctactcctattggtaggattttgaatagatttactggagatcttacaaacttggatgattctcttccacgtaatattggggatttattggttgcgactgctaaagttattgtaatcactgtttctatttcaaaagtggttccaaaattcttaatatgtattccagttcttgcatatttattctttcaagtatcaaaaaagtatgctcctatgttaagacaaagtgaaagatttgcagcaatatatgctgctcctattttatcccatactgttgatactattgatggtttgacaactattagagcctttaatgctcaagaaagattcattaaaaagatggatgatgcaattagagttgaggctcaaattagatatcatgctggaacagcttatagatggttatttgtacgacttgaaattatgggatgtattgcagtatttactgctggaactcttggagttatatccgttgcttatgatccaacaactgctggtatgtttggagctgctatgacttttgctctatcagtttctagttgtttgaattttggtactagagttcttggagaaattgagggagttatggttggattagaaaggattagagattatacagtatctactccattagaggctatgccaatattggataaacataggcctcctagaaattggccatatcaaggaagaattgaatttcatgatctcgaacttcgttataagcctgagatgccacttgtactcaattctattagttgtaatattcatccaggagaaaaagttggagttgttggaagaactggagctgggaaaagtagtatatttatatctattttgagacttgtggaagctgagagaggttgtattaagattgatgatattgatatatcttcaattggaacatttgatcttagaagtagaatttcaattatacctcaagatccaatcatattttctggtactattagatttaatttggatccattacaacaatatactgacgaagaaatataccaagctttaaaaggttcacatttggattcttatgtttcaaatcttgcattaggcttatatacagtacttgaatcaggaggccaaattttgagtgctggacaaaagcagcttctttgtcttgctagagctttattaagacaaagcaagttagttttgctagatgaagctacatcctctgttgattctcatactgattctcttatacaaaagactattagagctgagtttcacaattctactatattagcagttgctcacagagtacaaactgttcttgattatgacaaaattatggttttggattctggtaagattgttgaattcgatcatcccaatttattgctctctaatcctaaaagcattttctattctctagtccatggcgaacactag

SEQ ID NO: 3305 - DNA, 4176 bp, Cryptosporidium hominis
atgcttggagggatttttaatagaaatttgaaaaaagaaaatgatgatcaagtacaagatgaaaagccatttatacacaaaaaaactggtggaataactccagaagagagtgctagcttcttatcaaaatttactttttcttggtttactccaataattgactctgcatacgaccatatattatctttggatgagtactactatttaccggagcaaaacgatccaagttactcgctttccaactttgaagataaatggaaagcggaatgtgaaagatttggaaaatttaaagtgtttgaaaacaaaaatgggaataacactaatacaaatagttctagtaaaaagcttaaatttccttcactggccagggtattattccagtgttacagtaagcaaatatttattatatttgctttagttattttttcaaatatctgtaatttaactcagatatttctactaagaaagctcttagaatgtattcaatcttctgagttcattcccagagttgaatcttctgctgattcagctatcccttggtgggcagttattttggggattgttcctgagagatttagttcgagtattgcttgcaaaggttttgcctatatatttgcaatgacaaccctcataattgcttatgcaattttaagacagcaagaaaccaggattgttacaagattagggaggcaaattcgatccttgattactggggttgtttacaggaaattattgaatttggactcgaatatattttcagaaagccctcaatcgaacacagagctctcttctagagctagcaaagccagactttctgtggtttcagaaatttctctggaaggagctacgggatcctttggcatgtctggaaacgttgttaatcttctaaataacgatgtttctaggtttggaaggctatatacaagtcatgaattctattatggcgcttgttcggtcactattgcagctataatactttatatgaatattggaatttcaggaattgttggaatcttagttatgtttgctcatgctgcatggagtattaacttcctaaatatcagagcttatgtaagaaagccattttcagaaatcagagatcgtcgtattcttttgacttccgagtatcttaattacattaagattattaaatcatactcttgggaaagatattttatcaaaaatattgattcacatagagaaaaggaaatctcaagtttactggctcaaggtgcatgttggggatttgcagcagcatgccatgctgttgtttttcacgctcttctttttactattattgtaagaaggtatatgggtgaggttaatgaccctgccaatatattctttgcatacgttgtgtacgatgcagtgagtgagtttattgcctccttccccaaatcttatgctctgttcagggatttaattctatcatgtgaaagaattagcgaattcctagttattgaagataggcccaatattaattcacttatgaatacttcatcttgctctgaatcctctcgtgcaatgccaattgaggatcaggacctttcagagccaataaaaggaaatgttaaatatgagaaagttgagctaagatggccaagtggtgctctcttaatgaaagacctttcttttgaagtaaatcctggggaaatgatggctattttgggaccggttggcagtggaaaaagtggtctactgctttccataattaatgaacttcagcattataaaggacttcgacaggttagtggaaaattggcttatgttccccaattagcttgggctattactggtacaattagagaaaatattctttttggagccccatttgaccctgaatggtatgctcaagttgttgatgcttgctgtttagtagcagatttcaagatctttccaaaaggcgaccaaactatgataagtggtagctctaataacctttctggaggccaaagacaaagaattagtctggcaagagctgtttaccaaaggtctcaggtttatgcacttgatgattgtcttagtgcagttgatagtaatgtatcagctagaatcttcaagaattgtatacttgggttgcttagagataaatgcgtcattttggcaactcatcttgcagatttagttattcatgttgataaggttttacttctggatgacatcagcaagaaacccttatacttgggagatccttatggactactaaagtttcctcactataagaatctttttggttcaaacttaagtcaaacaaagaatgaccaaaagattgcaaaacttggctcaaataacagttcaagagagtctttaactctaacaagtcttgttaagagcaattcaactcaaaaatatagtcaagaaggaatctctataacagaagaggaaggagagagttcaaggtttaaagttgatgaagaggaggaagaggaagaagaagaaggagtggtatctctagatacttatatgaagtacatattctcttacaaaaagctcactctctttaaactattaatttttgtatctttattggttgcaatatacgtacttattactttcttcattggaatatggctagaaaatgctaatgaagaaaactggagaacttactttaacatatacttggcagcatgtattgtactcccaattgtttgcactttaaccacaatcatcttccgagtaggaggtgttggagtgtctaggatctatcacaataagcttctttctcatattgagcatgctcctctttcattctttgaaaacactccaattggaagaatattaaacaggtttacttcagatcttgttcatttagatgagctcctaccaacaagcttcaacaactcatctgtaacagttttaatgtcagcaacaatgttggtatcagttggagtaataacaccacagttccttttcttcattccaccaatattttacgctttttattgtgtggccaaaaagtacccgccaattctccgtcaaagtgaaagaaagtcagcagctttaacagctcctattacgtctcaattgatggaaactatgtcaggtttagcaacaattcacacatttggagcagagaatatgcttattagaaaaatggataatgcaataattgctttaaataatatcagatatcacttggacactgcctatatttggctttacctccgtcttgaggtaattggttgcatgactttagttgtaacagggattttcagcgtacttctttcagcttgtaatctatcaaatccgggtattcttggtaccattttgtcatttgcagtagctttacctggatggctaagatatagtatctttactgtcggtgaatttgaagcagatatggttgggtttgaaagaattcgtacatatacaaattcagaaatttaccaagtagttgtatcagatcaagagaaaagtaatataaaggtaccggaagattggccttctcaaggcaagattgaattcaggaatgtggatatgacattttaccctaatcctaatccttctctatgcaatatatgtttgaagatttctccaggagaaagaattggaatagttgggaggacaggggctggaaaaagcagtctattttctgcaatacttcgtctattcgacccttcttttggcgcaatattgatagatgatttagaaacctccaaggtttcccctctaaagctcagagaatctatttctatagttccccaggacccagtaatattcactggcacagtaaggttcaatttagacccaaaaggaagttattcagatgaagaactttatgaggttcttaaaagggcgcacgtatttgattatgttaacaaccttccagggaagttaaacttccaattagaaggaggtggagcccagcttagtgtgggtattaagcaactattttgcctaacaagagccattcttagaaaatccaggatccttcttcttgatgaagcaacttcctttgtggacatccagaccgactctctaattcaggaaactatcaaatccgagtttaaaggctgtactatattaactattgcccacaggattaaaacaatcattaattacgacaaaatccttgttcttgaatcaggtagagtgtttgaatttgatactccccagaacctccttaggaatcctaagagcgttttcagctcccttgcatcatcgatttccgtataa

SEQ ID NO: 3306 - DNA, 5676 bp, Cryptosporidium hominis
atgactcttttcagcataaaggtccttaaccacataatgttatggtttggtttgatcattttttgggctattacgcaaatatatggcaaatctccggtggaacatggaaagctgatgcgtaattgtccccctgaatttacttatagtgagcttcgaaggcttacatcagaaggatctttggtggaggctcagaactttttagactctttgagatcaactgagatcaatgttttgtatggaatgattgaagtaagatttgatacagatgttcgaaagcttcaaattgagcttcctaacctggagcttgctgatataaaagtatcttcaaaaattcgagaatttatttcctatgaatatgtatttgattgtaaagatattaaagaaagtaccaggttcttgttttggatcattagacattttgatttgaactacttatctcctgcaatagcattttcaatcaccaagtatgtacttggagaggcttccaaaatctttgggaaggagtattttataccagtaacacctgttacatcaattaatttgtctgaggttatagctcaaaatagtaaagatgattttccttcaagaaagcaaatcaatgaagctatacggaagtttacttccactggtaggttctctgaatacaagggagttattgatttgcccgacattaccaccattactccagcttctattgaggataaagttttgagaagtagaatcctaatacttcagagaggaggatacgctccaaagaacaaagatcgttctcaaattcaaacagttaagtatattatgagaacctccaggtattatttgaacatttatttatctgcagaaatgtcttataggctttggagtattgtatattttattatgacaggaataagaatatctgaatataaatataaaatgttctcatttatcatgaaaaagagccaatctgatacctggccccatgaatctgatgttttagaggcgatttcaggaactttaactaagtttggaattaaacataaacctttgagtattcattccagctggtataaaaaattaaagcaagaaggatatgtactttctgttcctcaaaacataaaaacctctcggtggttttgtagattcttccagcattatcttcaaatcatgattaatccatacttacagtttaatatatggaagactactcttgagaatcttttagaacctcatattagacaagtcaatgtttccggtgataaatgttttattagagaagatcccaaattcccatggccaaattgtagtcaagttcctatcaattctcctgaatatgatgtcttaaaacatgataaagctgtggacaacttaactcatgaatttgctcgtattatccataatttcaatcctggatatccatttcatgatttgtgtgaattaacgcgtcaattgattgaaacaggttcttttcgtagaaaagtaagacaaccaataaccagagtaaagcatgaaattgccattcgtaaacttgagagaaagacatatgttagaaatcttgtaagatcttataattatgcaaagaaatacgagccttttattcagccaagcgacgaaatgttgttcttctttaaagattatattgaaaatgacgttcctttgaatgataagatcgctgataaaattgcaagagaaaagttcatggacgaagatcttgaagatgttgttaagactaggaactttgttattgactgcgcgaaaacatatagttctattactgctagaaaaagttggaacgacttagagattcgtgaaatcccagctaaaggaaagaaagccattagtacagcctgcagtaacctcttttactcaagaccaaaatgcaaatttgagtctattcctccatttcatccggcaagggaacatagtgatattttaactggtgaattttctcttcgtatattttcatattttagaagtattggagtttataataccattccagatgacttttgccctgatgccattaatgtgatgagtaaaatctttaggattgagccaaagaaccatgaacaattaaagagagattatgccaagaattccaaaattcatgaaagagatcgatttatccgaaatgcattgttaaagttcaaaactcttgataatactgatgtccaaagatcaagagctcgcaaactgagtgagatgatggagcaaattgttaaatctaagcttcaagataagcttaaaccaaaaacgttcgactatattttcggtagaattgttaataggtactcagaatttgttagtaaagctgatggtaatgattgggaaattgatgaactgaaagatatggttcggcttgggaagaggtttgtatattataactcttttaaacagttcccaaaaaataagtttaaacatgtttgtaataaacttcttacaaatattgttctgaagattcatggttctgaagcaattattgaacgtattagaaactctgatccctctcttaagctcagcgatcaaagaatttctagggatatcaccaaaaatctttgtttcagtctcggaagctggcaaatttcacttcgaaaaagaataaaaaataagcttgaatttctttggcttaaaatgaataatcataaacaagaatataaacttattgactctaatttgattccaattcccaaacatgctagccaaaaatactatatccaagtagctgacgccaatattataaacttttataattcattgggtactaatttgaagaatcaattcccacacttagatataaagctcccaaataccattccaattgaacctgaagtaatgagacttagaaagttgggatacgactgtcctcctccaaaatctgctaaaagtgatggaatacctactgctgaggaatgtatacgatatatttacagatatggactttatatttacaatggcttgattctagattttaaaattctttacaaagtataccagaaatcttttatggattcaggatttcaatctttagcgtatttgccaaacatatatcccaaatttctcaacttttctctattgaaatcaagtttatttgattataacttccacagatttgaaactatatgttccttaaataaattagaaaccgaattatattggaaccaatattttacagttgttgagaacatttccaaagatttaattaaacaattacattctgcaaatgttattcttccaggatcagctgatcgtactagtagtacttacaatatatcccccttaaaaaccagatctcgtactatttgtgaatttattgccagaattctgaatccaaacttttacaagagttttgatgttaacacttctgactttttcaagggtcaaatatcaaattctgaatataataaaggacttgtctggtatgatttaaatcaagtcaacagtggatctgcacaccatacgcctaaacaaattgataagaatgttatgcgttcactttataccatctattttgttcaatcttgtattcactcactgatgaaatacttttctggtatccattttttgcatgcagctttattatgtagaaaaacaagagaatggagaggctgtgatgagactcagtttattggatataactatattgaacatttggaggttggtgatccaattgaagaaatttacttgaatagactattaaagggagtatttgttgatatggtgacttttgagttgcaagaaaaatcaacttcattattctggtcaagcaagctttatgatatgccaactgatagacttccaatttcttatatgagattttgtccagtttctatcagaatacatgattatcttcaatctgggaggttcaagaactttgtggattcttgtgtttatgctttggaaactagtaatgtttttcgtgttgaaattaatggggagatgtttaccataaaacgaagtgttgctgaaaagctttgttcaagtacattttggggacaagattgtaatcaccctacaatcaagagttctgcaaaatttctttacgaacgtttaattcaagcccttaaactcccttctccagttattccaagctcaattatgtgtaatattgcatatgaaatggccttcagtaagaatcctgttaatatttgctttaatcctaatactttcgtggatactaggcctaaagctggaacaaacccctattctgaagactataagctaaatcacaaaaccaatgatgaaaaacccagacttagaactaagaaatgggacactccagaaatgaattttgaaaatgctgttcctctccgcgaagaccctatgggaatgcttggccacattgcaaaaacttattctttgagcgaagtaaatttttctgagcttagagatgcatgcgagcaggcaccagtttccattagagactgctccaaagtaccttctttcgtaaaagagtatccgaaaattgtgaaaaacccagaaatcttaaagaaaatcaatgaggagactatgaggttattttaccctttagtcaaaaaagataacccaaaaagttttgaagaattcccaatcagaattgccacctttgtggagctttgcaatctttctgtatcaacttacaatatcagcccggagcttttcaacactgcttgtgtttcttcttttggatggaataaacattttaaatccaaccaggaaatttggaaagatacagattggcaaacttctatactttattgtagttccacatctaaatggaaaagctgctcaaaatggtcaaacaaaaataaatttgagctcgaaaatgatcgagtatttgaattatcttcttcatatgctagttcaagtccccttcaaaaagcttctattgactttatggctgctttcttctcttccactatttctctcttcctttctggtgcaaacactcaaaatatctcagaagaccccaaagacattgaaatgattacaaaattgagagagaattatgatatgttttgtcctgcagcaactgagcttcttgtaagtcataaacttattgatcaatcgaaattaaaaccctcaattattgaatttatgaggtctgaggaaatttcttacactcgagtaaggagaagaaagccaaataacggaattccatatttgtttttcaatactgattgccctgaaatccttacaaatcatatcttaaacattgtaaacagtgatgagaactctgttaaatcaaatcctgatgttcccttacaatggtctagaaaagaatttatcctcgaatttgcagttagagtttgcaaaaagcatttctcttggaaagactgcaattatgacaaagatattttggataaaaataatccactggaaattaaccactttgagtatgttgcctcttcaatgtatagggaattcttgattagctatattgaagataaagggtcaattcccaagaaaattggtaatcataaaaatgataacttttatgttttttgtaagctctcaattaacgtaatttccgagcatcccagaataatccacagcaaccaagttaggtcattaattgaaaatcttcttccaaaaaaattcaaagattattcccaaaatatcgccaatgtcttctttagttcattcgaaattttccataaaggtgtcaaatatactaaaagtatcaaacctccaaaagaaaccacaaaattctcattttcttaa

SEQ ID NO: 3307 - DNA, 447 bp, Cryptosporidium hominis
atgggtaacttgaaatcctgttgttcttttgccgatgaacactccctaacctctactcaactagtagttggaaatggttcaggagcttcagaaactgcttccaaccacccccaagaagaagttaatgatatcaatacttttaatgtaaagttaataatgcaagatagaagtaagcttgactgcgaggtagtatttgatagcacaagtatttcgctttctggagatggaaaatgcagaaatattgctttggatgaaatccaccaattattatattcaaaggaagagctctctagagttgaaagtagtgctggaatcagtgattccgacaattgtgttgcaattcatctcaaagaatcaggaaactgtattccccttttctttaataattcgcaagacaaggaaagatttgttgcaacagcaaacaaattcaaaccaaactttaactaa

SEQ ID NO: 3308 - DNA, 1131 bp, Cryptosporidium hominis
atgtattcaagcttaaatcactatcaaaaccaaataaattctccctcgtcttttagtcaatttattataagtggggtgggaaatgatcatggttccactagatcaatctcttgttctgctggatatgtttctgacaatccagaaatagactctgaaactttccaatgtataaatggaaaatgggaatccaactttgaagaaaggttcaattgtgtaaaaggagcagaagcttcacttaaatactgcagaacaagtttcctttctaatgtacttggaactgaaaaattcatggttgaggagctatttgatctttctagtagtaagggtgaagattggaaagtttttaaagtaacttgttcaagaggatatgaagcaaagattgagcctatactattggcatgtaacaatgggaacttttataatatacctggagatactgtaactatttcaaaaagtaatgacatggaatttattcataatctaatacttaaaacggtttatggaataacatatagtgaaagtttgaatttaccactatctcacggatcacttccaaaaattccctctatctcattttatagatcaaattttaaagaacaagatgaaatggactcagagtcagaaacaaacatattttctatcatagaatgtgttccgaaacaagtaatgaaactatcagaaagtaaaggactttctgggcctgctttatatgcaattttattcgctcccttaatattggggatgctaattttagcgatattattctggttcagaaggtacaaatggaagaaaaactttgaggatgaccaaaatacagaggtaaaaaaacaaactttggcaattttagatgttaaaagaaagaataatttgtgtgatattgaaactgcaagtcctgcatcagaattagaaaagatgagcaaccaagaaagctcttttctttcaaaaattcagtctccatccgaaaaaagatatagtaaagggagtaaacatatctctcatacactttctggacaaggaattcacgataaaccaagtttagaactcactaagtttaaaggaagaaaaaactataaagaagaaaaaacagcttcagaaggaaaaggaccgagacaaaaaggggttcttctatag

SEQ ID NO: 3309 - DNA, 681 bp, Cryptosporidium hominis
atggggatttggggaagcaaggttgatataaaggatgaggtaaacaagaacaaaagagcagtttcgaaggcaattcgcgaagttgacagggaaattcaaaagcttgagcaggaggaagccaaattgatgagggaacttcgaatagctgtggaaaaaggttatacagaatctgcaaagatttttagcagagacattttgaaattgagaaagcagatggagagattgagtttagcaaggagccaacttatgggggcagagctaagacttacctctgtaaagagtcagcttcaagtaaacagcgcgatttctgatctaaattcaataatgggaagggttaatgattcaacagaaatttccaggatacaagggattttgaagaactttgctagagaatcagataagatggatgtaaaaggggagataattaatgattcaatagatgtagctatgggaaacgagtcccagcctgaggaggaagaggctttagtgaacaaaatatatatggaagtgtgcgaatcagtgagacaagggaaagaaaaagagttagccaaagccaacgccaaaggtccagatatcaacaatttgttatcttatagttcttttaataaagacaatcctggagatgaaggttcaggaatttcaattgaagaaagaattaaaaaacttggtgaagatagatag

SEQ ID NO: 3310 - DNA, 348 bp, Cryptosporidium hominis
atgagcgagacaccaactaataaatctcagggaggaagtaatcagaagggagggaatataatccttccattagcactgatagacaagtgtattgggaatagaatatatgtggtgatgaaaggggataaagagtttagtggagtgctaagaggatttgacgaatatgtaaatatggtattggatgatgttcaggagtatgggtttaaggcagatgaggaggacatgtcaggaggaaacaagaagttaaaaagagtgatggtaaatcgtttagaaactatattgttgagtggaaataatgtagcaatgttggttcctggaggggatccaaacagctttaacttttcttag

SEQ ID NO: 3311 - DNA, 1209 bp, Cryptosporidium hominis
atggacgctaaaaagactattaaaaatagacaagggcagtctaagaatagtccaagctcaaggaaaagatccgggactaggagacaagacgaatcccaggctagtcttcaatctaattcggaaggaaatgatgatatcctttcaaagataccatttgcaggaagtccatcaaaatctacattaagcgttgcaattccagcatctattactggaaatgcccaatcttttgagctgagagcctacttagttggccaaattgccaggataatttctgtatttggtgtggacgaaatcattatttacgaggataaatgtaaagatgtaacagataatgaaaataggtcctcaaaggaatgggtagagtttgcttgttcaaaatggatggagttttttgtgaagaatttaaagtatctggagacccctcaatacctcagaaagaccctttttaagtttgataatgattttaagtttgcaggtttacagaatccaattgacgctcctcaccatatgagaatttctgaatggcttccttacagacagggagtaatagttccaggcccaaagttctttaaaggaaatattttgccggaccataaaaataagggaagttgggttaattgtggacttcctgtcgaagcttggattgaaactaaacttgaaaataacaccagaattactatcaaaatgtcaaaagagtcagaaagtcttcataaaaaactctgttctgactttaataagtttggaaggtactccgaaattaaatcctattttactggtaagctggttgatgattcaactccttatagaaaaaaaggaatatattggggatacaaagttcgaccagcaaactcattaaagagcgttttcaatgactcagaatacgaagaagggtacgatttgaagataggaacttctgagagaggtgaacctgttgacaacaactttaaactctctactaaaggcaaagactctaaatcacaaagttttaaacacatacttatagtgtttggtggccttggaggccttgaagatgttcttagcgatcctcaatgctctctagacaaggttaaaaatccttcctctttatttgacatgtacattaatatatgtccagagcaaagatctagaaccattagaacagaagaagcaattggacttacattagccttactcagaccccaccttttagaaaataacaaaaacttataa

SEQ ID NO: 3312 - DNA, 756 bp, Cryptosporidium hominis
atgcctagaaagactcaagagtttgctcaaactgctttaattgatccagttgtagtaaatgtaggtagagcaggagcagcaaatttaagagtaattcaggaattcgaatatattagacaggagcgtagactcgttagtttgctatcatgcttgcaaaagactgcacctagagtattaatattcagtgaaaataaaaaagatgtggatgaaattcacgaatacttactattaaaaggagtgaatgcagtagcaatacatggaggtcttactcaagaacaacgtttcagatctattgaacagtttagaaatggggaaatggatgtacttgttgggactgatgtggcatcaaaaggattagactttgaaaatatccaacatgtaatcaattttgatatgccaaaagatattgaaaattatgttcatagaattgggagaacagggagaggaggttctgtaggagtgtcaaccacatttatagataatactctaccagaagcattattatgtgatctaaaagctttattaatagaagcaaaacaggaaattcctccatttttagaacagtttgatagcacaaatacttcccttcaggagattggaggagttagaggttgtgcatattgtggtggacttgggcatcgcattggtcagtgtactaaacttttagagttacaaagaaaaacccagtctggagctcctaaagatgctctctcacttggagctagatatacaagttcaaataaagaagattggtag

SEQ ID NO: 3313 - DNA, 1068 bp, Cryptosporidium hominis
atgaaaatattcctacaaaatgaaaggaaaaagtgtaatgacaagttttctcctttctatactgaactcccaatcttactattacgctttcaacctaccaccctcagaatttcaactttaggaattttagagacacttgaaacctctggcgccaaacatttgataatattaattctagtaaaatttgtcaaaatgaacgtaaagtcagcatcacagccagagctgtggcagctggccagaaatagtagtggatatagagaactgctactgggaactagcaagctagctacagttctctgcacaaatctacacctgtcaccaggaactactctgacatcctgtcattacatatataagttttggtcaaagtttgatattcttgaaaccgatcgtaaatttattgcagctgcagctgttctcttatcttggaaggttagagaagatattgagccaactcgaagttctagaaaactttctgaattatccagatttctatatagaattattaaagctaattcgctttcccaagtatccagtgcaccaatacctcttgagctttcttcaagtttctggatatataaggattcaggaaaagaatacactcattatatggagcagattaaaacctatgaatttgcactacttagagcaataaattttgacctagttcctattgaactaccattttcacatatcgaaagatttacaagaatcctactttattctccaaaactcaatgaatatgttgaggaaggcgaagaaggagaggaagaaggaaaggaatttgagtctttaaaaatgtttagactccttgcttcaactataagtcaagatttctatagactcccaaatgtatgtatgcaatataatgcgttagaagtctccttatgttctgtatggtatgctggaatctttctatctatgtcatttgcatatgaagaaatttctggatcaaatcaatcttggatttcaaaggcatgcccagaagttaatgcagaacgtgttgttaaatgcatggacgagtgttcaaaagttcttatatggctaattaatagtgattccgcatag

SEQ ID NO: 3314 - DNA, 2061 bp, Cryptosporidium hominis
atgtttgataatggttctccgttgagcataaggctggtaatgtcggatgctactcagttacaaccaggagatatgattaagataacaagattttctttgaatgagatccattccaccaagttggttactgttgttcagtacgacaaagttggacattggtcaggatttacttctattggaaaggctactccgcatccatgtatggggtccagcaaggctgcagggggaggtccaggggaccagaagcagcctggagttcaaaatcagatgggagcttcatcaagcactccaaattcaagtcattcaactgagccaagcagcgtcagtatgcaacagcaacaacaacacaatattcagatgcagccacaacaagttggatacagagcgagcgggccatcagaacaaatgccaggatccgcaggacccatttcaggtagagatggcatgcaatcctcagggccaggctctatgaatatgggtaatatgagaagtggtccatacggaggaggtggaatgggttcaggccagtcaaagggtccagtttcgaggaatcaggaaattccagtgtatccaataaagaacataacttcgtatctacacaggtggagaattgttggccgtgtagtgagcaaaagcgatatcagaaagttctcatcatccaagacaaaggaaggcaaagtgttttcattcgagatttgtgacgctgatgggagcgagatcagggcaacatgttttaccaaagccgttgataaattctatgatgtgctgaaagagggggaagtatatagtttctcaagaggagatgtcaaagaagcaaatactcgttttaatactacagggcatgaatttgaaataatcttcaacgaagatgcagaaattcaaagtttgccacaggatgatcggatcccaaagaagacctttaattttgttcctatttcagaaatccggggctattccaagggccaatccctggatcttttgggcattttgctcaaagctgggccaattacaacaattaccgttaagtctactggcgcagatacccagaaaagagaactaacaatcattgataagtctggccatagcattgacttgaccttgtggtcagaaaggacccacttagatgagggcctcatttctcagaacccagttattgctgttaaaaatgccattgttgaggagtttaatggatttagattgaaattgggatcaagctcttccattgaatggaacccttctggagttgaacaatctcaggaactcaagaattggttcttctcccagtcaaatttacacgagtcagttgtttcgctctcgtcctctagtccaagtcctggaaacactaactcaaattcctcagccaaaaggcttagtattgatgaaattgtagctactgctacttctgggtctagctcgtctgatatgctcgatggagggatttgggttcacacttatggaactataaggtcaattcgtgataataagtactactggagtagctgccctaaatgtaagagaaaagttactgaaatcgaagatcctaacagtattaacgctttggtgttgccttatgggtcagaaaaggagactagtacatctctcgggccaaactatcactgtccaagttgccagcagtccattgaaaaccctattaaaaagtacatcttgagttgtgagattgttgactctacaggaacaatcagagccgtagcttttgcagaacatggagaaaccataatggatggtctttcaccagaaaaacttgaatctcttaaagagaatacagataaaaatactgaggattgcttctctgataaactctttagtgagtgggtctttaaattgaatggaaaaaaagaactctatcaggactctgagataattaagtaccgaatcttttcagctgaagatatgacaaatccagaaatcctaaacagagaagccaaaagaaagctcgagtatatttatgacaagcttaataatattaaggaaactaatactagtagcaatgcttatagtgctgttaaagtcggtatgggatttggacagtttggatattga

SEQ ID NO: 3315 - DNA, 402 bp, Cryptosporidium hominis
atgaattcttcttttcctatagacaaagaaagagcttctagagagaagatctcacagttagatagaaagctaaaggttttgagcagtaagatttcagaattatctcaagatagtaaagaacatggtcttgtacttaatgcttttgagaaggttgacccagaaaggagatgttttagagtaattggcggagttatggtggaaaggactgtgaaaacagtaaagcctgcactggaaaaggaaaaggccgccttggactcagcaatttccgagctagagaagcaatatgaatcgatagaggaggaacttaaaactttaattgagaatcttagtaaagattcaaacatgggtattccttcgtctgcttcagcatcttcctcgtcttcctcagaggtcaaagcgtga

SEQ ID NO: 3316 - DNA, 906 bp, Cryptosporidium hominis
atgaagtaccttccaatggtcagttcttcacttaattctacttcctataacagatttttatcaagatttggaagtaagcagagaccagtatctagtaagaataggatattattaacgggagtgtacacatcaaggaatccgacgaagccaccaggatatgaaaacgaggactcttgttgcgtaggagcaagttatatttgtgttgcggatggagttggtggttggatttcacagggagttagttcagctatgtatagtagacagcttgtaaattacatagaaacatgtattaatgattactcaagggaacagaaaagcgagttggacaaagataagttcattgaaatgttgaataagtgttatgaaaatatgaaatcttccaaaattattggtagttctacgctctgtttagcttatttggataataataacaagcttcatgtatttaatttaggggattcaaagtgcgtaatatatagaaaggaagaaaaagaagtcatttttgagtcagagattcagcaacacaactttaacactccttttcaactaggaactgggagtgttgatactccttataatgcagattatatgatgttagaaggcatcaaatctggagatacgattattgtagcaactgatggactatgggataatatttcaatggataaagttattcgaatagtcgataataatttgttgtatgaaccacagaaaattgcagaaaagcttgggagggaggctttacagctatctttgaactcgaagcatatttctccatactcaatgagtttaaataactatttaagccagaaattgcagtcaaatattcaatcaaatggtacttttggttttgtatcaggaggaaagcctgatgatatcactgtatcgataggggtagtccaatag

SEQ ID NO: 3317 - DNA, 486 bp, Cryptosporidium hominis
atgaatgatgtgctgatgaacgtacctgatgaagtaggtaaagaagaaaaaaagattcgaatggttaagaaggcagtgataccaaaggaaattaaggaaaatgatatctatgtaacaagaaagagaccattaatagtatactttagaagagcaatgaatcttctcacagtttcagaggctcataattctatttacgaagaaaggcttggatgtagacggaataaaaagctttttaagtcaggaaaaaatgaacaatttgtagtaatacatggaatgggagcctgtataatgacagcaatttggcttgttcaggacttgaagtcaaatttaggagataaaatcaatattgaagtgactacaaatactatcaaagtaactgatgtacatattaacgaagaaagagaatgggaatcttcgaaaagcacaagaaatgtgagtggaatatcaattaaggttacaatgaacaagcaagaatctagaccttag

SEQ ID NO: 3318 - DNA, 1404 bp, Cryptosporidium hominis
atggctaggatgttattaaagaactttgttatatttttattgtcagctttatgcttggcttttgtgccaaattttgctgtacttggtgcggaaaatgagattgaacctcaagccaaaagtctttcgataaaatcattcacctcatcatcttcttcatttagctcatcttatcaatttcaatcttctacaacaacccccgctacagaatgtagtgaatgtccagattccatgttccccgagaaaagtgaagatggcgagaaagactcacaatctccaatatttttagatgaactttattccagatattacgaatttaagagtagccaggaaggttcaagtattgatgaatcctcttctgatcaaattattcttgtcacaccacctgtaaccacgccagttgcgacaccaattccagctccaagaactacaacaactactacaactactactactaccaccaccactactactactaccactaccaccaccactactacttcgccaactgaatctccaaagttccctcttgatgatataattgtttcagtttctccaattgacgaatcatttttatactctcctaaaaatgaaaattcaaagtatttcaatgaatgtataggtcaagactgtatggagcttgcagcagtcggttcaaaggtcagtgatttggttaatatatttgagcaaggaccttccgattttgctaagccaagaggcgaatcctcgagatcagaggttgcaaagcttgtcaatgtattcgagaaatttgatgatgaagaccggtttgaacccaaagttgttagtccaactttgaatgccttgagggaaggtaccttagaatacttacaactcccagaaaaggttgagcctgaggtttcccattttatagcaactagagaagttgtaccaaagatggctttgaaattcgaatctctcaaatatgaagaccctaaaaacgagattgatgatgaatacgttgctacttctcttgtggaagttactgatcgttcttctgaaaagcaattaaggtccagggtaactagagaagctgttccaaagcttattgaagcttgggaaggtcttaaagaagacaaggaaccgattcttctccgatctaaaaagactggatacacctttaaagagttttgcgatgataaaattaagaaatgttcagattcactaaccgagaagcctgctttaattgaagacattcaattccctccagcggaatatgatgttattgaagttcaacctggtaagaaacacaaaatcaagattagagcagtatccaatgatccagaatccgcaaaggaagagctcaaaagaagtgccgaaaaattaggattggatttggatgaacaaaaaatcaaagttaccaaattaagagggtacaaattaatataa

SEQ ID NO: 3319 - DNA, 222 bp, Cryptosporidium hominis
atggcatatttccagtgttttaacatacaaaataagggtctgtatttagaaggtcctggtcttgaactttttccagagtctcatattgaaaattctggaatctacagtactaactttcaaagatttggtcaaagatccaagttgaatgacttttttcttggaattggtagatcatccaggaataatgaaggttatttgttcctctcaataagaattttttaa

SEQ ID NO: 3320 - DNA, 120 bp, Cryptosporidium hominis
ataaaatcattcaactttctttgccattatattattttgggtggggagagctttggcgggctcaacgggtccagatattgtattaatttagtaagaagcaaaggtaaaaagaaaaaagat

SEQ ID NO: 3321 - DNA, 456 bp, Cryptosporidium hominis
atgacaaaaagttcagaaatgagtggatcagtagggagtaaaaacattgaaaggatgataaatagtagtctagatgacattgtgagagaggccaagaaggaaagacaaaagaaggcaaatcttacacagagtagagtaaggaatggaagagggggtaaaggccgagatttaaagaagaggagtgaaagaaggccaaatagtgtgaattcaaatggtaggagaaactttaagggttctccaggtaagatttcaagaagtagaggaggaaatcgaggaagaggttttgatcaagggaagaggatgagtaaagatcaagttaaaagtatccaaattgtagccaagcttgattctattccaaccccaacagcacaacagaaggcgggtttaaataacttggagataattccgagctcaatttcgtctcaaaaggccaggagaaatcgagtatttagctag

SEQ ID NO: 3322 - DNA, 1161 bp, Cryptosporidium hominis
atgatgaaagttctagtaggattaggatgcttattacttattgttacacatattttgtgtgcgaatgccattcatttaggaagtcctaattatagaacagtctatgtttcaaggaagaaagtcccaactagaccccttccggagaggttcaggggagaactatattcagatggctccattggatggctttgttcaaaaagaataaatggaaggtggacagggtggattccagttagtgagtcgagagtacctcctcaaatggtgaaacaaatgaggtcacaattgtccagaagacctagaagagctccacaaatgtatagggaaagaattatatctccttcatttgaagaattagatcaggaaacattctcagaagacagttttgaattagttcagccaactattactcaacaaagaaaacaatttacttgggaggaggagggtccaagcgatgaagtttcacctttacagcttcaagaaatgccttcaatctcaactacaagccacagggagtacaatagtagaacaggaggatatccagtcttgcaacaaactagaattgaaagaaaaaatatccctagcagaattcaaaaagtatatcaaacttcaaccacagttcctggagattctgatgaagcagacattgcaagatactttgaagaacagaatacacctccaattgcaggcagaaaaggaattaagggcattttcaaggatacctttaagaacattccagagttggagctggcttcacctacattttcacaaaattcccccatacaagcaattcccccaaaaggctatataccaatccaacctcaacatccatctgactacgatctaaataggatgcaatggaggtttttcttaacatcctataacccagaacttgacaatgttaggattattaaacgtatccctccacttgggatgaaactatcaaaaactgttactgagtgtacaaacaactatcacaaggctttcaaactacattatttaactgtgtctggaatgatgtttagcaataaaatcaaccgagttgtgagtaattcaattaatagagaacttaaacaatggtgtagcggaatgatgactaattggtatcgtcaattgcaaaaaatgggtttagttgtcccaaaactcagcaggtttattaggtag

SEQ ID NO: 3323 - DNA, 996 bp, Cryptosporidium hominis
atgagtgatttctactacgactatttgaaactaattttagactcaattgttgaacataatattcttttctcaagaacaaattcattagttccatttttaagttcagcaactcttgtttccaagagaatcatgggactccattgtaaccaatttaggcatctaggctcctcaacctttactttttcacaaaatatttcaaattcgatcaacagtatttacagggatatctcctcttcaacaatagaaacaatgagagtagaaaccatgacaaattccttcaaagtatacactttaccttccatgttaactcatttcaatggaattggtttattaaaaaatctcaatgtatggaaatccactaaaattttcccgaaatttaaatgtctcatcaataatgacaaaaaatctctcagttctgaggagttagaatccctctcaattctcaaaaacctcatctcaaagatgatttgctttggattgaagtttgaagaccaaacccgtggcttattttctgagaaaaatactacaaacagtaaaatctcacatttcctcaagccaaatattgaatccctttactcttttcaatgtctaactaactcaatagagtcaggatatgtcagaaatccctcagttttacctccaagccctggaaaattcatttacgatattggtttttacaccctcattaaccagttgatagattttttcaaagaagatatttccaaagaaattatcccaggaattcactactttaacccgaaatcttgtaaaaaaaatacacgatcaaatgaaaaaaatacgttacttgaaaaacaagtaccggctgacatttttgtctctattcctacattccaagatctaattaacaaactaaaagttaaagaaaaatcaaaaattaattcagagaaaccaaactttttctgcatttacaggtacaatgatggctgtactgacgctgtcaaaatggaagttcaagtttctgatttcttttcttag

SEQ ID NO: 3324 - DNA, 651 bp, Cryptosporidium hominis
atgcctgaatatattcagatagtgggagatgaagattcaagaagtaatacaaatgatacatgttttatatgccttgaagattcgtcccaaggaaagcttaagcgatgttgctctcaatgctatgcagttgtacacgggaaatgttggtcaaaatggagtagttcacaacagattgcaatcttgagaagtattttgcttggagaagagagaagagagctaaatctatgttcaatttgcagaagtggatctattaagattgaacattcagaggatgactctgaagatttttcaaaagctctgaatggaggtttaatttatagattttttagaattgtagcaaacagagtatatggtaatcagtatggttcttttatggtttcatcagtagataatcctttctcaaaccttagaaccttactaataaatggagtgtttctttcactattttttatatatattctatatcaagaagagcattcagatgccaagagtttgattacaatatctttatgggcatatattacattagtattacagtttctgacaataacaggagtatatagaagacaagcattagatgaactgggaatagatgaaccaagtctaactgatacatatgaatctgtgagaccaaacgatcaaatacgatag

SEQ ID NO: 3325 - DNA, 996 bp, Cryptosporidium hominis
atgtgggatcttttaagtggagtaaatgggacaaattctgtctctaataaactagaaaagaaaacaacagaaaaccaaggtacttcgtccccaaatcaaactagatgtgctacaagaaacactacttccgagtatccttcaaatgtagcgagcaacggggctatcattggggaacggcttgaagttgtatatccaaaaacagaaagggaaaaagttgtataccaagagtatatccagaagactcaagaagctttgaactcttttctaagcgtaattgaagattttaatgtcgctcaagaaagcgaatccaactttaaagcgcttggtagctgccagaaaactccgcaagttcatgtgaatctgggaaatatgggggatgcactctgtagtagatttgattcttcttcttccaaatcagaagacgcattatctacttacgttgggaaatgctcatttggaacatccttaacaccaaagcaaatctttgacttcatgatcaatgttgagaacaaacctttgtacgacagtacctgtgcagaatcatctattatttattatttaggacatttagcattggctaaacaatgctatagaggaatgatgggagttcaaggaagggaatttctcattatggggagaaactttaccctaagcgataattgttatgctttggttgcttcctctgtgtctgatactaaaagtcttactgaaactgaagaggaaatccctgtcactgagtcatatgtaaggggagaaatcaagtttgttgggttcttaattcgtcaatttaaaggtgaaactgaactcttttttgctcaaaagatggatcttggtggttccgtcccgttaatgttacaaaggattgtcctcgctacccaacttcaaagtttgaatgcattgaaaaaacacttgttggacaatattgacctctacttttcacaggatagagaggatgaaatctcagaaagctcatctacccgagaaggagataagtaa

SEQ ID NO: 3326 - DNA, 225 bp, Cryptosporidium hominis
atgattcaatcttattatacgaattatgggtctgaaatctcttcaagagacgtttccgattcatttcacgacctggataatagtgcttcttacgaaactcatcaacaagcaacaaatgttcatgaaaatcatgcgcacaaacactcaacacactctcattcaaaatatagaggtttgcatttaattagtaatcagtcagactctgactcatcagacccagagtag

SEQ ID NO: 3327 - DNA, 720 bp, Cryptosporidium hominis
atggaagagcccagagtcacttattcagaagaccgtagacaccaatccgagttgttagcagaggctcaaaatcaggcaatggagggagaactctctagaggcttctttgtatcaacagaggtggagaataaccaatcaagcgtctgcggaattagctgtggatcaaatgggcaaagacttacacatactatacgtgcgttcactaagccaatcccagtaactccgggtcaagtaaagctaaattctgctgatgaattgattggaaaaccaataattaagcagagattaaacgaaatgtacactaacaggaatctaaatacatctacaaccaataaatttatgtcttttggagtagcttctttgagatcaatgaattctaatgcgctttcgtcatatcgttcaacaggttcaggatctatgcctacgaatagaagctatacatatttaagccaagtaaatactaacaactttagcaccatgaatacaggtatttcccaatattcaagaggagtcacttcgaatacttcatcagtctttaatactttcacaacaattttgagtggcttgtgtagttgtccaggattcatctcggtatgcaataacaagaaaaaaatacatgcaatcgagcaagagcaaataccttcggattccgactttgctgaatctggctctgagagtgatgatgcaggcctagatgttgctcaggaagagcaaaactaa

SEQ ID NO: 3328 - DNA, 1026 bp, Cryptosporidium hominis
atgaagattaagatcagaacagttcagaatacagagatggaggtagaggtggaggcagattattctattgagaaagtgaagcaggcaattcaagaattgaacccagtaatggaggcttcgaggctaaagctaatttttgctggaagaatattgaatgattctcaaactgttcaggatgtcggaataaaagagggagagcgattggtagttcttttatctaagggtgcttcccagaaggcagcagagagtcaacagaataaacaaaacaatacgtcgaatgaatcaaacacaaatacagatccagcagcaagtgctacaacttcaaatatccaaactcaatcagggaattctgatccatcaatagattcaagagcctcagctttgttaacagggacagaacttgaggaaactattacaaatattgtaaatatgggtttcgaaagagaacaagttacaagagcaatgagagcagcatttaataatccagatagagctgttgagtaccttacttcaggattaccaattccagagaatccagtagcgcctaatcccactaatattacaccagtaaactcaaatgcttctttgaatgcaggtttaacaccatcagaagagttgtcatcagaacaactcccgggaaatttggaatcgcttagaactaacccattattccaacaactgaggtctgtagttcaacaagatccaagaatccttccagagctacttgtaagaattggtcagtcaaatcctgagatcctccaacttattacagaaaatcaagaagagtttatacgaatgatggagagaactgactctgatgaagttggagaaacttctcaatttccaatgcaaacaactattcagcttactccacaggaagccgagtccgttgaacgtctgcaggccctcggattcccaagaaatgctgtcattgaagcctatttaatttgtgaaaagaacgaggagcttgctgcaaattatcttctcgaaaacagtgccgatttctttactgatggtgcgaactga

SEQ ID NO: 3329 - DNA, 1764 bp, Cryptosporidium hominis
atggaaacttcccaagatggagactactgggatgtcattattattgggacagggttgatagaatgtattgttgcttcaggcctctcaatgagaggatattcggttttagttttagagtcaaatacctcatatggaggcttaaataatacacttaaactccccacagttcataattggatctcaaacaacccagaacattcagaatctctatttgaaacctcctctttctttgaaaaagagtgcgatcttcagttatactcatcactaactgaagcagaatctcaatctttaaagaatatatatgtggatatgatgcctaaagtactattttgtcgtggccatcttgtagaaatgattttatcgtgcaatatttctggctatctagaattccaaggaataaatgatatttattttgcagaaattaaagataatgagacatttagattaacaaaaacaccattttcaaaaaaagaggtattttcctcatccgatttgaatttggtagaaaagagacaagttatgaggctgtacagtggaattagagacattttggagatatccaaaattgagaaaaaggttgatttggatttggtttctgatccttttaggtccccagcattaattgtaaattgtcaaaatagttctaaaaagattaatgagaataataatgaccaaactagttgtagccgtagttttggtggtattagtagaaatgcatgcattcctgaagtaacttctttctcagactttcaagatttctggaaaatcaatgaccgagtgttaaatttagttaaacacaacgtagtttttagcaattcacaccaaaacaataattttgaatgggaaaagaactttacaaggtattttaaccttctgttaagttcattaaatcaacatggatgtgtaggaactccttttttgtatccaaattatggtacatgtgatttacctcaatcattttctagacttgcagcagttaaaggatctcttcaaagacttgggacaaccatttcaactattcaaaaacaagatgaaaaggaaaaactatgcaaagttcatattaactcaagtaattcaaaagaagttattaagtgtaagtcaatattggggtctttaacaaatctttcaaaatacttgaagaattctgtaaataatttagtagaaaacaaggttttgtgttatttcatgattctaaatcgtccattaatcaaaccagaaaactctcagaatactaaaaatctttgtctcacaagtatccaaattggagaaaaccaatttgagaataatatagcttatattctacaatgtgactatagtacaggatgttgccctcctggatattatattgtttacataaataaggtaatgggaaaagaagaaactattttccaggcaagaagtcaggtccaaaatggaattaactcactgttatctgcgaaaacaaatgatgagacaaaggttttatataaaggaagttatatttatatacaaagggttgagaatccacaacaacttgaagacggattaatacttttgtcagatccatctattaacaataatagcttcttacttctggatgaagatgtagataaagctttactagctcttgataaatcaatcaagtttctagattctcaacataaggattatgtgacatttaagaacttttcaaattctaaaaaagatcaaaaagaagaaaattcaaaaatccgagattcaaataatcaatattttatagagaagttacaaaacatcttagactaa

SEQ ID NO: 3330 - DNA, 741 bp, Cryptosporidium hominis
atggacctgacaatccctgagattactattagacgaaggattgtccttgagggatatctagacttttcgaatagtgtaacatcatgggacatatacaaaaatatgctaaggaaaagttcagagatgtttgtttattgtcatagtaagaaagcattaatttgcccaactcccagacgtagaggagtgaaggaggatgggtgtattattgcttataatagtggatatattttgagtattggagagaacgaagaaacttgtactgaatatatttcatggcttagaaagaagtttagacagcatgatccatcagttcctttggaaatcaaacaagtgaattccattttgagagttgaaatgccatccaaaattggattaataaatatatttaaattatataatactattattactagtaatcacgcttttgaaatactctttgatccagagctctatacagctatgataataagttttcaaccaaatggtatttattccaatgaagatacaacatcagctaataagtttcttagatttccagatgagcaagtagaagaggtaaaaaatgagataactcaatgttgttttgtagtctctgttaactatattctagtacacaaggttaaagatcatactcaagggctagaagctgtccaaatattaatgaaatatttgtataggaacgatttgattgttgctcctattgatacaaatgttccatattcacgagatattattaattaa

SEQ ID NO: 3331 - DNA, 459 bp, Cryptosporidium hominis
atgttggacaaattgacaggtgtatatgcacctcgtccatcaagtggtccacataaactaagagaatgtattccattagcaattttactccgtaacagattaaagtttgctttaacatatactgaagcaaagtatattgtaatgcaacgtcttatcaaggttgatggtaaggtcagaactgatatctgcttcccattaggtttgatggatgttgtaagcattgaccgtgttggaaagaatatacgtataatgtatgatacaaagggtagatttgtaccagtccaaattgattctaaggaggcaggattcaagctatgcaaagtaactaaggttgctcttggagcaaagggtattccaactgccacaacaaatgatgcccgtactttgagatacatccacccagatgtcaaggcaaatgatactgttaaagttgacttggccacaggaaaggtaagttga

SEQ ID NO: 3332 - DNA, 249 bp, Cryptosporidium hominis
atgtgtatggtcactggtggcagatcccaaggccgtgttggtaccattactcactttgagagaaagatgggtgctcagtgtatcgtcactattcgtgaccaaaaaggtgctacctttgcaactttaatgaagaatatcttcgttattggagaggagggcaaacccttggtcactcttccaaaggataaaggtattagattatcaaatgtggaggacagaaacttaagaatgaagaagcacaggaactaa

SEQ ID NO: 3333 - DNA, 390 bp, Cryptosporidium hominis
atgaatgattatgatgagtcaggaggaaattatgatgaggaagaggagtatatggaagaggaattaatagaagaagagatagaaggagatgagaatatagaaatattaacagaagatgcagtacatagtagatatgatgggaaaccaaatgaaggtcctcgtattacaactccttatatgacaaagtttgaaaaggcaagaattattggaacaagagcactacaaattagtatgaatgctccggttgcaataccattagatggagaaactgatcctttattaatagcagagaaagagctttatactaagaaaattccttttgttattagaagatatctcccaaatgggaattatgaggactggaagattgatgaattaattttagattaa

SEQ ID NO: 3334 - DNA, 486 bp, Cryptosporidium hominis
atgattgaatatttagagcataatatttcaggaaaagactttttacagcccgagtttcaacaagtccttgtggaatctgggaactttccaatgctcccatatttttcagactcaaacaatgaagtcgagttaacaggatcattcacaatattaaggtacctcgcagataagtgtaagttgatgggtaaaagtcctgaggaaagaaataagatagaaaattggctggaatatcttcaatctttactacattcagtatgggatttcgaaaatatgtcagataattatacaggaattcaacaggcaaagaaaaagagccagtttctattagaaactcttcatccaatgcttaaatgtatagatgaaaagattgaacaaggagtctgggctctagaatcctattcagtagtggacattgtcctatattcagcaataagcgtgataattagatcttggggaagtgatctattgaaaccttatattaggtaa

SEQ ID NO: 3335 - DNA, 2055 bp, Cryptosporidium hominis
atgtataaagaaaatgaaagaatacaggaagagcaagagccctctgttatatttcggaggtttttggaggatttagcaaggaatagccacttgggaggagagagtatagtaagccattcaaagaatgtattgaggatattttcaaaagagcttcctgaaaagctttaccattcaaaaagatattcatcccagtcaacagctggttcaatttcaggtaatttctctccatctcagaatgcaacgtccaatcagagcccaaatgaggcttggtcaaagggctcagaaggtagtagggaggcagaaatagaagtcgaagaaagtagccaaggaaaaagagaacgcaatgacaatatttaccagaaatccttcatgagtagatgctttagcgatggtctaatgtttgctcgttcaaacctgagtcagaatagtaacttttattcgggagaaattttggatttggaattggagttagaagtagaaagacaagacaaaacaactacccaaagagaagtatacgaatggaatgttaataaagatatttatgactattcaaaaagtacctctgcatcttcatctgcatcctctaccataaactctccctcttctaatactccaacttcaggacggcccgccatatacagagttatgacaagtactactgttgcattcccaccttataatgacgatggtatggaaaggctaaatatggctctgaaagaagacagacttaggaggatttcaacacactctaatagagcttggccttcgaatgttactaactaccttaaaggaattgacatttttcttagaattccagaatatattcgaccaaaaaaagatggagcagtcttgaatttatctattgggagctgctctcacccccatccttcaaaagttcactatggaggagaggatgcacacttttatgaggaaaatgtaatcggaattgccgatggagtaggagaatgggccaactttggagttaacccaaaattattcgcttctgaactcatttctggaatgagagaagcttaccttaatacaaaatgcatgcaaccccattccccgcctaatgacgtggcaattttaaagaaaaatgtggtgcatgcaaacattaagtcagatgcgacaaagaaaatgacaatggaaagtatggaggtctcggaatttcgtggatttacgcatcgttctaaaggagcaaaattaaagtttgatataggttacaacatggaagaaaggactgggccacagaatgagttggataaagacgataaagaggaaatgtttaacttaggaaaacaattcaatagcgactctcaggctctttcttactctcagtttttgttgatggagggatataagaatacgcagtcttttggctcatctacagcttttgttgcatgttttgacccaaagaccaacaaacttcagatttcatacttgggagactctggaataattatattaagaagaactcctgaaacttttaggatgggtattgtttatagaagtccagctcagcaacattcttttaattgtccatttcagttatcaaggcttccaactcctgaagattttccaatgttacaagaaaagggattgacttgttttattaatctcgttaaaaatagcgaggatgttcctcaggatttaccatctcattcaataaccaaagagattactctttcccaaagtgacttaattgtagttgctaccgatggtttatttgataatttgtttgattatgaaatttgtagcatatgtagcggagcaatctccccatatgaggcaattaggttactaaaagaccccaaattatattcaagccctcataacatatccaaggccctagcaaatgcagcatacatcaaatctttggatccaaaggcaaagaccccttttaacagacattgtaacgtcagcgatgaactttggcagtttagtactggaggaaagcttgatgacattacagttgttgttgcatgggttgtaagtgagcgagatcaaatcattttaaatagtagacctgatcaattcaagtactcgagagattaa

SEQ ID NO: 3336 - DNA, 1806 bp, Cryptosporidium hominis
atgaaaagagtaaggccgtgcttgaggataatggtcacactgatcaagtcttttattgggactggaattatctttttgccaggaacgtttagagtttcaggtattatcagtggaaatatattatcaattttggtttgtttgttggctatcatttcaatcagatttttggtgaagtgttgtcaaggcaaagagactttaggagagttagcagagagagtttggggaagatctggattaattttggttgatacttcgatattcctttctcagctaggcttttctacagtttatatgatttttgtatctcataatattcaagaaataatatattccatttcaagttgccagttagaaattccaatacttaagctgatttgtttccagatagtaatttacttaccctttatctttttgagagatattgaaaatctgggatttctcagtgtattagcaaatatttcagtgttttcagtacttggagtaataatctattatggttatcaaaatctggaaagatatccaattggtagaccagaaatatcaaagcttggtagcatatatggagcagggttagtacttggaacaagtgcatttaattatgaaggaatagcgttgatacttccaataaggaattcaactccggagtatttactccaagcttttccagcaatattaacctttacaatgatattgattggggtaatctcaaacttctttgcaagctttgtttactattcatttggtgatgatactacctctccagtaactgagaatatattaaatccaaaagccaaaataatttctctaataatatactcatctgcaataatgttttccatcccattacagcttttcccatctatggggattatagaaaaatatatattacagataaaacttccctttataggaagaaagagtatggagaatctggagaagatcgagacaaatcctgtttcaaaagttgataaagagaaagtaaccaaaaaagagattaagaaagaactttttatgatcacagatgaccagcataaaggtgagctttcaagaaagaatatccggataaatcccacgagtacaaacattttaagggcttctcagctgaatttttcttcttcctctttgaagaattcagagaatatatcatcgttccagaacaatctgttttctacttcaaagattattcagcttgcgtcaatatctgaaagctgggattcctccattgggaacaaagtggtttactctcctgtggaaaattcaacttccagtttgaaattggaaaatatgaaggctaataaagagaataaatcagagaaaggagcagttattgagaatttggagactgatatttgtagtagtattggcggtgataagagtaataaaagtattccaagaatagtaaagaaagaaagcttggaaaggctagaagaaatagaagacgatggggcccagatcgttgacttgagccaagacagactcatagattccagatcaaagttccaccactcagctctgagggctttaatttcttattctctggttttattatgtgggattttagcctataactttgaagatgagttaggaagctttgtaacaattactggaggactattatgtgttcctttagcatttgtttatccacctttattctatttcagtcttaatagggagaaaatttcaaaagctggacaactctttattggatttatggtttttattggcagcgtaatctcctttacctccgttactatggcaattttaagttgggaaaccaatcctagaaatctagtatgcataatataa

SEQ ID NO: 3337 - DNA, 2316 bp, Cryptosporidium hominis
atgtggacaagtgcgcatgcaaatttgcaagtattgcatgccaataaagacggtatgtgcaaatatggtccccacgcatgcaattacaggatagtaaaagaagtagtttttgaaaatatattttttaaaaacaagaaatattctcatcttgagagtttcaaaataaaaaaggaagaaatgttgaaattcaagggtgtatttaaaggcctaagcttcatattattggcaggaaatgctttgagccaaacaactcaacaagcaccaacttcgcagcttcttcaggagcttgctcagtatagacaacaatttaggagaacagtagatggaagactctgttctgcagtatttgtacaggatttccagacatatacagattgtacaatagcaaagtctccagatgggacttctggaagagagtggtgttatgttgagccacaggtagcatcccaaggttcaaagaactggaattactgcttacctgttgtgaactatgatatgctccgtacaaaggcaaatgagatttttgaagtcaaggcaagagaatcagctaagattgcaaatcaattagataaccaagcttcaagattaacagacttgcttgagagatacaatagtacttgtggttctcagcaatcaatagtaagcagtagattggacaatattgagtcattaattcagaaaggtcagcattgcctgaataagattgaagaatcaattacaaaggttgatgttttgaaaacaagcattgatgaattagaaaaagatatcgtaagagatcgtgactttgctttgagcagaccagagaactgtgagttattaccaggatatgaagatattcctttcccagatggtttaagagggtcatattatgacaatccaaagtttgatggtgctccaagaaattatagaaatgatagaaatattaatatgatgtatatttcaaaggacccgattgagggtgtttcaaatcagcaattttccatcagatgggacggatttttacttgctcctgagtctggaagatactacttcagcattgaagctgattgtggagcaagattattcttgggtggaagagcaatcattgtcgacagaatgccacaaccttcctctggggatgcttcctctgagagagctgttccattattattggatgcaagacatgatggcccagttaaagttacttcagtggctcaagaattagttggtgggcaaaagtatagaattagagttgagatgttccatagcagtcatctcagatataaaaatccagatattgcttcaattaaattaatgtggaagacttcaaatattcaagaacaggttatcccaagttcatacttctatactggaaatccaagacagccattgaaactttcaggtgttaacccagtattttatgagatctctactttaagaaatggagaatttgctcacaaggatagtaatacccatttcattgctgacttaccatctggatttgaaggcttaaagatgctcaagtcatcatcttccccagaattacacaatatgaaggttagtgttaaccagccatgcacaatgttcattgctgctgatgttactgataaattaccagttactgccgaaaatctccaattcactaacactgactccgtattctcaatctataagactgacaaaactgattccagcaaggctgttgaaactcaaacaatgaaggttgcacaagtaactatcccaagagcaactgatatatctctcaaggttaatgaatcaaaacctttcattctcttcttcaagcaacatccaactgaagcatccttaactactacacaatgttcagaaagaaagctcctcagtactgatgcttttgttgaatctgtaaagtcttcatcttctcaaagtcctgaatatgatgggatctatgcattaaagggaaagaatcgcgatgagccttttggagcttggaaaacttctgtaggaaatactatcggtgagaacattatcatcaaattcaagcagcctgttgaagttactgacttccaatatattccattggataatccatcaatgtggccagcttcattgaccatgtatattaaacaacaagttgatgaaatgcatgagactaacgtccaagagaagtttactcttgcccacactgccagtctaaatgctcataaatatatgttacagtacccattaactgcaaaggaggtcaagattgaggtttctcaaatgtttgttgatagcactcaaactggaggttcctttatgatttacggaaagagttgtacaaaagataccactagtactacaacttctacagagtaa

SEQ ID NO: 3338 - DNA, 1185 bp, Cryptosporidium hominis
atgtgggttattttcagattaatatggctattttctcaattttaccttacttttgcttcaaatgcaaaaactaccaggttatttggacttactccggaagaacaatgcaagaactttggctgtaaaacggccaataacccaaattattatacatcatgcggtcaatcagtattttgtagtcagtgcttattgaactcatttaaaccattgtcacatatttgtggtggatggaatttaggaaaatttgaaaggatttcactggctaatggttcaatatattcaaattcaaggataagtgggaataccttcgaggatttaagtgcagactggggagaaaatgaacccatagatttaagtaaatgccagttggagaattttaactataattctgcctactcagcattttcaaccggtagttatacttcactttattccactgtcacttttaacattgcggtcttgatcaataaaccaaaaggtaagacaattcctccaattgaatttcagattgatttagatgaaactttggaggagattaatatgcgtggtatgaatgtcagggtatcaagaggaaattctctttgtccgattacccataatttgaatccattaaagttaaaacacaagaagacgaaagaaaccatgacaatgatttccagatcattttctttaccacttgataggtctggggtttatagaccatatgaatttaaagttaaagctaaatgcaaagaaaaaaaatcatgtgatatgagattttataaattttgcctccgtttatcgtgttcaaggatgcttgaatcacagttagcacaatataaaattgttcaaggacttttgaaagattatcctggaaatacggcacagcaggagtatgaagatgaggaggaatttgaggaatttgatcatgggagggtatcaaaaaacgcacaatcatctaacaaagaagatgaagataaggacgaggtagagaagaattacaaatatacggaaaaggtacagattagcaggaaggtaccaagagaggttagtagagagttacagctaggaagacaaatcgttttcagtggaaaacctccaaacagtctgcaatcgttcttgtctggtaatacattttatttggttttagggtttggggctttgcttattttggccgttctatgctttttgttaataaaaaaataa

SEQ ID NO: 3339 - DNA, 2865 bp, Cryptosporidium hominis
atggaaaacctagacccaactgatgataagaatcatgtcaatgccgggaagggtcgaagaggaacaagattttctataatatggaggaagcctgaagaagataaggaaagaacaaatgaaaaaagagaacaccatcgattctcgatctggaatcaaaagccattaggcgaaaaaaaaataataaacacaaaagcttcaaatattgatggaaagaataacgtggataaaattggcgttttcttgggtagaaatgaagatgaacaaagtatatgtacgaatcaattagaagatgaaaaaagtcaaagaaatatattccaaaaactaggaagtgacttattctttaaaaggcccagcaaagtttttgaagagaagaaggaagaagaagaagaggaagatgaatctgagacttggatatatacagtgtttaggtttttcttcccagattccgccccattatcctggctcttttttttagcatgttcttctattgcagcatatgtcaattatctaatagataacaatttttctgttagctctgctaaatgtgcaacagttatctattttatggacgttgcaacgtatttgttcatgatgattgtcaggctgatcattttcaggctcattttgccatggttatgtccagagggaagaatatttgctgctctttctgggacagcagatcctgaacttatttactgtttatgggcaggtcagatcagtttactttggaaattgcagttaacattgaacaaagaagaaaatggatatactcttcctcttttaaatgatgattctgtaattccacttttctcaggatccataattttgaagtcaagattaatggttttaatttttgctattagaagacttattcttgcattcataatgttcttctttatgcttgactttattggatccatgtcaaaactattggtgggattccttctcaaatatcgattcttaaggttaattaactgcaattggactaaactgcgccctcatattgttgaaggccttaggatgactccaaaccagaatagcaattttttgttaagtaaattctcttcaaagaatcgttctaaagagaaaccaatgaataagggagactccattactttaccttattttttgacagaagagggaatttctcaaataaagaagaagaaataccaaaattggttggcagttcaatttgttaaacaatactcagctctattttatttagatgatcagtttgtggaggttaaaaataagaaagatgccagaaagtatgcaaaattgttatttaatgatatgatagaacatacaaatgaaattttactattcatgggaaagtggaaatataggcaaaaggataaaaattacgcaaactcagaatttggtgaggaagcagaatgcatgcatgcattcgaagccaatgaggttagaagcgcctcaggggaacatatttttaaagctttaacttcgataaatattccattatcttctcaaaattcttcctgttcagtttcatcttctagtgaaaatgaaagagaatttacctcaaatactgaaatgccaaaaagtaatcatgacgatgaatctgcatgggatacttccataaaaatcagtaatccaacaatatacgagtccaagatcaaccagccagactttaaaagcaaagataagaaaaaagaggggaagaatgaggaagagaaaactgaggagaagaaaataagtattcttcgtgcagaagaatttaagacagttccaattcaagaagatgaaaagcctattcaaccatcagtgtttactggagggaaacaaaactctgatttaagaaaaggaaagagatacaactcatttttcccaacaactccatatggagtctttaattacaatgacttttgtttatttgaggaagaaaatgataagcctttggcactgaatttagatgtattaaaggtattgtatggagaaaatgtagaagcatttctaaagaagatagacccaattggaagaaaggagtacaatgaggatgattgggttagattattagtaactacatatgaaacgaggaaaaaaatgattaatactttagaatctcaggagggaattgcaaaggtatttaaacgtatggtttcaatagtactttggttcttttcatctttattcattctaataataattggaattaatgtaaatactctggttatttcaggtgcagcagtagtttcctcaatctcagttgctttaaataggctctatagcaactttataagttctgttatttttgtggtttttgaaaatccttacaaccaaggtgataggattcgaattaatagtggtccaatcatgacagttagaaagatcaaaacgttttgtactatcttttcaacactggaatcagtaccaatcatgtaccctaattattggttaattgatcaaagtatttcaaatgaaagtagagcactacaaagtagtcatatcctaactttctatatgtcagacttaacaagtccttttgtttttgatgcattaactaaatcaataaaacaatacgcaaatgacagaccaagagattttattccaaactcagtatatgtatatattcactcaattcaaccgggacacttcattgaaacaagagtctctttttctaatgttaacccttcatttgaatgggaaaaattactagagattaggactcccttctatctattcattcttcatacattaagacagcatggagttgaatatttcctcccagagagtcgagttctctatagtacatggtccgagaggggaaaaagaagatcgaaccaagcctttaaagatcctagatctttaattcctaacaatttggcaaataccaaaaagtcttaa

SEQ ID NO: 3340 - DNA, 300 bp, Cryptosporidium hominis
atgattatatacagaaatggtacaagtatttctcaaatcacaggtggttcaagctttaaagataagaacaggaagattactatcaagtcaattttaaagttgtttgttcaaaacaatgttattaagaatagtgaaatcaccgagcattctagacttgagaaaggctcagaatattccaataattactcaagtagtgataattctgattctgatgatgataatagagacaatggtaaatgctatagttccacagtttttgataaaatgcaggatagaattaaatacttacaaaaaatctaa

SEQ ID NO: 3341 - DNA, 372 bp, Cryptosporidium hominis
atgttattaagaatagtgaaatcaccgagcattctagacttgagaaaggctcagaatattccaataattactcaagtagtgataattctgattctgatgatgataatagagacaatggtaaatgctatagttccacagtttttgataaaatgcaggatagaattaaatacttacaaaaaatctaaaaagatttccaatctcaaggcttgttttgcagtaatcctttctgttgagctgggatttaatgaagatattattagttcaaagaaagctttgtcttctttattgataagttttgccaagtcccaatttgttttaaatataggaagaactagtccagattctgaaattgaaggtaaactctttaaataa

SEQ ID NO: 3342 - DNA, 330 bp, Cryptosporidium hominis
atgtggtcctttggatgtatagctttggagcttctaactggaaaggcgttttttaatgggaagaatgagattgaccaactatttggtatttttagattagttggaactccattaggaacaagcttggattatttaaagagtttaccttcaatttcagaatctggactagttcttcctatatttaaaacaaattgggacttggcaaaacttatcaataaagaagacaaagctttctttgaactaataatatcttcattaaatcccagctcaacagaaaggattactgcaaaacaagccttgagattggaaatctttttagattttttgtaa

SEQ ID NO: 3343 - DNA, 1161 bp, Cryptosporidium hominis
atgtttcagggtcaaaaaatgatcattatttcatcattacatcttcttgaaaaagcagtggaaggaatattgagatggtttgatatagaaagcgagattggagcaaatgattctgtgattaaattctctaaagccatttttagtcctgaaaatggggaaaacaagacaaatttattggttaagttcttaggattaattacaattgtcgaaacaaataccaaattatctcaaaatcttaatgttattgtaagaaaatcagtcaataatgcttttgaatctgaagaagattcaaaaaaaactggtgattttgtaataaatcaaatggaatctttggattggtggtggtggttgaacattaaagacaattttgagggtcttttaactcaaaatatgtcttgggttaatcaaatacaattatccatagatttatgctcggaaaatagttttaaatcaatgaaagagagaattgtgggaaatattgacatttttcagactcttaatggattgaaaaataaactaaaagttaagaaaaagatggaattgctttactctacaaagatttgtgaactttatctaaaaattgatcctgattttcagagatggaatttgaattacgaggaaataatggatggagaattggatgagacacacaagaatttgcctttattaaaaattaaaactgtaatagatattttgggagaccttttaaaaaagatccaaaaagttattgatgatcctgaaaagaaaaagtatcttataaacgaatgttttactctgattgatttgatcattagttatttgaaacaggcaatccaaattattaataaaataatatcagaattgaaaaagaaccaagaagaaatgaagctttcttttggattattagaaaagacttactctgaaacttttaagttaattttggaacttattagaattaatcttgaatttggaatatatgggataaaccaatctaattatgatttaccagattttaaaaatcatcaaaaaactgtctcagaatggagtagatatattgttaaatgtattttggaaggaagttcaatgagaaaagaagaccatagtcattcatttcaaatttatagacaaatggatatttatgagatggtttcaatattaataaatggttcaataaccagtctt

SEQ ID NO: 3344 - DNA, 249 bp, Cryptosporidium hominis
atgggagaagtgaaagaaggaaagaaatccaacccattcaaaaattctcttaagaaggcaaaaattctggaggagaagaggaaagaagaagcaatagaaagagaaaagttgaaacgagagaaaaaaatgaaagttaaagaaagatatgataaaaagagggctttgctaaaaaaaacaaaaaaaggtcagccagttttatcgagaagaatcaattttatgctcgcaaaattgcaaaaagccggtaattag

SEQ ID NO: 3345 - DNA, 852 bp, Cryptosporidium hominis
atggattctgaagttgaaaccaaagttgatgaagaaaccaattctcaaactgataataaaatgaccacagaatttgattatgatgaaagtaaaacatccaagtcagatatgtctaaacaaactggtacatccaaagataccaatacaacttcacaaacttataattccagtagtgaatctgatatttatgaaaatgaatcaacagcttctactcaagattttgaaacttatcaaagtatggataagactactactggtactactactagtactgataagagttatgatcagacatctaatgttgaaccaactgttcaagggactaccatgccaaaacagactagtaaagttatgagagctgatcagaccaattcttataagactgttactcctatgggaacttctgatgatttggagactgaagattatactgttggcaaaaatacatatacaaaatcagatgatggttatcagaaggatgttactaaatatcaatcaacttctacaccaacagaaacttccacaactaagcatactacatttgatggagaaggattcttaaaggctgtatctaagttggtcaatattagaaagagagttaatacaggaaatgattcagttgctacaactaaagattatcaaaagagtgttactatggatactactgattctacaaaaaagccaactgataatcaaggcgatcatgataatgatgatgaagatgatcaagaatcattctttgataagtatggaattccagaatatgtattttggattattgtatatacagttccagtattgtttgtcctcttactttgcctcacttcttattgttgttgctgcagaagataa

SEQ ID NO: 3346 - DNA, 444 bp, Cryptosporidium hominis
aatgacgtgtcaaatcttaaatacggtactcgtaaccttaaaactcctttcaaagtgaaagtaaccaaagatataaagaacattcaagatgataatctttttgttgagaatactagagaagagaaggatctagatgaaaaagttggaaatgaaaaggttgaaaaagaagaaataccagaatcttatgaggatatcccaagaaataaacaagaagaggatgttaaaaagctggaaaagaatattaagaagagaaatgtattaaaaaacggagagaaagaacttaatgaaggaaaaaataattcaaaagatactcaacttgtaagaaagaaaactaacttgagagagaagaaggagtgtaagaagctttataaaagtataaataatgatcgtttttacatagacactcgtccaataatctcaaatgatgtatacttagttaagcaa

SEQ ID NO: 3347 - DNA, 1185 bp, Cryptosporidium hominis
atgacagaaagagcgagattaggtgattctgcgaagaatgagtttgaaataatttcaagattataccagttacaaagtatactactggtgacatctagtaatggctttaaaaatgaagataaaggcggtgaggcttataattattacgaggtggagttcaatgaaaatggttggaggactaagctaattaattcttatatgaatttaaatgaaaaagataaaggtatacgaaatattggaaatacttgctatttaaattcaacaattcaatgcttggcgttgagttactattttattgaatggcttcatgaatatatgagaaacgaattctctaaaccaaataaattaattttgtatcttttcgaatttttaacttgtatattagagccaatcaaacaagatggaaaatataacatagttgcaaggatttgcagtaacaataatgctaagtctgtagatttaagatttgttaaagaaatatccaataaattcagttttgggaaacaacatgatgcttctgagtttttaagatatttattaacaaatattgatgataattgctcacctttcacaatgttaacagaagattatgttaaatgtttatcttgcggagtgattgagtcaaagaaaaatcattcattatctattattgatttatatgtttttaacaactctttatctcattcagataacagagaaaatcttaacttaagtaatgattatataataactctggattctctgattaaaaatcacttcttatctgaaaatattccagattctcttgactgtgaccattgtcaacagaaaagtgcctccgaaagatggaattcaatagttaatccctccaagtatgttattttggcattacataactacttttgggaccaaaaatcaaataaaggcataaaacaaaacgagataaaaataacctttaatgaactatttatgcttaataaccacaaatacattatttacgcactcatctttcacaaaggaaagaccaccaattcgggacattattatactataggaagaaaacatttctacgataattccagagaaaaaaacccaagttggtttaaatacgatgataatattatctcatatattgaatcattctaccaaattcagaaatctagtgaaaatcctttcctaatttttgccttacttgcagataaataa

SEQ ID NO: 3348 - DNA, 936 bp, Cryptosporidium hominis
atgacagggtttggaattaatgacgctattttaggattggcatttatgtattcaagtgcagatttaatatctcaatgggatagtttttctacatgttgtcatccaatacaactttggttaattataagttatatcacaattattgctttcagagtgattcactatgtttcaaattatctttcagaaggaagtgatgatgtattaccatatagcagtacctcaggaattccattctggttaaatttatcagtagtttgtttaattttcccattcttcctttcttggacagttgttggaactgtttggttaaagaatattgaatccaaaactccacaatgtttagctggaaatggctcaagccacccttggtttttgatcttttggcttgtactttgctatatttggatcgttgcttatactgcttttattagtatctctatattcttcgagtttagagttagaagagctgaagaagatctcttattattagagaatgatgaagttatgagacgttggggaagactcagattacttgcagattatggtatccactttattagacatggtcttaccccagtcgaagttgctgctttacctctaagcaaagttaaagttgaagagtttaatgatccttgttctatttgtatagaagactttaagttaaatgaagaaattcgaaccttaccagcatgtggacattcttttcataaaggatgcattgatgcctggttactccgtaatgctatttgtcctaattgcaagactttagtgagatatggaaaaactgaaactggtacttcaccttgtagaggaaatagtcatattccagatcatcaaaattcgtcatatagatcaaattctcgagactcagtatctacaatggatactagaagagaggctggaagagagagaagttatgacagtttgatggtataa

SEQ ID NO: 3349 - DNA, 360 bp, Cryptosporidium hominis
atgggagaaagttatagactagaatatgaaaacagcaatagagatgagtttcctcgtctgggtcaaggataccttcagatacctacaattcgaataattccaccagaattaaatttagaagaaagaaggataccgactttcatggtaatagtcagagagaaactcataatattaaagagatggatatattatttattttatagcacactttcttggttttcaagtagtttttcaggagaaagaaatggagaccagatttatagatcgtttgtctatggacaactaattagtgtaatatcagcagcaatttggtggggtttttttggaacagaatcacatttattatggagtcagagttag

SEQ ID NO: 3350 - DNA, 537 bp, Cryptosporidium hominis
atgtatggaagtatcggaatatcaatatttctatttttgtttgtgctcagattttatttttgggtcagaggaagattttcttttaatgttgggagcaatgaaaagctagaaagaaaatcgaattgtggcgagaaagttaagatattagtagttttgggttcaggaggtcatacagcagaactattaatgttattaaaggatatggatttgagaaataaagtttccttaagctgcgtagtggcaaacactgataagtttagtttggggaaggcaataaatgaattttctgagaatttgaaggtggacaaagacaatgtaaggaactatgtggagttttacagcataaaaagaagtagagaagttggacagagctatttttcatcagtattcacgacactggcatcttttatggattcaatgaggatattatttcaagataggtatgatttaattatggtaaatggccctggtacatgcattcctatatgctttgggtctttgatattggaggtaagtaattctattgagaggggttaa

SEQ ID NO: 3351 - DNA, 1332 bp, Cryptosporidium hominis
atgtcagaagaaattttggatattggggagattgcaaggagatcaagagaatcaggaatacaattatcttccagtacagttgaggagaggaatgcaattctagaacactttgcagaagaaatatatctgaatagaaatgagattctagaagcaaatatgaaagatatggataattctaataagaataacatttctgagccaatgaaaatgagattattattggatgaatcgaagcttaaggcatgcataagctctgttagggatgtaatgaatttggaagaccctttaggaaagtatacattatctagggaaatcacaagtaatggactaaaactatatagaagaacttgtccaataggagtaattttagttatttttgaagcaagaccagaagtagctatccaaattagttcgctaactataaaaagtgggaatgcagtcatattaaaaggtggaaaagaagcaataaatactaacaaagcaattttgaattgcatagaaaatgcaattaatcaagtaaaaaaaaactatattaatataaatagagaaatagtacaaatggttttttctcatgaagatgtaaataaacttctttcctttaaccaatttatcgaccttgtcatacctagagggtctggcgaacttgtccacatgataaaaaaaaatacgtgtataccggtattgggtcatgcagatggtgtgtgcatgttatatgtgcatgtggatgcaaacatatcagagggagttgaaattgtaatagatgggaaattggattatccagctgcatgcaattcactggagactttgttaattcataaagataagttatccgagtttttaccagcattattgttgagattgaaggaacaaggaaagcacataaagttttattctgacaaggagtgtttaaaatacttggaaggtgagaatgatgtttgcgagttgattgaggatttgtaccatcatgagtttagttcaaatgaaatgtgtgtaaagtcagtttcaagtatggatgaggctattgcacatattaaccaatatggttctcaccatacagatgtaattttgactcaagatgaaaaattagcagcatcattcatgaatagagttgactctgcatgcgtatttcacaattgctcttcaaggttttcagatggatataggtttgggtttggtgctgaaattggaattagtacaacaaggattcatgctcgtggcccagtaggtctggaaggtttgttgacatacaaatacacgttaagaggtcaaggacagacaataactcagttcagaaacggcaagtttactttcacaaagagagatattgtttag

SEQ ID NO: 3352 - DNA, 1092 bp, Cryptosporidium hominis
atgaagtccctctttgaaaaatatagtttagatattattggtgtaggagttttaaatcaagttccaaacgacagtcactatgggctcgatataggaggaactttaattaagttggtttatacattaagcttggagaatgatgagctttttgaatatgaacttgaaaatatgagaaagaacttctacgatattgaggcactgagaagtaataggaagtatgtgatattttgtctgatagctccagtgaacaaagaaatagaattacagattggagacatttttggattccttaaggaaagaggactatacaaacccaatagtgttccaatgactggcggaggatcagtaaagttcaaaactatacttgagtcaaaatacaaaattaaagttgtccgatttgacgaaatgaaaagcattgtaaatggatgttttgagctctttggtaacttgtcgacaggcaaccttcaacagccgcatttttatagtatattaaaaggagaaacatttcttgttagaatggactctcacaccagaatatttccaagtttagtaatttcagttggatcaggtgtctcaataatcagagttgagaaccaaaatcaattcgaaagagtttctgggactaggtttggtggaggtactgtatttgggatttcaaaattactgggagttgagaattacggtgacttattaaagctatattcaagctatgaacggaagaacggacaaaatttgggtgaatcaacacatttgagtggttgcttctttaaagagtttgtcaaggagtcctctattacctcttcatctttgcctcaatatctcggagaagctgagcaaaaggagaaatttgtccacaatattgtaaatatgatgtatagtgatttgtcataccttatatgtttgatatcatcaaactataaatatgaaaacatagttttttgtggaaattacgtctctaatcaccacaagatcataatcaagtccattaaaaaatactcctacatgctgaatgataaagttaatgtctttttccattatttggatggattttttggagcaattggggcctacttaagccacaaatgtaattga

SEQ ID NO: 3353 - DNA, 2058 bp, Cryptosporidium hominis
atgagtaatattggaaggcagagcccgtcagcctcgaatttcagagaaaaaggagggacttcagtagtttcgagtaggaattcgaataaaagtcaaacagtgagtagtaatactcctggacctgctcttacaaaagttgattatacatgtccattgtgtatggaagagatggacgaaacagataagaagttttacccttgtaaatgccgctatcaaatatgcttatggtgtttctaccatgtcagagatcaattggacaataaatgcccagcatgtagacaacaatacgaaaatagtcttacaaatagaccctgtgatcgtgaaattgaaccaataagtaaagatgaaggctttaattggtgtggaaatactgtttctagaattacaaacaatgaatcaaataagttacagaacgataatcatgacactattgatcatcttggtaaatcggatgatatttctaatttggaagacatgagaattattcagagaaatttagtatatgttgtaggtctaagttattctattgctaagagagagatactatcttgtgagaactcttttggtaagtatggtaagatattaaatatgaggattttacctaataataacgatacatgcagtgcatttattacatattatgatgaattgtcagctactaaagctattaaaaatattaatggaaaaaagatgtttggacaaaatattattagatgctcttttggaacaaacaaatactgtaatagctttatcagaaattctgtatgtaataatccaaactgtgcttatgttcatgaaattgttgatcctaatgattgtattagtaaatctgaacttattaactttcactcatctaataaatttgccttaaagcctttaagagaacttaaacaaaatgccaagaacggacatgaaatatataacaaggatagaagggcaattaaaagcaaaggcagaagaccatattccaatactaacaaccaaaattataactctacagataagaacgaagacgaaatcagggaattaaatgagcaagaagtcaataataagcaaaatgatagtcaagagcccattgaagcattatccaatgatcaaaatacatccaccagtcaagaaactcttgaagaatgtaaaatttctcaaaataaccatgaaactcaatcaatccatgaacaagaacaagttcattcagttaatgaagaaccaacttatgaatataaaagggaaaatataataggagaggataaccgaatagataacaggaaaattaagggaatagaagaggatgagaaaattcaaaccaactctaacactaaaggcggaattcaaattgacactaatattgaaagctttagttctatcaactttggaagtaacaatctccaaaaggcgggaaatggctgcccaattggaatgcatgaaaatcttcaaaacattacccaaactattccaaacagtatttactactacccaacccctaatattaaccaagaaaaagaggaaaaacctatgaacttggaattccatagaaacaataattcgcatatgcatgaaatacatatgcaaaagttcccacatccttctattatttcaaaccaccaacttgatagttatattcagttcaatcaggcacaaattcaaaaccaattatatgcaataaatggcgccattccccaaaagcttgtagaatacaatgataatattaacccagaaaatgacttatttgagcttgaaattaaaaataatattgaaaaaatgattgaggagacttgtgaaggccctattcatatgcaagatagacaaaatcctcttataagtttaaactcactggagaatggccagcactttcactctttcttctctaatcaattgggccaaaattgtgcatccaataatagaaaaactttctcggatgttcaagctggaattattcaaggcatccagaatagagatattacagaacaaatcaacgtgggtaactcttctcttgaaagtggcatcaatattcttcgtgctatgatgcctcatgcaaatattacaattcagggtcaatag

SEQ ID NO: 3354 - DNA, 1404 bp, Cryptosporidium hominis
atgatactgcttgaaaaagatgtccaatgtttgttttttgaatttttatcaggtaaaattaatattacaatgaatgatgaaaattcaaaattgggaaattataatataaaattaacaaatgatatgaaaagagaatcatcaattgttttaaaacaacccgaaaatgaagatattctggagaagctgaaggagatatttcaagggaaagagaataattgtattagctatgatgaatgggaaatattgatagtagaaggattattaggaatgaataaactttgttctggaactttatataagatcatgaacaatgaaaaagactttgaagaattagtttcaaaaaatgatttgaataacaaatgttctattcaaatagagtataataaagtaaaggatctgttttgtaagaaaataaatatggttcaaaatgatggtggattaaattactttaaattgttatcaaagttatcaagatcaaaggattatatatatccttttggatttaagcctatattgaatgaaatagtaaatagacacaaagcattaaagttcttagtaaaagatgaaatatttaaagaactgtatattgagacaataatctccagaatatattatgaattggatatattagaaatacgaaaattaagatttaaagattttaaaaatactgatttggtagatatattaataaatatgaaaggtaatgaatcatttgatgatttaataaattactttaattaccaacacttttatgttttgtatagccgttttgttgagttagatagtgatgaagatcgttatttaacattggatgattttaagaagcatgattctggatcattaactatgaatgccttgacgagaatatgggaatgtaatatatgtgagaaaaaagagttatttgaggatgaattaaacagaaatagaaggatgagctatcatgattttatttatttttacattagtgatgaagataagacgacagaaagaagtattaggtattggtttgagattattgactttgattgtgacggatggataagttttagtgagattgactatttttttagagaacagaagagcagatgtaacgatttaaattattttattccagaattggataatatttcttgcatgatgaatgatttacttatgccaggaatacaaggaagatacagattggatgattttcttagaaataaattaattgctggccattttttcaatgttttagttaatacaaaaaagtgtctaacttcaatgtttatggatgcagaattaaattcaatacaagcagtgattcttcctaaattaggttataaatctccttctccatgggagttacattgccaatatcaatatcagattatccaagactcaagaaacgatcaaaatatagaataa

SEQ ID NO: 3355 - DNA, 213 bp, Cryptosporidium hominis
atgtcaggaaaaattagacaaggatttgagtggtcattagtactaattctcttattagctgtttttatttcatatgaccaatacttttttgcagcttcagtaggattgggtgttgcagtttttgtattgataacagattacttatttttagattcaaatcaatttatatttgatccattttacaataattggatacaaagagtaaataactaa

SEQ ID NO: 3356 - DNA, 1203 bp, Cryptosporidium hominis
  misc_feature (1177)..(1177): n is a, c, g, or t
atgagagagccaaaacggtacgcagcacgcaaagggacggggagaggaagggaggccccagggggagtaggaggcagacgaaaaggcggcgggggagaatgttgggcggaaggcggggggaaggagacggaaaaaaggggagaaggagaggggaaaggggggagagagggggagggaggaccggggggcgacgggggagaaaggaggggggagacgacgggaaagggagggaagaagggggggggaggaggcgggggggggaaggcggcaaggaggagccgcgaccccacgaggagacgggaacgagggggaagggggggggggaggcaaaggggggaagagagagggagggaaggggaaagagggaaggggcggagacaccacaaagagagggagcccgcggcagaccaggaggaaaaaacacaaccccaaaacagaccgcccccccaaaaaaaaaaaacttgctttactatttcttcccaacctattgatcaaagatctatcaatgctggtacttctgagacacttgtatctaaagatactacaaagcaatcatctggatctaatattagatccagatttcatagtaatagtagagaacttttaagaaagattactaataatagcaaggatgtaaaagaaggaggatcattagttgagaagtcgtcttatattgaaaataaagaagatgaattagatgaagactttacatatttaaatagattctataagatcaattcatttattattcagatccaagggagaaagactaataatataagttcaaatttaagttcaataatttctcaaccaattttaagacaaaatgatcaactttggaaaagtcctgattggatgatttgtctaagagacggtatatctaaaggtatcaagaataaaaataataaagaagatactttaaatgatcaattttggaggatttttggtatatctttaacaacaagttcaagatcagaaagggtatatggagaaatactaatcagaagattaagtactttatctttcagatcaagaattctttgtctttgtcaaagcttctttaaattagaagctccagggattctaagaaagcttttacagattataagtaggatgaacacgtgtatggtattagaagaagatgatagtttatcattagtagctagaagagcagcanatatggcccaaattggttcagaataa

SEQ ID NO: 3357 - DNA, 1800 bp, Cryptosporidium hominis
atgacaggagtagaagagaaaagaaagttcaaaaagaacatgagagatggttcaggtcttggcgtggagggatattcaagcgtggccagaaaaggaaatacttatggagacattggtagttatatgaacaatgcaagtatttctagtattagtgctagctgtatgaattacgtggatacaaaggatctgaagtttttggtttcaatccacaacttattcttcttcaagaatattattttagagacatcttctaaattttttacccttttctttggagatttcatttctcctgatcaagatcaagatcatgatcttgaacaagaagggtaccgaaatcaagatcagaatctacaaaaagttgtttctttgccttctaaaagcaaaagaagcaactcctttttgtctagctcagtaaaatatcaagtggatcacaaacaaacagatcaacatgtagaggagagacagcaatataaattagcagatgaagttcttttgaaaatgaagaaaatgttagaattcttgaggagttatggagcaatggataatgatgagaataagttattggcatcagaaacaacaactgaactaaaccgactcttattttctcaaagtgctagttccttaatctcagatccaaaatctcagggacgttatagaaagctttttctgaatctaatagaggaatgtattcaaaatattgattcattgatactttacattctcaagatgtattgtattaaaacaatttcatgcacttttggtcaagaattctatttaagaatctacggtaccggattattaaatgaaattcaaaatcttacaactagtaataataacaataataatagcaaaggaagctattcatacacctcttcttacgaagaagaaacagatctaagcttagaaaacttgattccgggattaaactcatgcttcagaagctttctgtctcaatgccccaatcaagacaaatcctattactttaatgatcacaatgaagatgaaaagacaacaggtgaaatcattgctctattaatttcaaaaggaatttcaacacaaagccaaatcgaaaacgagtttaataaagaatacatgaaatcattagaactactttggctctctcatatatttgaattatccctaagtaaaacaggatcacaatcattctatactgacaagttctccacaacctttgaatacgacttcgaaattttagatgaattaaggagaagctccaatgtaactgatatctattcttcttcctcctcctcctcctcctcttctattgctaaagaatccaaacaaaccattacaatctctgatattatactctactttattacacaattattacctaaccaaaaaattattcaacacaagatcttcaaagatctaaccttaatctcaaacttaaactctgaagatactactcttttacaacaaaaagaaaaaaatcctagccaaaactcctccaactctaaaaacaaactcaaaacaaaaaatcaaacaaatcttaatgaaagtacccgatacctattaaatcaagatctagatcaagaaaatgcgcgggctccctcgaacggtactagtatagaaaaaattcaaggaaatatgggtgaatctaatagaagtaaaaattcatttatgagtatgggaggaagtattcctggaggttttgacttttcaacgatttcaaaacagttatctaagggtcctcctcaaattgtttcaaagattataaagaattcaaactctggacagaaaaagattaggaagtttataagtagaaatttatattaa

SEQ ID NO: 3358 - DNA, 1506 bp, Cryptosporidium hominis
atgagagaaggaggaggattcatgattcaggcagctggttaccaaatatttaaagctattgttagtaagattccttctttaagatgtaaccatagttactcaggaaattctaagatacttacttatactatagacagcaagatccaatccttctttagaagagaagaagatcatgaaaatgtgaatgataatggaattgaaattgagaataacagagaaagagaaggagaaagagaaggagaaagagaagtagtttcaatagaaactgatgaagaggatggtgaagatacaattggattaagaagaactgagagtagatatgctttggaagagatatctttatcttcttccaattcacaatcatcatcgtcttcttcttcaaactcttcgccggtatcgatgggatcaattccagaagagcttaataatgctgagtctatcaataatacgaatcctactccaataactactcagcaggaagccccacaaccgaacataatagaagaggatctagggataatgcataagcttgatccatgggagtggccaaaaaataaggagattagagagatgattggtgagatgtatgaatgtttaggaagattaatggggatttgcgttacaactaagagtgctatgaatattaatctgaatcctttgatctggaaaaagttctcaggacttcctctctcacttaaggatctcgtggatgcagattgtatagcttatgaaatgcttaactctctcaaatacatagaaaatgaaagtttaaatagaaaacatagaaaaggaagaggaggaaaacgagaagaagatataaaacaactagaagaaagagaagaaggacaggaacgaggaggaggaaccagtatcccagaaattgaaggtttgacattccaaatagaaaatatgaatggaagtataacctcactattaaatatagagggaggagaaatggaatcaagcgtgggagtcactttggagaatcttcatctatttgttcagttagcagaaagatgtagaatgttggatgacagtaatataatgacaaatatactcaaaggattcggtaccattattccattgggaaggatgaggatgttatttaattatcaaaagattgaatatttaatatgtggagaatcaaaaatagatctagtaatacttaagaatcatacagtttctcctcatccagaacttaaagaacaactatttcaagtgcttgagacttttaataatgagcaactacaaaagcttcttagatttgtatcaggtaggagtagacttcctcaagttaacaataacttaagtgattggaaattttcaataaactatgataaccctgaaactatacaagataatagacttcctattgcaacaacttgtggatttagattatctttaccaagatattcaagtatcgagattttaagatcaagattactttatgcaattaataattgtgttgcaatagatcttgatgcatacgttacccatgataattag

SEQ ID NO: 3359 - DNA, 1242 bp, Cryptosporidium hominis
atgtgccattcttggcctgttagagttccaagaccatgcttggagaagttacaaggtaatactcctttattaacaggacaaagaattttggatgctttgttcccatcagtacaaggaggaacttgtgctattccaggagcttttggttgtggtaagacatgtatttctcaagctttgagtaaatatagtaactctgatgttattatttacattggttgtggagaaagaggaaatgaaatggcagaagttcttacagaattccctgagctttatactatggttgatggaaagaaggagtcaattatgcaaagaacttgtttagtagctaatacatcaaatatgcctgtcgctgctagagaagcttccatctacactggtattacactttctgaatactttagagatatgggatgtaatgtttctatgatggcagattcaacttctcgttgggctgaggctcttagagaaatttctggtagattagctgaaatgcctgcagattcgggttatccagcatatttaggcgccagacttgcttcattctatgaaagatcaggaagagttaaatgtatgggttctccagatagagaaggtacagtaacaattgttggtgcagtttctccacctggtggtgacttttctgatccagttactacagctacaataggtattgttcaagtcttttggggattagataagaagcttgctcagagaaaacatttcccttcagttaattggaatacatcattcagtaaatattcaagagttttggagccatactttgattcagttgatccagaatttaatggattaagacagaagatttctgagattttacagaaagagaatgagcttgctgatattttacagcttgttggaaaggattcactttctgaggatcagaagattgttctggaggttgctaagattattagggaagatttccttcaacaaaatgctttttcagactatgattttacttgtccaattcgaaagactcttggtatgatgaagacaattggtaatttatatgatctttctctaaaagctgttaaggattcatctcaacaacaacagaagattggctggtcaacaatttataattcaatgagagctactattaataagatcacttcaatgaaattcttggacccaagattaactgatcaagaaatcaagaaccacttttctcagcttaatgaggaggtttcaaaccagttcagagctatttctgataagtaa

SEQ ID NO: 3360 - DNA, 1536 bp, Cryptosporidium hominis
atgtttatctggggtagaataccaccaaatctacatacaaaaattgctagatttttggagatacaaggatataaagagaaagctttatcaataactgatgatcaagatcaaaagtttgatttagcattaggtttaggtatattggagttatgtatttctattttacaggaaatacaacttaaagatcatgctgaaaatgctagtattacaatggaatctattactcctaatgtacaagaggatataaaacaaggagaaggaatgattgatatttcaaatgtgaatagaaagagatggaaagttttgggtgatatagctttagagaaaggaaggttttctatggcaattgcttgttatagggaagtacaggatttggattctttattattaatttattcatgtataggtgatattcaaggattaaaatatgtagcaaaaatggcaagtaaacagaatttatggaatacagcatttatatgtcatactttacttcaggataaggaatcttgtattgaagatttaattcaatcagatttaataccttatgcagcattatttgctagatgttattatccatccaaattggaggaaattgttattaaatggagagattttaataagaaaggcgaacaacttttagcaagtcctaatgaaaatttggaattatttccatttcaccaagaatctcttaaattagaatcattattatctaatcaagaattgattaatcgtcctgttgcatcttgggataaactttttcaagcattaaattctgatctacttgaagattttcataataatggctttaattatgtgaaagatcaaatctggggaggagatgatattaatatggatgatttggatgataatattggaaatagatgtgatcaattagaagaagagaatagaatacaagaacaaataatggaaaatgaattacttataaaaggagaaggagaaatagtaacaatgagcccaaaatttggtcatttagatgaagatgaagatatgtcagctttttcatccccaagattatcagattcacatgagattgaatttggaattggagctggaaatagcgaaaatttggatataaaatctcaaattcaaacagatgagcaatctccgaaaaatactaatagaaggagttcagaattaagtattgaatcttcatcacctgaagctcagaaaggtggtggtcataagaagtatcaacaaaaccagcatcataatcagaatcaaagttaccatcatagagatcattatcaaaaccacaaagacggtaatcatcatcataacaatgaagttgaaggagaaaatacacaaagacgtgacagaaaagaaagtagatcaccatctcctaaacaaagtggtagaggaggaggaggaggaggaggaggaggaagaagaagaacaggaaaaaaaggacaagaagcaggagcaaacgctgctgaacattcttctactggatctccaaagcctccttccaaacataagaagaataacggaaagaaacaaccaaaaccaaaggattga

SEQ ID NO: 3361 - DNA, 1614 bp, Cryptosporidium hominis
atgaccaatccaaataatgaagaaatcaatatgagtgtgaaattgttgaatggcgatataattaaagttccaggaaaaattgatgcgaaaaaaacttcagtattgaaactcaaagaaatcataagtaatatttgtagtattccagtttttgaaataagacttgtttggaaagacaaaatactttcaaataatgctttattaagtagttatggaattgaagacaatagtactttaattcttgcgcgttctccatcacgaagctcaaattcatcttcacaaagaactggagtcagctctaactcaagctctagcatacaagcagattctggaggactatttggtgaatcagatacggatgactttctttcttcagctcttgcatcaccctggatgcaaagtatactaaatgacccggaaatatttagagtgatgttagaatcgaaccctcagcttaaagctctaagagagcagaatcctgaacttaatcacatttttaacgatccccaatttttacagatgtctgttgatgttttgaagaacccagaactcatgaaagaaatgatgagaaactcggatagggcaattagcaatatagaaagtattcctggaggatttagtgcacttaaaagaatgtaccatactgttcaagaaccgatgtgggatgctgcaatgtataacccaaacactattaaagcaaacacttataatgaatataatatagataaaagttctggaccaaactcggaagccttaccaaacccttggagtattaataggaattccagtaataatagtaataatagcaataatattggttcctcatccccggctgatatatttggaagttttggccaagacgtttcagggcagagacaatcaccactaaatctatttcctttcaactttggggttggaaattccaccaataaccgtaatgatggtaactccaatagtgataataacgtaaatagcaacttattactaccaggatttgcaggtcttggaaactttggtaatatccccaattttggaaatctagcaaatttggggttcttgaatcccaatataagccaaaataattcttcaaattccaatacaagtacagacaataatactactattaacaataataatactaataattcccaaacaactccacaacttcccaatctgatgaatttatattctccatttgctaatagtaatccaaatacaattcaaactgttattgatgcaatgagaaatatggacattaatagtagagatgatgcacttcagaaccaattcaacgaatttattgggaatggaggtgctaataccaatattggaaatatttctcaaggaatcggaaatgcaaatcttggtaacttgctcaatatgatcaatgcgggaagtccttctatgcagactaatgactcaggaaacttaagtaatataaataaccaaaatggcgcttccaataatggaaatgataatggagggcagaattataattaccaacttgaagtcctttccaatatggggtttactgatactgaggcatgtattaaagcccttactgaatctgatggaagtattaatagagcgatagataaacttctcaatcagaactaa

SEQ ID NO: 3362 - DNA, 1782 bp, Cryptosporidium hominis
atgtttcgagaaacaagtgtatattcagacacaactaaatatactgtgcagatttgttttgatcaaccatattattacagttctgagaaaatacgatgtagcttaaaagtattttatgaaagatttactcaggaaaatgaagcttcggaaaattatgaattgcttgattatattaccatccaactatttggctatgcttcattttctaatgagttgttaaattttataaattctaatagcaatttctttgtatcatcaacaacttcttcgtcttcaatcaatcaattcatttccaatatatttaacataacttcaaggcttgacagactgggaataactggaagacaaggtaaccaaaaaaacaaacctatatttgtaagtaacccacatatattagtcagcgatgtaaaaatttctaaatcaaaggatgaaattggaaccttcacgtatagttgttttcttcctccatttattcccccaacttttactggaaaactcatttctttcaattacactgcgttagttagtataggaattaataacaagatgaaaccagataggccaaatcaattatttaactttgaatttattcaaacattgggtggaacaaaccaagataaaggaaacaaatccttaaaaagcgcaattccaacttttcaaaaaaagcttaagtttgatataaaatgtttaggacctcatccaaaatcctcgggactcattttttccccaataaaaagatctgggacatatcatccaattactgcattaaacaataatttttaccattcaattcctattgatgatattaactctgtagtaactaactcttctgaaaaaattccatccattgtaacaactacaccttatagtaatttttgtgaagtctctgagattgaatttctaagtgcatctggtaataatccaaagattatcttggatcatttgaacagtaaattccaaagaaaatctctccatttaaaagcaatacaatcccagaatgaattagatattacaaaaatgagattttttgaactccatgataatattgaaatatactcttatcttaatgcatgcccaaaatctcttcttgaagtttactgggaaaatgaagtttccattattcactcacctgaaaacttaaaaaatgaccaaatcatttattcagctcctctagcttttaataactccaataataatgaaatccttaatattaattacaaaaatgaattagttgcaatatgcagaatttcaaattctaattcatggtcttcttcaaacccaataattgttcactttgatttcttcaaatcatattggaaatctcaagaaattcatattacacttaaaaggattgaagtaatacgtcaaaactctcaagattctcacggtatacaaaatcaggttattatttataattataagaaatgcacactttgggatttgggattttctcatcaaattaaccctctttcctctttcttaatccaatctttggattcggatatattctatgtttattaccagctctcatttgatttctttatatatagtactgaaaagaagcttaaaagaattaatttcttggatgttaatagattcccaaacttgattaagctatcttggaactcatctccaattaactattatggcaaatttcaaaaacttcaaatccaaaatactgataaaattgacagtttatcaaatataagttcttattttcatcctttgtcttctattcttccaagcaacaatacatgtttatcaaagtccattgaattttag

SEQ ID NO: 3363 - DNA, 2031 bp, Cryptosporidium hominis
atgcttattgcttcagaaggcacaaacttattcttaggaaaagttgatattgagaaaatgagctgcgaaatcctcaaaccaaatagtgatagcttcagaatcagtcaccaaatgcctattaaaactgcaaagtacatggaagatattatatataagggtgaattatttgagacggcattcttaactgtagatcaaagtggacttggaattctgcatattgtcgatctagaaaacaaatcattcatttcattccagatcttcacaatggataagttaattagtgccccatctgttttcccaagtttggaccaaagttcagatagctctagttatgatatagaagatgccagtcaaaactcaaataagagcttttctttggagagtttgcagaacgtgccttcaagcataaagtcaataaaagattccaatgactttaaattgatttcttttgagaatcctttggtacctggacagttttacagctttaataaaaaaagtcttcataatttctcaattgctgtaattaactcggcagctttaaatactattcgtctgattattgtctttaacaatttctcccctatggattatatctttaatagaatttcaaaccatttcattcatactgaatctctaattaatacatattcttgtctggaggacgaaaaaagtctggaaccactttccagagcaatttctcaagcattcactttgaacgatattagacttatccttgcaggccctcttacaatgaacaagattcctcttttagaggagatggatggaaagacatcaaaggagcccgaggactctattcaatcaaaggagatgaatagtaataatgaaaatgatggctcagtaaaaaatgctgataagaatattagttcatttttgaacttcaagcttggggagaaactgagtttgaaggctaaaagcgagaattactcaatgaatgaaaattcggacgatgttatggatgtatttctctcattattctacgaaaacacaccttcagaactgattaaagaagcgatttcttataactttgttgaagatgaatttccagatgatattatcgggtgtttacatatatccaagcctgtcttttccaacttaattctgcttgctctctgttatattgttgaaattgagccatatataccaaagtctttggaatatatccccatcagttgtatggataaaagaagtagttttgaaatccttataaagacactaaatcaagcagcatcctgccctaattttcctcataaagagcttaatagctctacctttagcaaaaaatccattctatctctgcttttcaaaatcatgtacttgattagaatcctaaactctctgagatgtttggtactcttgctatattctcgttcaaacgaaactaacgaatcccaagtaattagacgcgaggagcagatttccagatatttagtcaagcttcagtattacattcaacttcaaataactcaagtatatcagttgggttccattgaaacgcagggcgaatcggtgcttcctgctagattaaagtatatttggaattgtataaaagaatttgagccaattgatttatctaaaatttccctttcagacaaaaatatggaaaaatactttcaagatttgatcaataattcctgttgtctagtttcagagtcgccttacaacttctaccattgcttaaataatcatgaggaattaacgaattctgagacatcgaatactagtagctcaagttcaagctcttaccctaactttaaagatgactgtgtatcctcagtcccaatttgtccaattactttccttccgataaatgtttttgccatgtacaaacatctttcatgtaatttttgcgggaaagtaatttttgtcccaacagaaatgactaatcaagctcgcatgcaagatggaaagagtctgagttcttcaatttccatttttgagaaattatgtcttcaaggcgaatactatacatgccagttttgcttgaatgtaactgaactactagatatttaa

SEQ ID NO: 3364 - DNA, 4188 bp, Cryptosporidium hominis
atgaaacttacaatcccatttctaccacgaaattcttcttttgattttttgcacaaaaactacagaatcatcgaatatgtgggaaaaggacagtttggtaatacatacaaagtggagaacactattgattataagatatggctagcaaaatgtattgatctttcacagatggatgaagatgataaaaagaggagcctacaagaagctgaaataatgaaaagcattaaccatccttatgtaataaagtgtcatgagtcatttatacacgacgatgtttatttagtcattattatggaatactgtgagaggggagatattggggctgtaatagactcttgtatatcaaaaggtacttatttgccagaagaaaaaatcttatattggtgtgcacagttagcagcagggctttactatttacataatgaatgcagaattattcacagagacataaaaccctccaatattttcattagggaaaatggagaccttgtaattggtgattttggcataagcaggattatgctcagtgtaacaatgccttttactttgacctcaataggtactcctcagtatatgtcaccagaaatgtgtgaaaataagccatatacatataagagcgatatatggtcatttggatgcgttttatatgaattgacatgccttaagccaccattttctggagattcattgttatctctggcttggaagatttcatttcaagaaatagagccattaccaagctgttattcatcaaacttatttaaattaatacaaagcttattatcaagggatccaattctccgtccagatccattggagattttgaataacgaatcttttctagaatttaatcgtttaccagaatttttaccaaataaaacaggaaatgatttgaaagaagggacaattgagaaagtagaaggaacttttaatgctcttttccaagataatttgaaccaagataacaagaatcagcttaaaataaattctacaaatgactgcaatgctagccagttgaatacaagaccaagttcaggttttagcgctggaaatgatgactcctttagcttttctaaagagagttattctttatatgaaggagaaaataagcaaaagtgtagtgaagtcaatttaattggtcaaaataatattcataataatttaatcgatggatataagtgctctaaaaattcaattttgccttcaacttctgtcagcattgctactaattgctctccagatgagaattatatctccggaagagaaaatattcgagaatattgtggaatattgaccaactatgagcatcaatactttagtgtattggtcggaagaatacaacatcatatcttaagatatacagaaaaaatgaactttttattctgctcagaacaagatgatatactaactgtgtttaaaaaatgcttcaaatcttgtcaaagtgacttatactctttaaacggctatttaacacaggaatggttctctgagtttgttaatgagcttaatgtggggttatccgaaaatgaagcttcattcttcctttcatatattggttattttatttactctgaaaacaaagatcccttctcagaatgtaaaaaaaatgaatccaagaaaaacaaaagcaattataaaataagacatacaaaatcttccggtagtctgctttcactggatgtatctaaaactatgaggaacattgattcaaaaagtaaagatgttttccttggaactgttgaatttaatgaagatacaaaacatccaattcaaaacaaagaaaacattaaacctaaaattccaaaaatacacgaatttattgagaaaatttattcttggaataaaataagattaaataagtttcaagaacaaggcgttttagagtctactgaaactacaaatctgagatttgaaaaggaacctagcccctttccaataagtccaataataaattacaataattataagcagaatatacattcgattaagccttgcttctatctttttattacagactggattcagactatattaactccaattttagccatcaacaatattacatataactcaaatcagtctgtaagtaggggaaagaaaattacattaaggcaaggatttcatctttttgatcagaggactcagggaactttatctagacaacatttcaggactgttttatacttgattttgccaaagctaacttcagtacagcttgattggctttacgctcttgcaccaaaagatttgtttggaaatgtcaagtacgaacagtttctagatttcattgataatattcaaaattctggtaaaaccgtaactgctaatgaaaatataaacagagaaaatgctttgaatgggaccaggagaggagataaatctgagaacttaaccaagaaatttagcttttttgagaatatagagattcaaatagataaggaagagaatgatgaaaatttggagtataacgggcaagatcatgcttatataaaggaaacaaacaccaataatattcttaataaaattcaatttcaaggagaaaagtctcaaactaactctgaaactaaattgacaaacaagataaaaaactatatagatgaatcagaaaatgagagattacaacattttggagagaatgaaataactaataatgaatataataacattcctattatacagcaagaactatatagctttggaatacaggatgtcgtattgcttcattacaatagtcaagcttgtatgagaaggccttctccttctcctcaactattatcaagagcaaggaatgcttcatttataaggagttccagaagaggctgtgagcctgaggtagatggagataataaagagaatgattcaaaacttaatttggcagctagtgaaatagaagttaaacaaaagtttgagaaattccaaaagcaaagctcggtttcaacagatagtacaggcgaacaatatctaaagataagtcatatcaagaatcaagaggttaatgagaaacaagatttaaatgtaaataatgataaaatcagcacttataacttgtgcttaaacatttcaaagagtttggttgggagtttaagcaaagaactggaatgcttaattcaaaaattacaggttgaaagaatatacacgtgctggattacagcaaaagcttcggaaagtcaaaaagagttgtttggcgaggtatttgaaaaactaacaaatattaggctagatactagtttggctttggatttattgatttcaaatctggatatgatgaaaaatcctaatcaattcgagtctattatcgaactcgatggcatattaacgattttaaaagaggagcttccattacaaagggatgcaattgattgtatattaagagtgattgatcatatggaactttcatctgaacaggaatccaagacaattgtcgaaagtcaacttatcaattcagatgcctcaaaggtttataagcaaattatgaaacaagcaattacaaacaacatcgtattgccaatttcgactaaaagcaagtacaaatctagcagaagtcatgaaggagagctagcttctactccagtaagatctataaatagcattaaagaaacagatttttgtaaatcccagcttgattctaattcaaaagtttttgattggactggaaagtttctagcatcctttgaattttttggagaagccacagtaaatctaatccaatgtgggataaatatattggaaagcatgagaaactttagacaagattttcaactacaggaaacaagtcttaaagacttctcaaaactgaaccttctcatagaaaactacagacaatggtcgcacttaaaagagcacgtgtctagagagtgtgcctttgttgcatcaattggagctaatcatgacctaaagaatgatattgagactgcaagaatcttcctagaattacttggggcaagaagattccaagtaaacgttacttggcagcaacaaagtagcacagaaaaacagctattcagaaagttgtttcttcttgaagagtctctttggaatagccaaagctatctttctttaggagaagatatgctctcatctacaaaagagagcgactctgaactttggctaatttgtggcgaacaaacttgtggagcactacacagtacttgcaacaaattcattagcgaaattcaatcattgttataa

SEQ ID NO: 3365 - DNA, 384 bp, Cryptosporidium hominis
atgtcagcagctgtaatgaagccaacagacaagcaatttggtcagtttaatggagagcaacaacaggcaccattacacaagatcagaattactctctcgagcaagaatttgaaatcaattgagcgtgtatgtgctgatttgatccaaagtgctaaacaaaaggacttaaaggtaactggtccagttagaatgccagttaagaccttgagaatcactaccagaaaatccccatgtggtgagggatctaagacctgggatagatatgaaatgcgtatctacaaaagagttatcgacttgtattcatcaagtgatgttgtaaagcaaatcacttcaattaacattgatgcaggagttgaggttgaggtaactatttctgacatttaa

SEQ ID NO: 3366 - DNA, 1692 bp, Cryptosporidium hominis
atgaaatcaactaaaccgaccttaaaagagctatattacttaacaactatactatccaatttaccacaggaaattagttcagttttaggaagagacgatataatagaagactcgaatgagattattaatgataagttaagtattattaagaaacaaatttcaagtaatcaaatattagattatgaagaaatctcatttttatttggatcaatttctcagttaattcgattaggatctagaaatgtacaacatcttaaaatgatgaatacaatcttggaattgcaaaataagaatctcaagttttatcctattgtagacttagatacctttgtcctcaacttctcactcttgtctagagcgtacttcttcttaagaagacccattgattttgaagatatcccactttccttacagcaaatggcctatagtatttcaagaattaaacttagagatataaaaagtttaacagttttgaatgaatatattgtcactagaagactgtttattgattctggtatttatttgatacaaggtttccaaaatactaatcccaaaaatattgatgagaatttagctacagtcatattttgtagattagatggatcaccaattgaaaatttatctttgaatttatcaaatactaatacttttaaacttgtaggtataccaaatacttgcgagtatcaacttttttataataatatcgcaaatcaaaccgaaccatttaatcttgagaaagtgaagaatgatttgtctaattctattccaaagctaaaaatttctagtaaatctgtccttgctagagaggccaatattccaattcttaataaaaaaagctccaattttgagattacaagagccactatttaccttggtgagaaattaacattgggaaaatctcaagttaaagatattaatactcactatatgaagatattagatagtttccaattttctctggaactacaaacaagcttggagatattaaactttgaaacagtatatcaatattttactgcttttgaaattaaagctttgactccttataaaactattggtacccgaacaatcaagcttattccagcaattattgagaagaataatctaaaactttatttagatcttacaaatgatgactttatttgctcttctctagaattttccataagaattattattggaaatccattgaaaaatgaatcatccaattcctcaaattccaatcaagagatactttcaattatgattaatgatgaacgtaatgatacatcagctcttagtaaactttgcccatacaagatccaccccaagattgccgatttctatccaaaagaagaaatctcatatatatttaaagaaccaagaaaactacctggacctcttctcccttatggcttctctatcctaattttactatcactattcaaaattattcctatttggaataagttgtccaagattgaccaaggattcttcactttcataaataatgtccctttcattaaagtagcaaccttcatttctttggcaatttctcttttcattatcctttgctactggcatacactcaacatctttcagtttatgtacatcttcactccagcaatatgtatcttttttgttttattaaaactctctcttagaaactttaattatccaagcttcagcaatgaaaagtccaagtctgactag

SEQ ID NO: 3367 - DNA, 1728 bp, Cryptosporidium hominis
atgtggaatttaccagaaaaaattgaaataaaagaagataagaggaaagggaggagtatcatagcaaaagaggaaatacaaattggagaaagcatattaatggaggagccgtattgtagaatattatttagtgataatatagaagaaatttgtgatacatgctttaattatttgagatcagcaggctcttattctgaatgcattctagaatgtcaggaatgcaagaaaatcaagttttgttcaaagaaatgtatggaggagtctaaaacaattcatcattttgaatgtggaatactaaagttggatattttgcaaatgatttctaataaagtaggagtttcttttgatagatctagacttttaacgagatttgttattaaattaatacttgagcttaatgataaaaataaaagccaaagagagcagaataatagttacttaatatcaaatttaaaccaaattaattctttggttgacaatcaagaaaagtttttacagagcattaaggatgtttatcaagaattagcacttgagattctcaaaattccaaaactgaaagcagaaattgataaattggaaaataatgatattattacagataagttattggttaagatttcatgcattatggatagtaatagttttggaatccctaaattccctttgaaatgtaatgtaaatggagattcagtatcagaattagtgaatccacgccaaaaagctccaaattcttctttagagttgtctaactctttattaaacccaagcattcttggatggggacttttttcatattctagcctgtttaaccatagctgtgatccaaattgtgacttcattggagtaaatcctattcctaatcaatcctctgtaacaattaatttaatagctaataggaagattcaaaaggatgaagaaattacaattaattatgttgagatttatgatactaggagaaatcgaattaaaaatctacttaaaaccaaacattttatatgtcattgtgaaagatgtacaacatcttttcttaattgtaatgactcatatatccaaggattttgttgttcaaaatgcttcaacattaatgattttgactacaaaagtaataatattccaataatccaatcagaatctgtttctaacttaaataaaccagaaaatattacgtctattattgatgatcaagactatctaatctcccagttaactgaatcatatcactgtaattcatgtggtgaaatatattacggatctgaagttactagtattcaaaatgaatttcttgataccatacaagaagctgagaatatgaatattcaaaaatatgatctccaaggagcaattaatctaatatcaagcttaattcaaagatatcatcttcctgactctaaatcaccgttacctcatccattaaaccatttactctatagatgttataagttactcactttttggaatgttattgttaaagactggaattctgttaattattatgtttcgaaaatgatcaactctcatttattattatttcagaaccaatataatttagaaatctccaatctatattccactaaagctattgctttatctcacctaggacatgtttctgaatccaatacagaatggaataaatgtcttaaaatcagacaaatttgctccggaaatttctcttacccatataatatatcttcagtgaattctctaattgtgcataaagatgccgcttaa

SEQ ID NO: 3368 - DNA, 1671 bp, Cryptosporidium hominis
atggaaatgagttggaggatattactaacattacaaacagttttattttttttatatttctcaatagttaaaggtgggaatttaactgagttaaataaagatagctttcaagattttattacaaagaatgaacattgtctagtaatcttttatactgatgattgtgcagcatgtgtgacaataatagaaagattggaaaagttgaatgaagaaataagaaatattaaggttaatgtggcaaagatcaatggagagaggaatataaagatattggaagaataccaaataaatgattatcctacaatgaagttttttagaaataaggtagcagaagaatattatggaggaagagaagaaaatgaaatattagaatggttaaaggaacaagtagcatttcctgttttggaattagagaagaatatgattaataaggaaaaacttgagaatttattacttaagaatgatgttttatatatcttttatggtgataagaacggaatggagagaagtatatttaatgatgtagcaaactataatagagcttctgggaaattctaccaaatttcaaaggatgacttaggatttggtttatctaaagaaagctttatcaatgtctttcaatctggaatagagttagattcaataaaaaatgatttaaagaaaagcagttttgatccttggattgtttgcttaaggagatatgaaaatgcaatacctttccatggctcttctaaacaaaggaaagaagtttgggattttgtgaaagctaatcagattccattatttggtgagatttcatctagaaattatgtaaaatattcagaggtggaatatgatttaatttggcttcttgttccaatggaacctggtaaaggagaagaaagtattaaaccatatgttgcattatttactcaaatttcacaagaattcgcagataactacagagtagtatggttagatacctcagaacattcttctcatttaaatacagttttattagtagaacctgagatgcttccaacagtagctgtagctaaatctagaccttatctgttaccaccaaatactccaatagagtatttaacaataaagaaatttcttcaagatattgaattaaataaggttgagccaaaattaagatctgagccaatacctgtctattatgataatgacacagtattcaagttagttgggagtaactttaattcaatggttttagaggataaaaagaatgactggctagttattttagttactccattttgccaaccttgcatagatacagaagagattattagaaaattacatgatgcaatttcttttgggaattctgaatcaaaaataaagtttgggtcctttgatatcagtgaaaatgaccttcctaaggatgagttctattccaattctattccatccataattttctttaatagaaaggattcaggtaatcccattcactttaatgcagaagaaattagctacataaatattaaggattacatgatgaactcaacaagtattgattctaatgagatttcattcatagatccagcaaatgctactgatcttgttgttacgattttctcagactttgaacagtttagtgatgaattccccacacaagagcaaattgaaacggtggaaaaatctatcaaacatgacgaattataa

SEQ ID NO: 3369 - DNA, 1371 bp, Cryptosporidium hominis
atgagttggtggttggaaaaactaaccaagaacttaacaacgggaataaattctgagaattccgtaaatcactctaaaaataacataacttccaggaatgaaagtgaggaagagattttagcaaacgattcttccatctttagccagatttatgagttgaatggatgttacaaatgtactcttcgtacaagtggagtgggactgggatcctataaatgtgatgtaattttcatggagaagcaacttatagtattgcatttggtgagtagaaataacctcaatgtttcaagaatcttggctccaatagcagccacagcttttgctacctcatttaatggggataattcaaaagtctctaaaggggaatggattgtacttccttttgatcatattacaggagttgagttacaaaaccaagggaaagaagtgagaataacgacaaaagttggaataagttattttttaggagataatgaagagtgcattttgaaagtttatgaaatttacaatgaaagaagagactctctaagagatttagaaaacaaggaaaatgcaaaaaatccaaatgctcgtagctttactatacacaatgcagacataccaataagtagcagggaaaatgttggaaaagaatcattttcagattttgctcctttatcacacatatttcctggttgcattgtctcaattacagcaacagagttagcagagatactgactaatgacttattctacggtaagtacattttggatccaaaagagacatttgaacttgagataagtaaatgggagggtcaaaataacattgtaagtaatgataaatcagaattttggctaaaacaaggagcatctagagaaatacaatataggagaaagatttcaacaggagttctggacatatgggtctcattcacggaaaagcatcagatctcatttcccactgaccgttcattcatacatatattaattggcgtcatattcactatttttgaaaaggaagttggaatcaaaattctaattagattagtcgagatacaagaaaataagacacaattcgacctggaatgtgaattagaaaataccagctctctaccatatctagtaaggtaccagctagaaagctcaacaattaataatgtaaagtcaaccgttgaaaactatattcaaggaatcagggaccacctctcagaaatttgttctagcagtatggactcaatcccagaattctgttccaacaccacgatctgcaacctaaactacccagaaaacaaaataggttttttcaaacaaaccgcagtaaaatgcgatgaatccatgatctgttgcttccaaccctttcatcaagtcttaagaagcttatttcaattttaa

SEQ ID NO: 3370 - DNA, 1065 bp, Cryptosporidium hominis
atgatacgtagaggtggaaataaagttttaagaggaagtgttacttttgagatccataataacagtgaaattcctttggaactaatgttttgccattttttccatacaaaatatgtatatgatttactttctaagctttgtactttaagttgtagcagaattcatgaaaccatcctgggggataaaaataatcctgatttgaataatattattcatgaaaaggtcaattctattgaggatttggaaaatatcgggaaattggatcaaaaaactgagtctattattcctaatgaaccttgcaattttctcctgtataatattcaagatagaatttccataagtaatagctgtgactttgatcaacaaaatatatatggaatattggccaaaaaagcaagtaatgactttgaagaatttattaacgagtatgactttaactctattccaacatcatctttgtcaaatgttttcccttgtgtgattataccattaaaagtccagaaaatcttctcaatactttcaaaccataccatggatagctcaaagaacgtttatcttaaatacctggaactttctggagcttctaatattcaaattgaatctaaaccttgcaatggtgactttatgtttcattatatatataaatatgaaaaatctttgagtttaacaggcagttttggatttggttggctttccaaaggaatgatgaatataaagtgtcaagaggatctcaaactttataatcttggtagtgatgttggtattttactttgtatagatattaactccactggcattcctgaaaatgatgcttttactgtcaatataagacacagatttacaccttttacaacagtttcaaatgctaatagttcaattaatatggataatcaaatatcaaataaacaagaggatcaacaaaacaactttgttcagcttgatgttgaatgtgatgttactttttatagattttcttttttcaaaagtcctgttgttcaaaatgcaattgaccagactaaaaagggtcttgagcttattagatcatcatggaagatgcattactga

SEQ ID NO: 3371 - DNA, 1059 bp, Cryptosporidium hominis
atgagaaaaactccaacgttatcatatggatacacagaaaaagaaaaaagtgaacaaagtcaaaaatcagaaataacagaagtatccgaacatgtatattgcttaaatgagaataagtcttcagaaatggatgaagatatttcagaaaaatatgatttggaagaaactaaatcagtaatcttctctggaattaataaaatgtttgagaaaattacagaaactgaaactaaaggtgaattttgctccattaattctggagactatcttgataattattcatgtataacagggactgagatacttgatgaaataatgagaaagccaaaaaaaagaggattttctgatttttctttaaaatccctcaattctattggtaaaatgtcaatctctgattctatttttagccctgataccaactttgatgataatgttacagtaaataattacaattttatttgtaaatctaaagaaaaagatcatcataatagtaaccagaatcaaaattattcttcgttaccttctgatctttgtatttcaaagcttaaattagaggaaaataaacaacttgagaatgcactgaccaagttagaaacaactagtaaaggactttacgaaaagtgtcagaagaagctggaagcttacttcattttaattaaaacccgtattgaaaatatgtggaatgaaaagattaatgttttttctcaaaaaaggaaagatcttacattaaaggtagaagcaagcagggctcagatagaaaatgaatatttgaatttacaaaaaaaatatattgcagatttgaaaatgattggcgagaaaattaataaggaaaaggaaatgaatataaagggatcagaacaagataaattttcattaggaaagaaagtcatagttggacttaaggaagaaattgaaagtgaaaagaaaagggtagaaaatagtataaaattattatcagaaaagaaagagatggagagaaacaaatatagaaaatctacaacaaagaaattggatttaagacagattttgaaaaatatgataattaatgaagaaagcgaataa

SEQ ID NO: 3372 - DNA, 393 bp, Cryptosporidium hominis
atgctaaaaatttttcttgttaagtttttacctatttttgttgactcattttcttcttctctttccaaaatttcaacaatcccatcttcaataataacccataaatcttcatttccctttactttctcaagcttcttttcaagctctaactgccagtccattgatttcaatgaccatatatccaattctattattttctttcctttcctctctatgcagaatttaccagtttattatcttattatacttgtcaattttctactttttactagtttgcccccccaccctcattctgctcttccccttattgcatgcatgcaattcacatttactttctatataccggtgtccacatgcaaatattttaaaaaaataattaaacaaatttcttga

SEQ ID NO: 3373 - DNA, 792 bp, Cryptosporidium hominis
atggcaagaatttcaatagcaacattattccttgcatctattgcactagttaaaggagcaaagactcatctaggattgtcagagtcagtatttaatcagttggtgaataaaggatacacaaaaagtgatatagagtcattagtgggaacaattagaagctcacttttgactgtagatgacgaacaaattggtcaatgcggagagggattaaaaggattattagatagacaattgattccaggagatccagatgctttggagagagtttcaggtatcattcaccaaggaaatttccaattattccgtggaaaattaccaattgtaactttatcatcaacatctattttattgccattagatagtatttccgatatatgttttggaatcagaagtgacaaaggaataggctataatgtatgcacaaaaaacagaaatatgagaaatatttggatgaacgccattacagaaatggttttatgtgaaaaaactggagttagaagtggtaaattaccagcaatatcaaaaaaacaaaatgtactcgctggaagtaatgttggtgagctgaaaccttctggaattgatattattatcaaggacagtagccaaggcaagccattcctcactattaatggaaagccaatttctcagattattcaaaagcaaacaatggcagcacaaaatgctttgactacaccaaagggtgaggagagcgaagaagatagtgttgaaattcctgcagaaattgacggtaagttttttttatcaattaatgaactaattaaaatgaaataa

SEQ ID NO: 3374 - DNA, 1887 bp, Cryptosporidium hominis
atgtcgacaagaattcaaattttcctgttaactgtgctttttattggattatttaacgattcagtgtcacaatttacacaaaacttgaaaataattgaatcaaagtctgtatgtgtagattcagatatttatgattcagaaacagatatgtgcctggcgaaagttaatgcaataagtaaaagttgtcctaaaaattgtcaaaagtttggccatctttgcaaatgcattgatgaaattccaatacagtcaatttgtccaagcgaatatgttctttctccaaatatgaaaaaatgtatcaaagtggaaaagcttgcaccttcaatagaatgtgggagaggattaaagtggtcagaaagtaaaaatatatgcgttggagtaaagttatcagctccagaactgacatgtagtaaagagaattccatgttaattaatggagtttgtttgacttatagtaaaaagagtattcaaaatgtttgtgaagatgggtttattattaaggaaaaaaatatatcagaaaagtcgcagactgtcaagttaaatacaagaggaattaagactggacatcaaaataatgatgaatcgagaattagtacaagttattgtgtaaaagaacttagctcaccttataatttagagtgccctaatggttttattttagacagagaaagatcttcatgtgtttctcaagttttcagtgatccagaacctaaatgcttacctggctttgagtttgataataaatctgaaacttgtgtaaataagtcattagaagagtcttccagcagagtatgtccaaaagattatgtacttgaaggttttcagtgcgtccaatcatcttttgtcagtcctgagccacgatgtagagagggattcgtttttagtgttgaagatgctgcatgcattaaagtattacgggaacctccatcatatagatgcccttctgatttatatatttttgatggaaaacaatgcgaattaagaaaaacagagaaaccaacaataatgtgtggaaatggcactattttagacgaaaagatacaaaagtgtgttaaaatcaatgtaatgccagcaacaatggtttgttcaggaggaagacagtatgacgaagataaaagaaaatgttatgtaattcaagttcaagaatctaacaaaacttgctcaaatgaagaaaaatacgatccaaaaagggatatgtgtattaaatttgaagaaaagaaacccgtcaaaggttgcccttatggttttaatcttaatgaattagaacaaatttgcgttcaagaaaactttgaagaacccaagctctcttgtagggctcctttctccttagttggaggggattgcctttataatgctgaagttcaacccgaatatgtttgccctgagaattttgagtataatgcacaaaattcacaatgtttaatgcaaagtactatacaacctgaaaatgggtgtcccgaagattataatgagtatattgataaatgtattaaacaaatagaaaagaatccagtaagtgtatgccctgcaaattcaaagttaaacacaatcacaaatgaatgctttattcctaaaaaacctttgaaggagtgccctacagggtttaaaccaactaatgattctgccactcaatgcattcaaatattaaatcaaaatagacctcaagctatccaaactacccacagcaataataacagacatcacaacggtcatcatcaaactttcattggagattactacaataatcatcctaatataagaaatttcggagatgtaagtaatacccaggtgcaaacagttcaactatcaaatcctaatagaagaataggagatcccagcttaaatgtatatcctcaaaacattaaaactgcacctaaaccaagaaggtga

SEQ ID NO: 3375 - DNA, 183 bp, Cryptosporidium hominis
atgcttaaaaagttagtatctggaaatgaagaacagcctgcaaataagactctatattgcaagaacttgaacgataaaatcaacaaaaaagatttaaagattctattatttgaactctttatccaatttggtttgattgataagattacaataaggggaggaagtccatatagaggccaagca

SEQ ID NO: 3376 - DNA, 531 bp, Cryptosporidium hominis
atgcatctatctttgttacctttatgccccatagctgaagagctctacaagaaccataaaacttttcacgatggtgattcaggacttgaccttttcataattgaagaccaagtgattaaagcaggagaaactgcgtacatcaagcttggatttaaagctgcagctcacagtgatgatggcaagccagttagttaccttttatttgcaaggtcatcaatttcaaagtcgccaattagactatgcaactctgttggattgattgatgctgggtatagaggcgaacttttggcaccagttgataatattaaagattttgatttccaagttaaaaagggcgagagatatttccaacttgtttcttttaatggagaaaaaattaccttctgtattgtcgatgaattggacaaaaccactagaggtgagggaggttttggctctactgacaaattggattcagtaaaaggattacctcaaaagattgcaaaggttgatgcagaaaacgctgagaacttgattgagaatgttcaataa

SEQ ID NO: 3377 - DNA, 1353 bp, Cryptosporidium hominis
atgatcgggaaagacggcctaatagggttgagttctaatccaatggaaggagccactcaaacaacgaaacatgtaggttggggaattagcagacaaactgaagataaagattcaaaagaggaggtccagcaactttctggttcttcaggtatttcaggaggaaaaggatctggatactttcaatctcagtcaggaggacagcagatttcacagggttctttggcatcaggtactggacatcatcagcactatagtttttcaagtggaaatgcaataggaaattcaggaggatcatctcactataaacatttatcaacaaaaactacagtttcttcagtagaggctgatatttctgccattttaagaatcattaagcattgtacagaaaactactcacaaatgaatgctacaggtcaattgctaggtatggaatatggtaataagctggaaattacaacatccttccagcttccaacaagagaagatttgcttccgtctctcatgtctaactatagtggaggaaagttggataaatcagaaaaactggatttagaggagcgtcttgttgaagaagttgataaatatcaggctgcaatggttgagcttatgcatgaaatacgttccgattgttttgtgcttggatggtaccagcttatacgtcttgatgatttccaagattatggagttgtttctacattattatcttactataataacattgagagtaaaaatgctatccttttaagcattgatcctgacttacttattcagggtaagaaaaatgcttttaaagcttttaccttgaactctgaatacgcaagcaaactcaaagatgatgaagataactttcacatttttaagaatgccagctttgaggatattcttgttgaagtcccaatttatattaaatatccagttctttctgaagctttcctacttgattggataacttcagatgtactccaatccaccattgactattctgaattatctatcaacacaaaaacaccccttgatatcaatgacaaggctctattaaatctcgcagaatctatcgatgttttgtcattggaacaagagaaactttacaaaggatatagggactataacaaacagcaatatcttatcaaacagatggcagaaaggagaagaattgaaaatgagcaaagaaaactcaagggtgagactccattacctattgatacggaatcaattaagaaggttgacccaccaaatcctctcccagttattcttgtttccaaatatgttgaatctcaatgcaatgaaataaacttcaactcaaaggaaagccttaccaaggttctcattcgaaacatcaagaacgacatgtaa

SEQ ID NO: 3378 - DNA, 1242 bp, Cryptosporidium hominis
atggatgtaactggtcagaatttgagtttatttgaggaaaatgaggattctatagtggactttattacaatactgacttcagtagtacaagattcaaatgaatttttgaatgaagaccaaaagaaagttaccaaagagaaaataaagtctggaattctaaggaccattaattccaggagttcactttctttaatagattttgattataataaagaaaataactttaattctctaattaatcagattccagatatacttgagataagggatgctatttcaacaggttgtattgatttggatgactttgaggttttaacaagaacatttaagtctataactgaaatgtgtagaccagaaaatatttcaatatttatcaataaaaatattgagagcactcaaaaatctcaaaattattttgcaacaaaagagtttatctacgaaaatagcatcaatgaagcttcgtggcatgagaaaaaaagtctattcccgtcctttatattatcaatgtttgatatgatcacaaagtactcacatttcttcaatattcgtatagtaatgttccaaatttgcagagaaattgcaaatattttaataaactgtaattggaaggatgataatgttctgacttggctatcacgtcctgtactgtcagatcttattatatcccttgcaaattgtactcaggaaggcgatgtttcagagccaaatgaaaacattcaaaaaagaaaacaatcttgttcttcttgttatattagggaagcaatcctgagctcaatttttagtaaagttctcgaaacttttaacattataagcaaaaacaaattattaaatggggtcattgaaattaatataatcgacaacttttctctatgtttctcgatttcaaatcatataatccaacaatatcacccaaattgctacttagaacaagtcaactcaaattcagaaaaaggatataaaagttggtgggctcttaagtccgaaatttttaatctaattcaaatgacaaaacaatcatgcaataaagactttgtcacgctaactcaaatttcactctacttcctcaatcagatagattcatctcatctcacactgaagaggatctctacaaaaaatcagctttataaaaacctaagtctaaataaacagatctccaacggatgcttttttaacgaatatttgtacggcaatattgaagttgatcttcccgcatgcctacagtcaattctatttaatgcctag

SEQ ID NO: 3379 - DNA, 873 bp, Cryptosporidium hominis
atgttgactctaaatactttcaatatcagaaggttgcttcttacatgtcaggtctatgataatgatcaaatagataaaatcctagattctctttcagaaattaacgttgatgaatatcaagatgaattcttggatatgcttgcgaagaatacactattaataatcaacagagatattagcaaagaaattaaagttatgaaagaaatttttacatcaaagcttgcaattgttcctcttatatttggaatacaaggctcaaacaaatcctctgtgattattgatttgtcgcattatttgaatattccaaatgttgtatccacaaatactgttaaggaaacattgagaatttaccatggaaaaacaaataatactatagaaaatgataattttagtttttcaaactacttgattgattcaagagaaattactaaaggtattcaagttgatattgaaaaggcaataaaacaaggaaaatctatcattttgtccggccacaatctatttttgccatatatttttgagcttcactctggtggtctttttcctgccccaattctaattaacgaaatgaaagataattccgtaaatcattcttttccactttactttcttccaagcaaaaatgaagattcgattagcttactctttataccaattttacttaaggcagatttgaagaaaacccgagtaaaccctgaaaaaatagattttttgcaaaaacttcaagatgaaataatttccaatactgtaaataattcaacgaactggccagtacatattgtttcacatgatccagaaatcccgcaaaaaacctctagaacaattcatcaaattattattaagagtctaaaaaaagcaatccatcccacataa

SEQ ID NO: 3380 - DNA, 1542 bp, Cryptosporidium hominis
atggagcttataaactcgagaggaggcctggatgagaaggtaaatggtgagggaaattcgagaggagagttatatttaacattagatgaattgcgttgggtacagttacatgtaagacctgaatttggattcattctatctccaactgctcccaaaacgcagaaacaaaaaaagagtaaaactaaattagaaaatgacaatgaggataaaggcgtgaataaatctgcactttctacttcaaataaaagacaaaaaactggctcattatctggaaaaggtacttctggctcatttcttggtgttcctgaagatagaggtaactgtgcaagtagtgaagtcagttttgaggggaaaactacaaggcaaaatagtggtaatagagcaactataagtcacgatccttcatcaaaagattatgcaggtgttaataatataggtacaggttctgctactacttccgttaatttgaaaaatattaagatgattgattttaaagccttttctctgacacttttagaaaagttgagtaagattcctggatctagatggtttttgcagcctgttgatccagaacttgatggagtccctgattactttgctgttattgaaaaccctatggatttccaaaccattcatgaaaagctagttcaaaacatgtacaagaatccttttggttggcaacttgatatgagattggtcttctataatgctttaaagtatcacaaggagggtaatactgttagagaagatgctctttctttagcaatcgagtttgaaaataaatgcaaagaaattaaggaagttaacccatattattatactattctgcaagacaagcaagaacttttgcctttatcagagtttgatcctgatgatactttgttggaaaagcttaatactttggatccagaaatcttagttagaatttattccttattaattgactccaaagaagagatacaggattctgtagatgaccctaatcccacatcagaaatgattcttgatcaacttagattcaagcctaaaataattcgtgatcaaattatattacttgttgattcaattattcaaattgaagataaatatcaaaaagtttctcaatatacaaaggttgatgacaccattaatacaactaatttccttaacaatgatgttgcaatgactccaagcagtgaaggaagcagccccgaggatgtgagcttttccaaagatccagatattgacgatgagtttgaaggaagtgaggattttgtaaggatgcaagccgaaaattccagtctacaacatgatattccaatcaattcgggttctaatagtaacgacgatgagcatgatgatatttatagtaactcaattcatgaaaaggagatcatgaactcttcttttacctctaacacctttccaatacctcctcaagaatcagcttggggtgagtggaaggcaaaggttattcacaacagtactttaacccaaagagagaatgctccaaagaaatcaaagagagaaagagaggcagaacaagccgatgctgagatttga

SEQ ID NO: 3381 - DNA, 1692 bp, Cryptosporidium hominis
atggacgattacgataataggcttaaatcagattttccaagagactacgccagggaatcaaacaaaaggaattacgactataggaaaaaagacttctatggaagagaaagcgatgtaactggacattctaactcatataaaccttatagaaatgaatacccatataaatttagaagaaaagatcaatactttaggaaagatagttctagatcccctgaaagatataggaatagaaatcaaatatctaaaggaatagaatattcgagatcaaattctatatcaccagatagaatctcctctaatggtagtaggagatatccaaatccaaattttgaaaagaatctggattccaagctggacaaggtcaaaaaagatttggaatattctggtagggatgacttgactgttttagtcttgaatttaaacttggatgcacgtgagtttgaagtttatgagttctttacaacttatgctggaaatgtacgagatatacgtattatccgggaccatcgcacaggaaggtctaaaggagtttgttatgtagagttttattctgtggagtcagtgcttaaggctctcaaacttagcggccaaaagattatgaatacacctatcacggttcaggcatcccaagctgaaaagaacagagctgccaagctcgctaaattggaggaaattaaggctgaaaccacacctcttctacttagagttgatggattggtcggtttattggcaagaataaggcgagatgaaatcgaaagcttgttttcgacatttggtaaagttaacaaaattgatattgaaattgacaaaaagactcaaagatgtcttggatttgctcatattttgtttgaaaaggctattgaaggccacgatgccattaaagctctaaataactttgaaattgctggacaaaagattactgttacaatatctcaagaatgcaattccagtgttaaagtttccaattgtttggcctcctccacctttaatagttattcgtctccttctgtagtatccaattctcaaaatgaaccttctaaggggaattcctcagctcataatttagaaagagtgtctgaatttgataaattagatgaatcagaagaggcagtactccttggtgcagactcaagaaactttctgacaaaaaagctattagcaagggctcaatctcagattgataatcctcctcccatccaagaaacctcaaataatacttcttcatccaccatattaaacacctcattgccttctccctcttcctctatatctcctcttaatcagttatctaacactaatcaaaaccttccagtcttaacaggaacggattcacaatcttcttcaaataacattgaattcaataaatccgaaatacatctccgttgtctgttacttagtaatatgttcactgaacaaagtattaaagaatccatggaagaagatgaaactatcgaacagatattggaggaaattcaagctgatgttgaggaagaatgtggaaaatacggaacactacttgagtgttttctggataaggagaagatggacggaaatgtgtgggtaaaatactctcgtccagaggaggcctctaaagctaagatggttttccatgggaggttctttgctggaaggaaattaaatgtaagcttcatcaaagatgaggaattccctaaagccgttaaatcctag

SEQ ID NO: 3382 - DNA, 501 bp, Cryptosporidium hominis
atgaaattcgttttacaaaaagttaaaagtgcctccgttaaggttgatggccaaattgttagcagtattgggccaggattattactacttgtcggaataagaacagatgatgttgactcaaactctgactatttggttagaaaatgtctaagcatccgactctggccagatgaatcagatccaacttcaagcaaaccttggaaacttagtgttaaagacaaggatcttgaagtcttggttgtttcacagtttactctatttggcaatgtaaagaatggatcgaaacccgacttccataatgctatgagcggaaaagatgcgttggttatttttaacaatatggtagaaaagttcaaaagatcgcatgatccagaaaaaatcaaaactggctgctttggagaagaaatggaagtcagtcttgtcaatgatggaccagttacccttatattagaaaataatagtaagaatgatgcaggtagtgataagtccagtgtagcataa

SEQ ID NO: 3383 - DNA, 1227 bp, Cryptosporidium hominis
atgtttaagaagaagaacagaaaaaataagaaactattaattggaacagtaggagccaattatgatggaacaattacaaaatacaacactttcgaaactgtgattttacaagcatgtaagaagtattattcagataaaccacaagcatgtgatatgttgttattagaacaagaggcagaaaaaatactgaacacacacataaacgatcggcttttatggtgtaatgagtggttaccagagactccactggaaaagtttgatggaaatgccatagcaaagatattcttggcaatttcagagtttgaatatatatataactttaaaatagaaaaagaaatgaagatattgcagcttttaaattctgatatagttgatggatcatctgttgaatttaaagaaggttgggaatttcgagaaggggcatttgaaacattaaaatcactttgtgagtttacaagcaggtttataatagtttcaacctcaaagggctctaagcgaattaaagatactgttgaaggtatcctatctgataatgaagggaaatgcgagcttgaaatctctgcaagcgaatttgagtataaatctgaaagttgtgataccgttgaaactgctcccaattcactatatggcccttcttgtaagtatagagcatttagacaatctgtaaaggaaatcaataaacagtacaataaaagaatgagagacaaaatacactatgtaattgcatcaataagtatgaatgctatttctaagcacgatatttatattaaatcaattttctttgggaacaaagtcaacgacttagagtgtatcttatattctgaaattggagttataatagcagattctcctgctttagacaatatttgtgatgctaaaacttctgagcattcttcaattgttgaactatctcaacattcatcattatctactattgagaatactctaaatatcgaccactttatgttcaaaatctgccttttattctctattcaaatagttccaatttcaaatgatcatactgaacgaattcaaaattctggattaaaagtatacaaggatattctgagagatgaagaaggtattgctgatattagagattttttacgtgtttctaggatgatgaggcatcataactccaaaacctctcagtttagattcaatgggatattgttactggctttttcttgggatgaggtttcaagatttttcttccctaaacattaa

SEQ ID NO: 3384 - DNA, 1302 bp, Cryptosporidium hominis
atggaaggtctaacagtcaaggaaattagtgacgagatgactgagtgtgcgagatacggggagttggatgatatgaaatatatactagataattataagattgatatagattatcaggatgataatggaaatactgccttacataaatcgagcgcaaatgggcatctagatatagtatgcgaacttttgaatagaggagcatcgattaataagcaaaataataacgggaattcaccattacattgggctacgacaaataagaagaaagaagttataattaagttattaagtgacagaagaaaagcagaagaaggaggagcagatgttttattaaaaaattctttgaataagagtgtgcttactgaggtatttaatatgaacgacgaggatattttaaaattggctttagaacacccttctgcagataagttagagcaagaacattcaggatccgtcaaatttgatgaagatcatggtgaattaaatagcgattccaacgtaactatttctcaagaagttgttcatagccttacttttactagcaatgatatcgataaacttggaacaagacctataataaaatgcagggagttagctttaatgggagttaaggaagtgtttgatcagaatcctcaaaatgatactacaggagtacatttatggtctagttcaattgtagcttcctattggatagctaatttggtcagaaatgaaaatatatttgcaggaaaacgcgtaattgaattaggttgtggttgtggtttaatgagtttggcagctgccgtttactccagatacttttttgatagtcaaccagccaagctttttttaacagatgtttcaagtctatcattggaaaatgctggtattaacattaaattaaactccgcacttcttggcagtcatcaaaattttattcaagcaaagtacttaaattggtttgatcaagaaagctttagaagcttagaccctgaaaatccagaaattatgggatcttttgatattattctcggctcagatcttgtatacaactctgatatggaggttcaactatcccaagttatatcagggcttctagctattcaaggaacattttattatgtgcataggcatgatcgattatgtgcttcaaagtttaagcaagctcttgaaagcacaggacttgcttgccaagaaattcaatcccctgaagagtacactagaaatcctttatatggccaaagccagcagtttgctgattcattatttaacgaactttcttcacaatctgagttttatctcttaattgccagaagacaatag

SEQ ID NO: 3385 - DNA, 1275 bp, Cryptosporidium hominis
atgtataactcaaaaggaagcaatgaatttggtgaactgggtcataactttccaaacatagatctgagtttggaaaaagtaggagaaaataattatttttcagtaaggccttcagtattgcattcaataagttctgcatttcctgcaaataaaaggggtttaatagaattagttgtaactgagttatttaatgaattttcagtaaagcctgataatatggtagaagatgcaaaatatggattatgcattccaacattatattcagtcttactattaacaatttgccacgtgcataaattaaaagattttgaagaggagtggttcgaaggatttctcaaaagtaggaaatttcctttattaactccatttggatgtaagaacgaagcactattcaatcttttaaatgcattagcctgttttggatcatctttaaaaaagagaccagcagtaatgcaaggagttgagttggtgttattaagacttggaatatctttttatttttcattatgccaaattatggaccatccattttcaacaaataggtttattaaagcactaataacaggagcccatgagtggattcatggatctcaagggcaatatattccaaataaattagaaggaactttttcttcaagaaagaagagttcatttacaagaaaaagaagcaaagaattgattcaagaacatacagtaaaaagtctgataggaatttttgatgacttttctattaaactaatttgtaattttggatatagaccaaattgcattacttggaatgaagtaaataaatatgtacaaaatttgaaagattcttcattgtcaaacctgtttaaaagctcaaattcaaacggtgggttttttcaggaaacaacaatgaatgaatttataagatcagtttattccttatatcaatttaatgaatctaaaaaagattctttaatttcaagcaatatcgatacgaatcaatactatgaaaattcaaataatatagtgcaaaatactttgatattaacagataataaaattctgaagagggatttacctattgaagaatattctatgggttttatagatatctcaaataatttgagcagctatcagaaagaggatacattttcattatcagaatttcaagaatcagatgaatatgatagtgaagaaatagataatgagtttgatcaagaatttagtgaaaaattgtataatttagatgcaaatacaaacaaagctctggatgcaatttcatcaaaacttaaaggaatgtcagtatcc

SEQ ID NO: 3386 - DNA, 1008 bp, Cryptosporidium hominis
atggagacaaagcaacaagatgtggtggattgtagattctacgaaaataagtttcccgaacctgaagaatttgttatggctagggttaaaagaataacagaggttggagcttttgttagtcttttggaatataatgatattgagggtatgattttgatgtcagagctatctaaaagacgtattcgtagtgttaataagttgaccagagttggaagacttgaagttgttgttgtacttagggtagacaagaataaaggctatattgatctatcaaaaagaagagtaaatcccgaagatgttgagagatgtgaggagaaatattctaaaatgaagaaagtttatcagactgttcgccatattgctcaaaaggaaggtatttcagttgaagaacttagtgagaaattgatttggcctttacatagaaagtacggtcatgcattggatgctctcaaggaggcagctgttaatcctgaagcagtactcggagaatttgacttaccagcaagtgttaaagaagctctcattcaagatattaagtttagattatctccacaacagttaaagttaagagcaagaatccatgtttgttgctgcggctatgacggtattgatgctgttcgtcatgcaatcattgcaggacaggaaactgttaccaaggacgatgttgaaatccaagtcaaattcattgctccacctcaatatttggttactgcagtttcatatggaaaggctgcaggagttgaagcaattgaaaaagcaatggaaactattaagaatgttataactcaatataaaggaggagattttaagagacaaggtgaaattgaagttgttggaggcgatgatgagaaaaatgatctcaatagtgcatctgaatctgaaaatgagtctgattactctgattctgaagatgaagaggaagatgaaacaatgggtcgtgttgaagatatggacattccattcgatgaaaatgacaatgttgaggatgacgatgaagaaggcaaatag

SEQ ID NO: 3387 - DNA, 1545 bp, Cryptosporidium hominis
  misc_feature (64)..(65): n is a, c, g, or t
atggaaatattagagggctgggttaccaggaccaaggaatatttaaagcaagtaaagaactatnnttggtggaagaatagaagaacaaatgcaacttatcattataaaccagaggaagttatgggagttgaatggatacaaacaagttgtgaggatagcagttgtcaattaagagtatttatcagagaaaaatttgtttgcatccactttacaggttttaagactgaagattatagtgtaattaagagccattttgagacatattatggaattaatttggagactaaggagctgaatacaaaaggaattaattggggagatttaactattcacaatgataccatatgtataggtaatgaaggtaaagtaatgatgtatgttccaagtgttaatattaatcaaatagcaatgccatctaaatcagagttagttctggaattcaatgaaggagttaatgcaggagaagattgtgatgaattaatggagatacgtttattcgtaccaaatcaagaaaattcccttgatggaaattccttgtcatcagcagaaaaattgagatctgatttattaaagttgacaggaataggatccagtggatctatggacaaagtctgtcgttggaatgatattcacttattggttccaagaggtagatacgaaattgaagttttggttaactgcttaaaactccatggtaaatctttcgattatacaatcttattccaatcaatttccagactatttctactcccaaggcctggtacatccttggttaacctagtaatagcattagaaactccaatgagacaaggaaacacaaaatatccatttgttgtaatgcaatttgatacacaacaagatgaaaatattgaaatgcctttaaatctttcagaaaaagaaattcaaaggttcactgggctatcccctataatgactggtaaattctgggatatagttactcgtattttaaagtccctaacagggcactcaatcatagttccaggagatttcagatctgcatctatgtaccactgtattagatgctcatataaggctcaggacggtttactttatcctcttaatcgtagcttcatttttattacaaaacctgtaatattaattagatttgatgatatcttgaatattgagttctcaagaatgggtggtaatcaaactagattctttgaattaactattacaattaggggtggaggtgactacagcttcacaagtattgataaagccgagtataatccactcataaaattcttacaagaaaagaatatcagaataaaaaatcttcaggagagtcttgattcttcatctagaagaacaacttctagatcaaaagatcaggattcttctaagaaagaatcatcaaccaagtctattcttgagcaagacctaccaagtgatgatgaagatgacgaagactttgaaaatgatgaggattcttattcttcaagtggtggcagttccgatggagatgaggagggtgggagtgaagatgacgatgaggctgacgatgatgatgatgacgagtaa

SEQ ID NO: 3388 - DNA, 1131 bp, Cryptosporidium hominis
atgaaagttaataatataaaaattatttgctttctctggttaactatacttattgaattattctggtttaataaagaatgtcgcaaaaatgtggatttatttcattcaaatccaagttttattcgagttagaaccaaatcgatatttgatacattttcaggaatgtcaacaggaggaaccggatttaggtctggatggggaaatgttatttcaaatgccatttcattagcatttccctcttcctgtgtaggccaactgataaatattggttacttgtccaatgaacttgatgaggatgattatccttataatccaaattgtggggctcagagtcaatcaaataatttgtgtttcccaggaaatagctcagtggttactagagaaaggggagaaataaagttggaagatttaagaattggagagcatgttttaattagagatcttaacacaatgaaatttaagtacagcaaagttgaaataatgttacataaagataaaaatatatacttggatgatgaatggattcaagtagaatatttaggaatggagaagcctctagttctttctccaaatcatctaatattcatacaatatcttggagaaaaaccacacgaaggaaattgttattatcctagtcaaattgaaaaagctattggaattgaagtcactcctcaacttgagaaaaaaaagaaacttacttcaatccaagcaaaggatattagagttggtgactcagtaattatctattcaaaagagcgagttgggtgggtaacacaagtctcgataatttctaatgtaaacagtaatcaaaaaaattacgagtatgtgggaaggtatgctccattaacaactgatggctacttaattgtaaatggggttttagtttcaagctatagcaagcctttcccttggccaatggaattattgaatcctagtcataatcttatagatctactcgcaagacctattgttaatatagaaatccacttcaaacaaatttttgattatataagaaatggagtggtcaagattctcagatatattagcaatatttcatcagaatatacatttgatcaaagtattgcactctctttagaaattattagagcaatttctctttttgtcaagtaa

SEQ ID NO: 3389 - DNA, 1704 bp, Cryptosporidium hominis
atgcatggcagagtgaagagcgagcagaaggaacttactgaggaggaaaagcagtacatagaaagagcaaagcggctttttgatgaatgcatagagttaattaatcaagatcaaaaaaagtcaaccttttcagcaaaaactttggaattaactgaaaagattttgaagattaatacagaagtagcaactatgtggaatttcagaaaaagctacattgtttctgagcaaagcaatacacaacttattgataatatattaaataatgaattaatattgacagaaagtttgttcaaaaatgacccaaaatcttacaatctttggtcaaatagagcctggttacttgagtttattgtgaatcttaagaatgctgacaaaattctacttaaggttgaagaagattatttgaagaatatttcaaattttgataacttaaattatatacaaccatttaaagagtctttagctaagtacagcaatataagattaaagttattggtaaatgaattagagctttgcaataggttatttgaagtggatgatcgcaatttccattgttggagacatcgatcatttgttctttgttgtttaagatatatttctgttattatatcatgggacacctttctagaagaaatgcaactacaagaactagaattcctcaatagaatgacagaaaccaatttttcaaattattctgcttggcatcataggactttacttgcgtttggacaccaatttaacagcataaaagactttaatagagaagcagagtttgtacatacagcaatttatactgaaccaaatgatcagagtatttggcaatactatttttggttaatgggtgactttcttcctaagatactctttaaaaatgaacaatttaaagtaattccatcatttcatatcaaagatttacaggttgaatttcctgaaaacaaagatgatcaaatagtaattcatatcaaattttcattaccttgtttgattaatagttctgtatcaagcctatcaatagaatctgatgatggatccacaatcactcttgaaaaaggtacctgggaaccaatttatgaggactatgcaagcatctatggcttttttaactccaaactaaactctgattttgacaataaacgtaaaaaacgaactgcaacttggagttattctttatctctaaaagaaaattctcaagatgaaattagatccatcactaatttactaagtaattccccatccatttttctaataatatctgctgcacattctgatacaacatatacaaacactccatcttggaacttaaatgacccggaatataaaaatgaaacgttttcatcactcagaattagtccaaaattaattttggatgaatacaaattctacagttttaatacacgtacaaatgaaaatacagttacttgtaaatattattttcagtcagaatcttccaaatctcaacttagagaatggattgaaattcttcaaagtgaatttgaccttttaaggagcatacaagaattagagcctgaatgtaaatatcctataatagcacttaagtatgtaaatgacatctatcatctatgctctccgccagatattgcggagaatgaaaaaatgaaagtggatccagaaatgataaaactgctaccaactatagatcctctaagaaaattatactatagtgaaaagttcaatattgcataa

SEQ ID NO: 3390 - DNA, 594 bp, Cryptosporidium hominis
atgcgtattgagaagtgttggtactgttcaagtaatatatacccaggtcatggtgtaacttttgtaagaaatgatgccaaaattttcaggttttgcagaagtaaatgccatagacattttaagatgaagcataacccaagaaagtccaaatggaccaaggcatatagaaagactcgtggaaaagaaatgattatggatactacatttgaatttgaaaagaagaggaattgcccagtaagatatgacagagagctatatattaagacaatcaaggcaatgaaattggtggaaaagattaaggaatcaagaaaggagagattctacaagactagattaatgaaacagcagcagacacagaagactttagttgataaggaaactgagagaaatgctacattactaaagggacctgaaattcctttagcacagacaacaacaatgagtgatgtttctcgtcagaaagctcttaaaaagagtgagaggaaaatgaataagattgttgaaaagagaaaatcatttatagataaatttagtggtaacacagatgttagcatgatggatatagaggacgatcaggaggaaattgtcttataa

SEQ ID NO: 3391 - DNA, 561 bp, Cryptosporidium hominis
atgtctcacggtttaagttatgaggactgcaatttccccattgtatgcgacagatgcttgggtgaaagcaagtttctcagaatgacaaagtcaaaccaagaaagatcttgcaagatttgcaatcgaccatgcacaatgtttcgctggaagcttcacaattccaaaaaatacaatcaaaccacaatatgttattcttgtggtaaaatcaagaatgtatgccaatcatgcgtaagtgatttaaactttggattatcattgtatgccagagatgactatataaagagtaaaaaagaacaaggagatgaagttgctcttcaaattatgaatattccggatagcgtggataacagggatcatttcatggagaataagctgaatggaaatgatgaaacctttattaagaaaattgatgaaaaccaaaaaaagagaaaggaaatattaaaaaagattttggcaaaggatgacaaaattgaagcaaaacaagtgactaattatagtaaaaacacctcagattgtggctctagttctaaaactacaatcaaaagtatttcgaaaaattga

SEQ ID NO: 3392 - DNA, 1995 bp, Cryptosporidium hominis
atgagcgtttttagtgcttttacaatgccagtgctattggcttgctggtcagtttgcataattttgagcatattagatttgtattatctgaataatatggataaaaactggtcaatatatgaccaccaactattggaaagcaaggcttggtggatttgtggaatcccattatcagtatactctttattggctgagatttcattgttaattgcaacttcattttcgtatatgaaagctcaaaatgaaatagagtttgaagatggggaaagattcaaagagtacagaagctataattcaaattatacctactcaaatctatacgaaaatgctgagggttatacttcttctattttgaattggatagatagcattggaatatggaatagaatagttttcatgatgactaactttattgcaattgtgagttgctacttcttgtttattggcttatttgagtataatactagatcagtgacatttttactcaagtcttctgtaattggtttagctcttattttaacatggatacctggagttcttagtacttatacagaaagtttcagattatttggaatagttgttgcaagttctattgtgttcatatttatgatgtattcaagaaactatcaaattactggaaaagtaaaagacctaacttcagaagttatgaatattagaaaactaactaaaggagaggaaataatcaatagaaggattattgaaaggtatgcagaatcaggaggaaaatattacacaataagtacttcacctgcagcaattgcaactgaactggagtggggaaaagcagctattcaagtacttaaagacaataattcatattttgactgcaattttgatcagaatagaaattcttggacaagttgtgttgaagaaaaaatcacatcttatccaacttggctaattggggacaagacaatttctggagtagtttcaccaaagacaattgctcacatggtaaatatcaatttgaaggagttatcagaggaagttcttgccttagttcatccagatgataaaaaggaaattgagaatagaatatctgacttttcggaaggttcaagtacagaggcaggcacagatacagataccgattcaacagaagctcaaggcgaggatatttcaaaagagctaagctcagtttcatttggagagggaaaagttgatttaatagcaaaagagcttggggaagaaattagaaataataatgaagttggcgatgataaagaagataaatttgagcaattgagcgaggctgaagaaggaattcaaaaagatgttcagaaaaataagaggaagaagagaagaaatgcgattaagaaaaaaaaggccaagattcaaaataaacaaatctccaagaataaggaagaacaggaggaggaggagttggcagaaagtatgtatgatcagccatcattcagaggaatgagcattctgaacaaattagaagcaaataataaagctggtggagaaaagattgtaaatttaattgaggcaaatccagagaatagtgaagatcagggcttaaaggaaggccttgaactaccgtctaaagaagaatttgagaagctctctgatagcattaatagaaggaatgaggagatgattaaagaggaacaaaagttggagcaagaagcagaaaaggaaattagagatatagaaaacgatgataatgaccaaatagttggagctgaagttgaatcagagattatcaatgatttgaacgaagtagattctcagagtcgtgaagatggaatgctcaatgaacttcaaaaagagaatagcgaaaggttgaccacaccaacgcaaggtgagcaagatgttgaattgagccttcaagttggccaaaaagactcaaatgccattaatattttaggcaaaactaccccaggtcaggcagcagagccttccgagcaatcatcttccagtgatcatgtagtttcagaaatgatacaaagtgatgagataaacgaatga

SEQ ID NO: 3393 - DNA, 1581 bp, Cryptosporidium hominis
atgacggagcttatcacagaaaatgaaacagggagattgaagcattatagttcacatggagggttcggaatacctaaatatgcaggagaaattatcattgttagatttgaaagatcacaaatttttcctgaagaaaccaataatgatgattacgataactggaagcttcctgaagatgtaagttgtaatgtttggatgatggatagtatcggagaatttattgactgcgtaactgatccagacaatcctgcacttgacgggtgtgttagcgttagctcagatattgaaagatatttcccaagagcaaaaatagatctgaatgcagttcaatcatcaggtaccggaataatattagtaactttaaatactaaaactagctcaatatatgaagttatgaagaatttaacagtttacttggatgtagtaaatccttcaacttttagaaataaagataagttttataaagcagaggaagaaaaggaagtatggaatatcttttcgttttcacctgttgaagataaaagcgtttatgatattgatgaagattggaacaatattgcagtaatgatgttttttatttatgctgataggtggaatatgaaacctctttcccatatgtatttagcaaatagtttaattgaaaaaattaaagattccaaaaatttatgttatgcactaaataacatcattttaagagatttagaacttccagaaggttgcaggtctattagatcattattacttggagatgatgaaggtattaataagaataaaaatgctgataaagttgaaaaccaaattttaggattggatgaatctgaagatgccaatttagatggtcctttgcttgtcaaacattcgagtagtattacagattataaataccttctcaatagattaaaggagagaaaggattatctaaaggagtttctcacaaaaaataaggacaaaatactcgaaggaaaggttttgattgatcaggatggaaaagcaaagtattttaatggggacttcaattcaggttcaaataaaacacctacagaggagagttttgttgaagatagtgattcagaattttatccacagccaagtagtttagagtctacaaataaagatattcaactacttaagcaagaaatgagtgaattacaactccagcttgttggtattatggatatgttcatggcaacctcacctgcgtcctttactgtacacggaacagcaaacgagattacatataagtcccttttagaagagattcagtacatggaaagcactttaattttacatagtcaaagcttaaaagccaagaagtcagaggtagcaaatcaatttgttgtaacagacaatgaccagatttcagtcttgcagcctgttatttctaattctggatatgcacagtttattgaaagaatggaaaagcttagggagtctgttgagctttatggagtcaaatctagagaagctgtaattgataataaaaatttgatgagcgaatctagagaatatgctttcaataaaattaaaagtattgaaattaggtttgatcagttaaaccacgagtttaacaattttatattc

SEQ ID NO: 3394 - DNA, 297 bp, Cryptosporidium hominis
atgaatagttctacattagaacagtttatcaacaagactgtgagcgtattgacagttgataacaaagtatatgttgggaatttggtagggtttgatcagctaacaaatatagtattacaaaattgttccgaaaagatatataataaagatctgaacaaagtagaaactgtaagtatggagtctcttgttttacgtggcgattgtattggaatggtaggagagggatatgaagatttgactcaagactttgagaacgaccaacaagtatataagaggcaaaagatttcagattcttaa

SEQ ID NO: 3395 - DNA, 1977 bp, Cryptosporidium hominis
atgtatgtgggctctcagaagaagaatggagttgtggaattagaacttgtgggagaaattccaaaaactgaaaggttagataccgatataaactctcccgtttcatatgatgatttattcgaaattataccaaattctagaggaagaaaacgcagtaatgaactgaagattgatatgcccgaggacttaaactctcagatggctgaacttctaaaattttgtggtattaatgaatttgatgatgaagaatccctaaattcagaagaaaacaataagcaatcaaaatataataaggactctaaaaatgataaattacttaaagctcactctataggtccaccattcctagtcagattaatgaggtataatttattggaaaataagtttcctaacttttttgattttggggtaaatttaactttgcctgcttcttttcaagtctctgaatatcgccttctaaagacagttcatcccagagataatccatggtacaaaggttgtaataaacttattttattaggaatcccttcatctttacgtccacatgacttgaaggaaattatcctatcttttgctaataaaccagggtgtaatttaaagataagagaaacagaagttgaaaattctagcccagatttgaagtcttcatcccagaagtccttctcaattacagagttaggtataaagaacttcacaaatttgtttacaacagaaaataaaggccactacttaaataatttatatcagccttctggaacattggtaaagagtcatatgaatatggcaatattagaattccaagaagaagaagatgcatttgaattttgggtggcgttaagtaccggactatttcaatgttatggaagcgttttaacagcaattcctgacccttctggaaagagaattcttgccgagggaatgttaactgtattttccccaaaaaatattccacttatggattctattgaatcttttacaaaaaatattcttcaaaagaattgtcaaaactcagatgaagtagaacttgttttatcttttccacttattggttcatcacgttctattgatactttaaaaaatgaattaatccaaatatttaaagatttaccagaatctgacagttatgtaattgaagaaactgtatactgtctaacaatacgttctaagactcaaaaaatcatggaactaattaacaatcggctttttcaactttgtactttcaaactgacctcagaatccaatcagatgaattttatggatgagaataatcaaattataaatactgcaatgtttattttcaaggataaaatttgtgaacctgtaataattcaagggaattatgatattcatccaataaagcaccgtacaattgagctttcaagctttaataaaaagcatgaaaagaactctaaagtcagtttttcctcagtaaaccagaatgatcaagacacagagcctgttgggtttctttttaagaaatttgaggaattaagagaagctcttcagcatgggctagcaccaatctctacaaactctggagaccagaacattaactctgaccaaaatggttcaaataacgctaagagattgcttagaaccccttcagaaatttgttcaattggtgactcgaattcttcgcaaatagcatctaacacaatgaatactatcaacaagaaactttctggagtccaaatagatggaccattaaagaatgaagaagaaaatttcgtacaagaatatccagattcgcattatagacgctcaaataatagaaaaagaactctcgaaagtttagatgaggaacctgaacttccaataggttcaaattctgacaataaaaatgtgaacgggtcaaataaagatgaaacacaaagatctgaaaacgataaagctgagaaatctacaagcaagaggaaaacctccgttgaactacctaggaaaaacattaaaagtagctcatctaggagagactcataa

SEQ ID NO: 3396 - DNA, 1176 bp, Cryptosporidium hominis
atggctgcaaaaaaaattaaagaatctaaaaaacaactgaacgaagaaagtggagttactggggcagagaaatcttttaatgataataattctcctcaggatagtcattttcattcaaatgaaatcgaaaagctagatgagatgattttattcccgccagtaaaagttgttgaaatacgagacaacatctttcagaggtcaggggataaagaaagggggaggatggtgagtgagtatgtggacttgagtcagattccagcaagtttgttgaaaaaactctcatttatacctacaagcgaagtgcaagttattaaggaagatagtaatttctcaaattctgaaagcgaagaatctgaagaagctactaagcttggctcaaattttgatcatttggaatttgcggattatttggaggaagaagatcaaaatatcaaggtaaatcaaactccaacacactttttcagtttaacatttaatcaacactctttaaatctattcaaggaattcaaagctttaaaaaaagtggtgaatgaatctgcagagtacggagaaattaaaccgacattttttattggtgaaaagaaattgcacataactttgggtttagttcgagcagaaacacctcaagaacttttacagtgtgaaaatgcattattcgaattaaaagaaactcaagagtttcaagacattttggaagaatcatcttctgaaaagggatttcctgtggagttacatggattagggtactttggatctcctcataattctagagttgtatatgcaaaaatatctgaaaatcataaaattgcaatgattaaacgactttggattaaactttgcgagatactgataaaatatggggttaatttaacaatatctgactctaattcagagattagtaacaaatcacaaaatctaaaagattctatagtacaggattataacccacatgtaacctttatcaatacaaaatacggaactaaaagtggaaaacagaaattaacatttaattctagtaatcttgtgaaaacatactcaaaaaaaagctttggtcctggatatatctctgaaattcagcttaatgaattatctggaattcaagaaataggagtcataagtaatgaagaacaggtatataaaactatttcctctattaaaattaacagaaatgaatag

SEQ ID NO: 3397 - DNA, 801 bp, Cryptosporidium hominis
atggatcaaattattgacgatgatgagtacaattcaattttcccacttgagaaaattgcttctcatttgaatatttccttaaaattcctagaaaatgctcaaattcagtggatgaatgaaaaagaatcactccttcgtgaaattgagagactaagaatggaaaatagaactctaagaatggaagttagaagtagtgaaaatattgaaaggaattctgtttcaaatactccaaataacaacagaattaaaagttattatgtaataaacaatgactctggccagattattcctatccctccaaatccagtaaatcaaatagtcggaagaagctgcagtagttcaaacaatattaaaagagtgaacgatgttcttgagattcaaaatattactgaaagaaattcgaatgttattccaaatagaaattcgacttctgcaccgagaagtatccaaaatgatcagatttctccagctacaagttcacaaaactgccgagtaagacatatacagcttgaagacgaaaatagcgaccatgaaccattagaggaaaagaaaaaagctattaagtatagagaagttggaaaaagtattggcaaaaaagaacaaagaaagaatcttgaagcattcgagtgtaccgagtgttctaagttttacaaagctattaataataatagaacatcaaatagccaatcaatgtgtaagcatctaaagcaaagccttcttcttcaaaattcaggaaggcataggtttaaacatcctccaactaaatctcccccagggtactgggatttggatgaaatttga

SEQ ID NO: 3398 - DNA, 984 bp, Cryptosporidium hominis
atgatttgtaatattgttaagtatacaagaggcagaatttggtgtccaaagggcttcaacgttatttttcctcctaaagcactcgaaaaatatgagtttggagaagaaattcctgaagatgagacatacaaaattatttctggaacatttaatgagaatgatatggtatcagatgaagtagttgaagatatctttgaaactttaaacgaaatttcagaaaataagaatgatcaagagtttccaatcaactttaatgacactagttcaagaggtcaagacactatttcaaacaatttgttcacttcctcttctcgttatgtgaagaaaagtcaagcagacatccaagctgttcaaatgagaggtatgggaattgatatggaaaatgatgttgagtttggagctaacgaatttgaaaacagttcaaagaattgtatcaaagataaaggaatttgtggagattccaaaggattaaaagctaatgaatctgagattggagtgggtaaaaggaaatgggatgatattagtaataacaacaatataatgcttagaagactccaagaaatggcatttggaggaacattagcgacccaaatgttcgagcctggtttagaaaaagaattggaatttggtcctttatcgggggtatatatgggaaactatggtaatgtatttggtaaagaaacagaagaagaaataattatttctggaaatcttgggcaacttatgggtaataatcaagctacaactgctccacttctccagtacatggagaaaaaggcacaattttttaaagagccagcatgctctctcgttgtagcggtgcattctgcaaattgtactcctttacaatgtaagtcacccttcttgaaagaaataaaccacatcttaagagattgggctgtctttgtactgcaagctgaccccgattctggttctaacttaatacctaatggaaaagatttaccgtttactaatgccggataa

SEQ ID NO: 3399 - DNA, 531 bp, Cryptosporidium hominis
atgaattttttgatattgctactgtttgttttaggttttagatatgtattgtcgcaaagaaatgtggcccaagaaaggcatgacttttcaggatctacaaacccagctgaaatgtatggacctcaaaaattaaagtcagattacaagccccttccttggaaagacaagtttcccaggtatgatgcaaatattacagagattcttgagcttcataaattgacggaaaaaaaacctgaatttgaaccaattttaactagaaagcaagaaaaaggagtagataatagggtacctgaattaattagacctgttcaggtcagatgcccaaaaggctggactccttgggggccactttgtatggctgaggtttccttgggaccaagaacagagtgctttggtgatatgggaagatttgttagctcagcgtcaggcactattcctaaacagtcatctttatatccaggtaattttgcaaaatattctttttggcttaccataataaatttacttatattaaatataatatatttttaa

SEQ ID NO: 3400 - DNA, 2673 bp, Cryptosporidium hominis
atgaataaagagattgaagtatccggaatttattcattacctgagatagataagttaataggagaaaaggtgtttttttcatctgctctacaaaatagtctttcaagcaaaaatgaacaagaattaaaaatacatagttatctaaatcaagatttaagcggatctatcttagagactgaatcaattttgaataaagtatttaacactgataacttttctatgacggattcgtctattttggagaaaaacgaagacaatatagtcgatgaaatttatcaaaaagaagagttaaatagtcattacgtctcagtagaaaacactctaaaagagaatcaaagcattgaaaactctttgagtgaattttcagataaaaaaggagtagcaactcaagatgatttaaacgagagttctgaagggaaaagtaaaattaatatcaacgaaatggagcatcttatggatgctgatgcaaactctgttgggtctgaggtggattctctggatggatatacaacatttgattatgggtttgatgggagtgggattatttcttctgtggaagactgggaaagtgacgataactcggtagtttttagatataatgaaatggcctggccagaagaggccatattagaaggagcagaaacggatgcaaatgaagttatagaaaatatatgtgaagaggatgacccagataaagatttaggtgaagctaaatttgaagaagaaattgtacctaaagaaagtactcctgaatgcgaggattataatcaaatctcagttaatgaagagaattttattaaagaatccgaatttgttagcagtgaaatcaaaattggtgatgttgaatctattggcagaagcgatcaaatagatagtgatgaaagagatattatttatataaaaagaagaccaggttctgaaagcagctttcatgttgaaggagggatgatgcacgtaccttcagttgaacaagaggtagtactggaaaaagttgcgggagagagcgctgaggcttctccgtcgtcgacaaaattcaggaaatggctttcaaataactcaggaacctctaagatccattcatatttaggaaattttagaggagaaaatttcaaggatggctctgggatatctggttcaagtaccttgaagagtttatttaaagttggaggagtttttagaagatgtgggtacctttcaaactcttcttttaactcaaatcttgttacaagtttgggaagtattattaatcaagcagaaaagagcaatagtcggacgttcaaaggcgatgattctggcctatctcatgtagaagtcttaaacggagctcacgaagccagaagaaacttgagacagcgtacccttccgatgaagatttctacaaaatttcaaataagcaataagacaaggaaggcaagggaaaatgatattggatcaatttggctgataagagaaatatatttatctttaacgcctcaaattctaaagctatcaatgagtgttgatggagagtggttgattttaggaagtcaagatggtagtatacgacaatggaagtttaaaggagatgaatttggagattctggaatgatttcgtcatcaggtcatcaaatagagccattctttaatgaaaaggaggactttaatattcaagctcattcaaatgcaatcatatctttgcactgggagaataatgaaggaagccataggttcctctcaagcagtatggacagaactgtgaagctttgggaggcaggctctacagaaccaaatgctgtaattaattgctcagattggccgacatctgtttctttccatccaatacaaaaaaatattatttttattggctcattggatgcatctgtacagattttgagactaattcctaacgatgattccccaaataaattcctaaccaaagtagttgaaacgattagagtacaggatttattgacttctttatctatttcacctaatggtaaatatcttgcttgtggatttaaggatgggggagttgcattttatgatgctagaactttaaagtatagatgcgatgtggattgtagaaatagaagaggaaaatcctcaaaaggcagaaaagttagtggtatttcttggaaaagagacaataaaagtgttttagtaacgactaatgatagcagagtgagattatttaatttgagtgatttgtcaacatttgttaaatttaaaggccatataaatgaggaaactcttctttctgctcaaatttctaatgatgaaaaattcatagtctctggttcggaaaatgggtacatttgtttgtgggatcttcaaccagattttggaagatccatttttggaatccaatacaacaaaaataacctacatggctcgaacttccatccaaatgttaccagcaaccaaatttccttaagatatgataggattaacattagaagaggtcccacgcaacattgtgttgattcattcaaggcatttgattcgtctctaacctcgactatacttgctcctcctgctttttccaaaaaaattattaaattcttcaaaatgaatcaaagaaattcattgaattatccttcatttggaacctacattaatgaaaaaaatgctcaaatatttatcgctgtaaacagaaatggacaaatcagaatttttatgaacattcctaattaa

SEQ ID NO: 3401 - DNA, 1572 bp, Cryptosporidium hominis
atgagtgaaaatttgattgaacacattttgaaggacttgcaaattcaagtttgtgaggaggttgaaaagctattagaaccatttaaagaggattatgatgattattctgacaaacttttaaaacttttgctttcagtggacctatcaaaaattattaagaaaggaagtctacctttggatattcattctttgcataaaattaacttaaaaggagttcatttattgcaattaatagaggctgaggatgtttccaaggctaagtctagaaatcgattctattttaactcagatttatctaagatggagcaattatcaataactactccttctaagaataggatgatgaagctcattttaacagatggcacaaatgtatgctctgcaatggaatataggtacatgcctgaattagatgaattcataagcttttggtgcaaatatagagaacatgttgaaaaaaatggagattcaaatcagcgagataacaacgcccatatattggttcttttgtcaggtgagcctgaaatcaaaagaggagtcatgcttttattacctggaatgcttacttttatcatgcataaagatgctgaacaaagtgtttatgatcgagtaaaaaagctcaatgaaaatacaggagaaaagcctaaaagcggctccagctcctctattttgtcagaaaacttagttaagaaaccaattaaaaccccagaggggatcttagatatcaggtcatactcaaactttgtgatttcaaactcaggcttaaaggaaaaaaaagataatgagatatttgaagaaaactataaagctatttcaaaccaaaaagcactgaatcaagttaattcagattcttttttaagcaactctttgattgaagacgagttattattagagaaattagaaatcaaagatgaatgctttatagaaccagataactctgattctgattctaattcagttattgaaatttttcctaagtccattgaagaaaaggaaaatgaaatattggatgtcggtattgtagacgatttacaaggttattttgactttgaaaattatgctgatattgaaattagagaggatttagaatatcaagatgaaaatttcgggggtttaaatagctcttatcttgatataaataataatcatgaatttaatttatcggaagctccatcggcattacaagctaattctgaagatttaaatgaaatttatcacccacaaaatgaagatgaattagtcatttgggttgaagctgttgtaattaactctagaaggagtgtaaatagtgatgaaatgttccttgaactaggtattcattatccaatgcctttaccaaagccgtgggatgaattactattggaggatgtatgtttaaccaggcaagtagccgagagaatactgtctattgaaaacaataaaggatcttctgaatgttctaaccctaatttcactatggataatttattattatacgttcgttttattcagggaaatatttgcctgaatgcatcatttgattcaagtaataaattaaaaatagtcaacttagttggatttgttcctacttga

SEQ ID NO: 3402 - DNA, 1746 bp, Cryptosporidium hominis
atgtttaaaaaacttaatataaaagaaaagggctgtgataatgaatctttactctctgacaggtttcatattcagaaaattcttttagattttgatagggaagcatccattcatctagatgacgaaaataccgaagaactacttattcagttttctaagatttattcagaatatgtcattcccttaactgcagttacaataaatgaaagccttgtaaaaagttggagtttgtttgatatttatttaaaattagaattgtgtggtggctgtattgaacatttcatattagcatttcaaatgatttctagtattattaccacaaatccaaattctgtatatttattatttgctccattaaatgaaaggactgatatatgcccaataaagtacatatgtttgatgttaagtaattctttttatggtttagatcccaaatcaccagaatttgaaaatttgttaactagtattagttttttacaaactgattatattggaaacggaattgaagatgaatttattagaaatttagaaaatggccaaaaagacaatttgaaagctattaagaatgaagaaagtgaaaataagaaattcaaattagaagaattggcagtaaatttaattactgactctctagatttacttgagctaatcctaaagtacatagatgatttatcattgatgtatgaagtagatttcaagcaaactgaaaattttattatttgcattaaagctttaatagatacgtactcccctatatttcaaacaattctctcatctaaaatgatgttaaaattacatgggaaggaaactgataagattaaggaaacacgaattattgttttgaggatttttgagagactggctttggttttatttaatacaggcctacttccttactttcttgaatcccttaataaagaaatagttagtaatcaaggtactgtttttgaaagtttgatggatattctatctccagattttccgaattggtacacatttaagtacaaagggctggaagaattaaaaaatttcattttttctttacagcttcaatttactggattcttgtttttaaaaaccatatgtaacactatagaagagccatcttcagctgttaatatgttcttaaatgtaagaaagcatcatataccttttgatgaactccctgactttatctcagaatccaattattggtttagcgacattaaagacaaactcgactttgataaagaaaacactatttttggaaatttctcggaatatggaaattctttaccaaaatatgtaaacagtattttctccaatttattctatagggtagctgctgtagcgtttcataatgggctcaaactccaacagaatatgatcgatttttctcaaatcactgaaacatttcatgaaggtgttattggaagtgaaactctggctctaaaaagactttactctcttaagactgatctttttattgttaatacccaaattattacttttataatttcttcaattgtttcaatttctgcagaagttgtttccgatgatgaatttataaagtctaatcctacagcagaagttatttctattcttcacttgtttttagtatggatctgcgagtttgtatttgattacaaatctaaaattccaatattctatcatattcttgaggaaattaatattataaaaattaggcttcctatactatacaatgcctttaataataaagattctacaaatgatagtaaaatatag

SEQ ID NO: 3403 - DNA, 9687 bp, Cryptosporidium hominis
atggatagagacagatggattggattactgagaaattgtaacagatccctgctttcattccaagtatatgcaaaccaccagtatacagaaaaggggagtacccaggaaatagaaaatctggttctgaaagacattcctctagttattcgtgagaggattgagtattatacaaaaaaaagtgttattcctcaaaatatttctcctgagagtcaagtattttcggaaaaggatgtaattaagacaatttcaaattgctttcaagtagaatcagaagaagcctgtcgaatttttagaggctttaactatttaagagaaggtggtttcattataagatttacaaatacagacgaccaatttttatcaaaagagatcataaatagaaacgggaatgatcctgaaggtaaatatagtaatgctggaacaaactctggaggagttttggattgttttttttcagatgtggacttaataagcaaaatatacgacttcatattacaagaacagctttctctactagactcagtgaaattcatgtatgaaaatgcaaattttgaaaaagaacattcaggctatggagcagttttaaagaaggcttgttttggagaagtcctctgggggaaagaccaagatcaaccagcaaaagaagggattggaaaacattcttcctcattcaatatactagatgagctttggagatggtactctaggttagttaatgaccagtttgttgattttgacaatccagaattggaaagagtttttggaggtcctctattacaagcatattctagacaactactcgagtctaatctgttacacaccattttggtggttctccaagctcataaaggttatatgggtagtttaactggtattcaaaagaaaccagaaactgaagtgagctctaacaataataatagaattcctattggggaatctctttcaaggtcttcacctcttaacagatgtagaatcatcatttctgaactccagtcaaaatgcttccttggtagtctttatactttatattcttctaacagtggaattggcatagggccactcacattttgtgatagcagcttggctcactccacatctatgatagatcaactcagacaaactgcttccaatggagtgcttttggctagctctctaatactttcattctctccaaaagagattacaattaataatgaagatttgggctttttaatcaacgttatagtaactttattacagtcaatatgttcgaatgattcaggagagattttatgtgatattcaacaagaaaagtataacttttctactcctgcgagagctaaagctgatacatttagtagaaatgctcagaaacaactatttataagaggtaacttgcttttggttcatgctaaggttgtaaaacccttattacctgctctaatattcagctatgcttccatagttgtacaaactccaaatagagattcactcttggctcctattcttgaagctccatcattctttcaatcctctgcattttctgattctttggaaagtatacttcatgctctcagttctcaacatcctcttaaacaatatatttcagtttcattactttcaagctgtggattggaaaacaagacaactcaaaacaaaactttagatttggatgatgcttacttttcagaagattttaataatgataataagaaaaatatcattctgggagaagccttcggaacatattaccagcatttggttctttatagtataattagaaacacagtttcaacattttcactcaactccttacctttagttgcaagaatttcgaaacatctaagtttcttactcagaaaagagcctagactggtttatagagaatgttggagaggggactatttcagacaaattggagtccatttaatcattgaattattcatgtcatcatttccatacggaattgtcgagtttcttgatctcttaaacagtcttgttcctgactttaattcaatttcaaaattcaatcaagctgatatcgatatggccaagcaatcattcaagctttttatgacttttttgagaactccaattagaaatatttcctttcctccatacctttcctctcttgggttatctcctattcctgttaataattggaatccggattcaataaaaaatgattctgaattccctgagcttcctctacatttacaagtatcacgcttagagacaccagatttggctcttggagcatctttttctcaagcatccctcgcaggaacgcttgaaggatgcttgttggactttttagaaatcaaactcaacgatgtaactccgctttctgctggatttccaaatgcaagaaaatgtctcacaccacttagagtacttcctattggagttgctcagtcagttcctttaaagtcgcttttaatcgaaaactcggaaactagtttttcttcacctctttggtcaaattctccctatggaacttcttatgactttcctgaagttgaaatgccaccatattaccacatttacaattctagaagcaagttagaagaaagtaaaaagctaagaagttccgatcttcttgatatgaataagcttagacttccttctgaacttaataataactcaacagaaattaggcttggagatttggaccctttcacaataaaattctgttgtaaaaatattcaaaatcctgattctttgccatcgcttctcaaaattttgttgttgatctgggaatctattggcctttcattatcacaatttggcggaaacttgataaagcaacatattgaaatgttggtttcacttagcgaacttatatatagacttgcatcattccacccttcaattatatttgttcttgatcaggaaatcttctcatggaatgcactaattccgaatgctacccaacaaggattaaaagcttccactagatttggacttttaccaatcaaaactatacaaatgctgaagggaatttgctatctaattaataacaagactaatggagaggagactgtatcagttactttccaaactattcctagactcattaatcttcttcaagtatccctccaacctattgatttactttcaatcgatgactcagttaatgggaactttttaaagcttcaaattggttctaaagagtttaatagagaaaataaacaagtatacaagcaatcaaagttatttagctttcaattcccatggagtcaccaatctcacgatataccaatgtactggcttgttcctctgttggtttcatgtcttggttcgaaaactcttgtggatccggctacacaaagagattcaggttattattctccagtgcttaaaggaatacagggattcaacttggatgagctttttaaccttgtatcaaaatctctagaaattgtcgaaaagcagctgaagtcatatccaattactgctcaaattcttgaatttattgttactttacttaacttttgtcctgcttcattttggggtctcggatgggacagacatgcaagacttctgctttctactttggaagaatttagctatagttcatctacaacaaataagattattagagatattcagtttctaattaatgactgcatattatatcaacaatgctctgaagagttggagcagagagatttatttggattttttggtaggatctccaacttttcaattcataccgttctttctagaatttcaagctggcaattcaatttggagtcagaaaggaacttgttgtttctacgctcactttcagtgtttggattactattaaactcaatggactctgctacaataataaaatctgacgaagattatgaacaacaattaagtgaaaacatgataaagactgaagttaaagatagcaactcttatagcctaaaagatattgttcccagtatttcaggaattgcgtcatctaatcatcgtgctattatagctactcttttaaaacacatcactgaaactggcttgataccttcattgcttacaatactgtcttgtgaatacagcattcactcccagtcatttagaaggtcgcggtattcgcagttagcaaaagatgaattgaatgatattcctgctccttgggaattacttatttcaaactctgtagttgcccaggcaatggaaaagaatgaatctctttcctttactctcgctctccatcttcaacattcaaactctcaagttatgtttttagataaactcctcgttcctacgtttgaatgtagtaatactcttcctaacagaagcggggaattattctcttctccagatgttattgttgctcaacaggttgtaactgaagttctcaaagtaattcaaaaattgctcaactccgttgccgatcttcaaaccagttcagatatgctttgttctctaagaacagctctagttcaatggattttatcctcttcatcaaatcaaggctctcagatttcaaatagtctgctgaattccccaaagtttagttggtcagatactgacattatcgcaaatcatatacattcaagaatatcactgctttatctttcaaagaagccagtaatgaatttagtaaagtctttattttcactcatgcttagctttgtcccctcatctatggcctcaaatactccaattgttgcagcaaagcttctctcttcattctgttatatactttcatcagaatcttccgtgaataactatgagcaaagccaagtacaaaactccagattggacataattcttgagcaaattctcaagccatctgcatctctcggttcaatacagcaagatttcttactttcactaacaaatactaaactatttccattgctgatcaaacttctatatcaagagctcgactttgtacttttagccccgattttcagcttcttaaagacctttgacttctctgaaactaaaataaatagtcaggacaaaaccccaattgaattttgtaaagtggttttggagctcattaacttattttctgcatcccatccttcaatgcttattggatcaactaaaagcttttcttttgaaaggctggattatgttttggctcactgtaaatctaatctcactatttgctctggtaatcagattaatgggtctccttcatcctcttttagtagaatcgggttaatttgccatgctatagttggaatccttgagaaatgcaattcactactaacatgtatcaacaaggctaatctagtaatctccttaaatatgctcaatattttacatctaattcctctttcattaagtatattgaaccaactttttgaaaatacaagatcaaaggatttcttgatcagggaaatgtttattaaaactaaagataaagatagcagtccatcagccacttcaacatggaatattgtcatttcagttacacaaaatctaacttctctttggagttgtcttcaacttgattccaatatttctcaagccaagttgcaattgttaactataatatcttcatctgttgcgtctacataccacttaacatccaggtttatcagtgtatctactcatctgagctttaaaaactatgacaaacttccagttttcttaagagaacgaaaaatatttgattttgtcaagtaccttgtttcagacaaaactataaatgaaattcttcactcctccaagagttccaagcttatttttggtttattccttagatccaatagccatttttcagaagttgaagataaactaggagtgccaattaaatattgtgtattcagtagaagcaactatgattccagtaatgattcagaatcggctaaaactcaaagctcatactcagataattccttggaacaatttgttaacaaatattactttgaaagatacctcaaattctctcatttgatcatttcaaatgagacaattaacaatctcacagaatttaatatatcaaagatttgcgagttcagagatgaaagtactaaagatttgagatcaagttcctttgatcccagcagccaagccttcaagcttcctccttctaacaacagtgaaacttctcagcttgctacacttgaaatggtatgggaatctggacagcttttagctccaaaacaacacttttctccaaataatacgagccttgaaaagaaagaagggtctttacatgttagagatgaagaatcacttatcaaacactctgttgttagttccagaattaaggaaaggccagaaactttatcacctctgcaaatatctaggaaggaggcttctaattcaggattaaacaaaattgtggaaataccttcattactttcactaagaaactcttcttttattcataaaacaaggcaatggggacccgaatttgaactggatgtttcatcggtgctcttactcctttcatgctcagctgcagcttgtatttctgttcctcactcagaaatggatattctgtccttacttaccttttctaaagaaatgatattccaaatccgtcgagaaaattcatctaggagctttctggagtcgttcatgtaccttttaactagctataatgaacttatattctatctaaaaacgctacttcctgtagtaattgcaaagtttagtaacctggtctcaaactctttcctctcagaattggcagtactttttgactcgacaaaactagccttaattaatcactgtattagtctagcccagaaagaaagccacgatttcgaactagagggagatgatacaagtcctaaaactcccattctggatgatttgggacaaaggaaacctagattccttccaaatctaatgatgaccattgtattttctacatgcactgacctattggcttttgaccttgtatctagtgtcagacttattcttgggagagcagaaatgattgaaactcaaaactcattgaaagcccttaaatcctccacagaggtgaaaagtggtgaaaagaatgactcctacacgctcaatcttacccctattgctccaaatagctcatcggtttgcttatcttcgtcctggcaagatctcagttgccagaatttaaaaaataaccagagattaaatgatgaggcttcagagtttagaggctgtgttgggaacttaatcaattatatgcctgtctcagaattttctgaaaaaagccagagatccaatatcaaaagattgttttcttcacttattgagcaatgttgtaggtacattattagaaatctaagaactatgttgctaaaccaagaaaaagcaattccgttccagattcaaactcagaataagaacgaaatatctacgtataactttaacttcaagaacatttggatgatccaatcttcccagacgacgaagagttcagttgaagttcaggtctcacaagaaaatgatatttgtttatcctgtgatttaacagctgcggtttacctcctcctatttgctctcaaacagttatcttcactctcagaagtagaagatatcacaccaattatagaaagcactacaatatcattgttgctagagctaacttcatgttctatgcaattttataagaaaaacggaaagttcattcacagaattgcaaatgaagttgggaatatagattcgaatggtactttactaaactttttctcaagctctttgatagctctcccaatcctttgtctttgcattcctgcaaaaatactggaagttatatatattgaaaataggaaaaagcttcttcaggatatttcatctgagtttacaatgaatacttcgaacttaaaatctccgataataaccagaatcaaagaattacttattacaaatcctcttatgtatgacttcaatatagatatggctgtcaagatagtcccattattagattctgtaattcaactaagctcttcctgtcttgaaaaaaatgaagctcccagttatagttatcaacaagcaattatcagaaaaggccgtattgagtctattggatactttaaacctcttaaagtaccatttctaagctggagtgaggcagcttaccactctttactgtcatctataatgtcttgcctagctgcaatttcctctactccccaaggatgcatgcttacccttaagagtggaatactagtacaaatagcatccaatttcttcgttaatgggttcagatttaccaatatttcagctccttcaaagcaatcatatgaaaactctgatgttactcctgaaatacaatctattataacctcatcaaattcatctttctggccctcaacctatcttatagtcgaacttggagatcaaacaattagaaatcctatgcatattttatggtgtaagctaatttctcttgcaacaaatatatttgtatcactcgaaaaatcctcaaatgttatttattcagaaagcgatacaaatttacaaaacaaaagtcttaatgtatctgtccaaggagaaactgaatacagacagcctatgaatacctatgcagggagaatgatgtttcgtggacaatcacctcgtagtcttagcactatttctagaaagtttgcgaatacaaaaattgagggagagacaaataaatatatctcggagcaacctgttagagatgattctcaggcaaaagaagaagtattgaaatttattcagcttttagagccaagaattcaactaattctctccgagcaaagacaaatttcccaacttgcaactttggaagaatttaatctgggtattgatttaatcagagcaactatttctctgaacatccccgagcttaggtatgaattgacagaaattcttagaaaatctcttaagacggttagaggcatatctgtagtgtctcttggacgtggaataacagaaacctttgacttgtttaaaccaacttcaagaacagagagaatttcagcaggtcaaatcccagaaactttgaatttataccatttagatagtctccctgctcaagtaccatccatttttcaccaacgttgctgcattcttttattgaattctgttaggagtattattgatacatttatctcagaaaccgggttctctctcgaattacgtggatgcagagaactgctcatgcaactgtttcatgatactatggatttaggtcgtccaatactgcaactattggaagatataccaaaccactgttattctgtctttacgattgtaaaatccaaaggtggggaatctttcctacctctatctttaaatatccaagctctaaacccttcagagccttcaattggtgatttccttccagaatataaaaattcatcactgaataagaacagtgtggaatttagaggaatagccagggtctcagctattacagaatcatgttgcctaccagaaatgatcactttcagctcattcgtacatttgcttagctctttggttgacaatattgcaatttgtggagcgaagtgcctctatacacttgaaagtttagaggcttcagatcaacataatgacactattagaagattcttagaattccttcacctttctcaaggtctcaactcttcttcgcttttggattcatcaaggaaattaattgaaaaggtgtatgcaaatcttaaatctaagcttggagatcaaattaatgtggaagttgtaggtcttgttggaatcaagaaagatcccattcatacacttttatttgatagactctcgaatacaaatagtaatgcaagttctgggatataa

SEQ ID NO: 3404 - DNA, 739 bp, Cryptosporidium hominis
atgcgaatatttttagtattactcttggttatttcattaagtgaaggcatttttggaataaaacaggagcaaagcaaaggaggaaatgtagtaaatggtcctcaagtttacaacaaccttaaggtaaacaatcaaatgagaatcaaaagtgaagttggagatgcaagaaatccttctcaaacaaaaatagcaaagatggacgactctttgataacttatagaacagcgggagttgaaaagcaagatgttgctaataacatttctgaagttcatggatacaatagtttaagaacctcagagattatttataacggtactcaggtattaactttgatgttttttatttcagtaattatttttggtttgtttattctggcgattgcacttattccaagatatgcaaaaagatttggcttcaagtctagaagagatgaagttccaattgaacaagagtgtgatgattctaatttcaatgatattgaaggaaaggttttagtaggaagggaaaagaaggataacaatacaatgaatggtccttcgctcacttttacaaaagtaaagaacaactctttgagaaggcattcgctaatttcagatggaagttccgatagttgcaagataacgacaagacctaggtcttcttcttctcttccatcagttcaagcatttactgaggcgatggaagaaagtacaacgggggatgaaagcagtacaagagctagtaagcacattacttata

SEQ ID NO: 3405 - DNA, 2904 bp, Cryptosporidium hominis
atgaaatataactggcaaagattgggaaatggctggtatgaccggaggagggactcgaaaatgagctgggaggtttccgatcgtgatttgaggaggaatattattgcaatagcaaataacgggggtcctatagctattttgatggcacttccttcagatggaaattctctggtttctaacttttacctggcaacttatacttttagagggactgaactaggtagaattgcttggatggatcatattccagtatctattgggtggactctagaaagtaccctgttgtctatattttctgatggaacaataagggtattttcccccctattagaacagttgagtgttataagtttgaagcggaacatagaatctacagagtgtataattatggctcgggtacttccatatggtatttgttttgtgacttctagttataatgttcactttgtttcaaattccaatatatcacagagttattgtttgaataatataccacttaggtgtagtccactggaaatttcagtaacaattccaaatgaaaatgattcaaatatctcctttatatttcccacaaatgttttcctcccccttgaagatagttctattgctataattagtatttgggatccaaaaatttcaaatttaattactaaagaaggaattgcatctccgaacccagttgatccagcatatttatcattcaattcagatggtgaggcgagggagaaggtacttgcattcagtgtctctccaaatggggcagtattggcttcattaactgaatcttttgttttttcattgagaaaaaccaattcaatatttgaagatcccatattctcatgcaagttgaatatatcattttctaagttgaggcaaatggtttggtgtggaaatgagtctgtagccttaaatgttgttacttctacttcagatccctccggaaatcaaaagctgaaaaatgtagtttatattggaggtcctgataatcaatggctaacatataactacggtaggcagccattaattctaaatactgaagtcgacggagttaaggttcaaacagcaacacactctgatttcttgtatagggtcccagaatgtctagaaagcgtttttggaataggtagttgtgaaccttctgcaatgctttattttgcatatgaaaaacacatttcgggagatattacagcttattattcacttagggcaatttcttcccaattaatagaagcaagcttaaagtgtattgatgcttctatttgcaagtttcatgaggaggaaacttgcattaaacttcttaaagttgcatcattcgggagacttttttctattaaatccttaggttcagatcaaattgaggctaagaaatgggaaagaagttatatatcagcttgtagagatcttcgcatagtaaaggcagttaatcagtctagtgcagagtttaacacaagtgttgctcagctcagaacctatggtgttaaggttctttcaacaagattggcaaaccacagatgctatttactttcaataaaaatatgtgaatattgcaacattagctactttcatatactatccagctgggcatgtgcaaaaataagacattcattagaagctactgacgaagaattggctgggactataatttcaaagattattgggagtcagggtagtagtagcggatttatagaaaatggtgttggaagctcttgcttttccataatagctgatgaggcagcaaaggcaggaagaatgcatcttgctatccttttactacaacatgagccaaatcttcaaagaagagttgccatactacttaagctaccagcttttaagctagccgttgaacagtctataaaacacagagatatagaccttgtgtacgtttgcgttacccacttgttgtttgcatcatccaaagaaaaatttagagaaattgaaaattcttctccattaacttctgagtcgactcaaaagcattattgggattctgaaactattgagactttagccaatattccagaaatggtaccttttgtaatatattactgtactaacttaggggaaactgacttacttcttaaactttttgaggagatggaaaatttctttgatgctggctgggttaagattatgcttgcaactctagagaaaaattctgtattagcaaaactggagcatcttgcgcatgcagctgcttatttctcttcatctttgaaatcaaaaaaatctcttgaaattagtaaaatgatctccaataatactttaactaagtcattaatattactaaaaaacacaattcctcaatcaaacgataaaactcaagcaatatcttttattcattcttcaaatcctaattctggttcttcttttgaacgtgaagctgttatagctgaaatagagcttattcaatatcagacaaatttagatagcaagtctaagcaagcatcttggagaacctctgaaattccaaattttgtttcattcgttggatgctcactttccaccacaatcaaatatcttgcattcctagggcttctagatgatcttttgcagctaaaaaatgctttaaatgttcaggataaaatttattggacgtataaaattaaaggccttgcaatgggaaaaaagtttcaagagctttcagctgaagttcagtctttgaatttgtcataccctcccattagcttggaaaagatcattgatatttgtatatattatgatgcaagacacatcgcagcaaaactaattccaaagcttagagattccgaaaaacagagctactggtttaatcgtgcagggatgtatagagagactcaacagcttagaaatgccaataataatgttcagaataaaatattgaatactttttctggggctattagtggtattttgaaaaaagactaa

SEQ ID NO: 3406 - DNA, 1209 bp, Cryptosporidium hominis
atgagtaattctcgagaaaaaattcagcttttagcttcaactggcttaagaagctattctgatgatgagcttccagtaattactccatgctctgctccttactcatctacaagcttagatcgagattttatttcaaactccattgcaaagaactttccgtctattaaggtatattcggagcaggatggcacatacataacattccatattaaatccgtggaaactactgtggcaaaccttaaaaatttcattggctcattaaaagataataagagaacacacaatagtagtctggattcccaagcatcaactatggattcagatttgaatttatctcggcaaataaaagaaggtgaattatcgttatttgaacagaatattcaaatatatggagagattccaggtctaccgaagagaatattatctgattcagacagaattctacaggtcattagagaaactgataatttgaagttatactatttatatgagagttttgaaaataaaaaaggtactcaaaatgaattgatagttattgtatatcctaaagcaaacctacacgaattagggatcaaatgttttatcaccatttctggatctggactaaaattcattccagttgatgagacgaaatcatctaagagaatcatttttataagttttgatgacgtttgttcagtaacagtatataaacaagtagaaaatagtcttttaataaaaagaaggacaattgggaagaacccatttcttattcgagcaagttctagtatcgattttactgttataaagaaaaggttaaaacaggcttcagaactacagaaagattcaagacttatttctgatgctgattctaggttgtctaaatgcaagatgcaattcaataacgttgagttaatgactaaaatgaacgtattaacaacattcttcgaatttgtaggctctgaatttggtaggatttttttttctaattggattaaatctattgaagaagattcgaagaaatcctctgaattaaaagttttaaaagaaaagtctgaaaataatagtttcagtcatctaatcacattcacgaaaattaaagaaggcttaattaaccaagactacttttcacttagtgaggagaaagaattaaataactttatagttgaatttcaaagacatttaagtgaagcctcaccttctttagaagatatattacaggtgaattaa

SEQ ID NO: 3407 - DNA, 5061 bp, Cryptosporidium hominis
atgatttcttcgtcaaatatcaaattttgccagtccagactgcgaggacttagaaggtgtatattatattgctcttcaattctaagtgggaatagggataatttagacttagaaaatcttgcagaactttatatggtatccactatgcttactttaatactcaaaaacagaagtttaagaagaacctctgttttgcagctagtcgatctcttgaataaaagagcaaaattctctaaagacgatttaaatttagaagttgtaaatgatcttgaacttatagaaagacagtggagcttgaatacaaagtatatttttttcgactactttaccttggttgacctcgaaaaagatgaaatgagcactgcttatgaacaaaaaatttatggagaggctctgttagtagaaaaaatggaagaattagatgatcaccacaaaaaatcagtaataatgagcacagaagggccaaatttgtcagtattaaaaactccagactcttttcgcctctccaaacttttatcagcaataaaaaacccaaggattcaaacacaaataaagatttctgcactaaagtctttgactaaatctctaacttcctcaaaaatttcatgtaaattattttttatatatgtagatgagcttgtgaagattttgatgaatctgagttgtaaaagtttctgtactaaaaagcagaatttggacaattcttcaagagatgagtcagcttttgatatttcagagctcatttcaattgaagaaaattctctgttctaccatctttcaattgctctaaatgcaatttttatctcgagatcatatagaaagaatttactagaatatctagctgcatcttactcaattacgctcattcaccacctaagtatttggatatttagttcctctgaagaatggagatctggttcattttccctccttacaaccattctgataataattttaaaaacaggagtaatctgcgatactccaagaattgaatctccacatgatttatttttagataagacgatcacgtatcttaaaacatcccccttggtccagaacacgttaattctcccaacttcaacaagagaaacaaaagaatataaggaaatctatgaagtagaactacatgaaaatagtgagcatacctcacctctcaaatttgacgacgtaaagaacgtcaattttttgaagcctcttgtttctaaaacaaatgcatcacaagaaatttcaaaggtattatgggatttggatagactttttagaaaaagatctatcaaaacaagtggcgtacctcttggggaatttttgtattcggtattttcgctttcatttccctggacaagaatgaccagtcaagttgttcgccttgaaagtggaatatcaaaaattaaggacagtatcgactctgtactttcaaaattaataatgttgttgggccagaataaccctgagtatctttctgaaattgagagatattctgatctaattaattctcattcaaggaatattgatattaaaatgcttgcagtacttaaagttattcattcaatactacattctttccagcacgtaaatagtgagtcactttcagagactctttccaaatattcttcatttattgttataatcttatcatattttaacaactatttcagagataaagatggtaattttatagtcggaacaatcagaccgaagataagctttggaatttttgatacaatttctctttgtttggactcttgtaatggggctttatgtgaattattatttgatattttaccaaataatattcaatggagctttattatattgcaagtaccgaagctaattgatcccattaatacagttcaatctcctactactatgcttctagtaaccaaattattgagtaagatgcctctaaaaagatggtttggagaagatccaaggtacactttagaatgtttgaagctgcttattttaaacaaaagtctgttttgtaatagagagctccctgaactactgctttgcgcacaaagttttcaagattcgtattttgttaagaaagtaatatctattttcgataaaatctcagtttttgaaaacccaaaccatccgattaatgcacttttacaaaaaagccttcttaagtggctcctaggtgtaggattggtttctagttcatttgaagttcaaacaaaaatctgggatttaaagcttgttctcttggataaatgggattatgaacattctaataatacttattcaataatttctaactttcggattcctaatgttgataatgttgaaataaatcagcaaatatcttgggggttcattttctctaggtctattaagagtttaaatcacttaatcaataatatgagttatttagtgccaataaatgaaaatttaactaaatcatatattggatggagaaatgtggagttctttgagtatttagccagtattttaaggttcttagaagtttttttgaccattcaacacagaccaattgaaaccgagtccaatgaaaatttcgatcaaaatattggagaagttcaactagtaataacaactttaactgaatctatggaagttattgcagaagaagtaatcactccttttttaaatctaataacaatgcaagattcgaatattgaaagagaaaggcttttattcaccaatttaatgtttgggtttctctgcaagttgagtagatttttgcctttctcatctcttgtattccaaaaaattgctgataacttaagtcttttttcttcatctctaagtgagctttctcacttagaactgagtattaatagttttcttttacaaatacagcttgttttatgcataataaaagcggatccaagctgctttggagtattaagagagcacataatcattttaattggtaagatatctcccaaggaaatgtcttcggaccagatgaacaagcttttatcatttttactgtttttgtttgacaaaggattaaagaatcacgaaatttgttcaagactattagaaaagatctcttcactctgtaatcaagctcttttgaggatgtctgaaattctaccaaagtcaaaagatggacataactttacattggaattgccacaaagcttaaacttcaacaatacctataatttattaatgggagtttctttactgtcactgaagctttcccagatagtttcaattgatgattcatcaaactctttaagtgaagagctgaaaaaagagatattcaactcagtgatactaggaattgaaatatcgagtaaaatttcaattagttcagagtttttgacgctttattgctctttggaccaaattaatattttacaggaatcattggccttacttttatctgctctttcaatcttcaacagctcaagcttgtccattgaaatggaagaggaatttattagaaagctctttaaccatatttttacaatatgggaaaactttatatatttaacttcatttttttcgaaaagccaaatgaaccactctgaagaattataccatgagcttcgaacacaacaaagtgaaaagaaagaattccataaggaaataaaactttgtattgattattatattcagataattacaatggatatatttacggagctattaactaataatctaaataactttgatcctgggaagtttactgatgatttaaagaacatttggctcttcataaacaattcagaagaaagtttaagtaaattaaactaccctattatttattttgcgtcctttatatataagatcaaggtcaaatctagtggaacgtcagatctaggagattggaatagaatatttaacaagaatttttatctcaatggcttattagattatgttttactgagaacttctgaaattcttgttgaaatcagagaaatttgtcttggagagcttaggtcttgtacaattgcttctcttagagcaatggctaaacagacaaacaaaaactcgaacaaatttaatgaaaatacttttctttcacaaatgtgttgtcttttccaatttataaaagtcattggactctttttagcagaatttgaaggccctcataatcttttaactaataacaagttgaagcctttacttaactttaccttagaatctttggcactccttagttgcatttctaaacaactagaagcagaacttgaaagaaataatcgctctggtttcgaaacatgtattcaaacttggtggaaatatacatgcaaaatcactggcgaaagtcaaaatattgaacatttttcttatatgattacgcagataatttctctattattgtgttgttcttcgcaaattattccaatttccgagacacaaatgacgaatataacgcaaggagccaacccagtaccgctttcagatttggcaagatctcaaaaccaaggttctgcacgctttcacgacttatttatcaatctccttgataccgaaagctctgttggtttaaggttaagtcgaggagctctacgttttcctattgaaattaatgaagagaatggcttcctcatgagcaacgtaactaagaaagaactgaataaactggatggctttgatttaaaaattaatcctaaaaaaggcagaatgcttttggatagcattattttaaatgactctgttccaatcccaatcaaatgtggagttttgaaattatttctaagtctggctctttcatcatcgaaaaagaaatttattaagcagtggaaaattgacgagttttcagataaaataaaaattttgagtattctggagaaggccaaaatatctaggagttctgaattcctcgtactatctttggctctattagaggtactcctatcctttaatcccaaccaactagtaagttctgttgaacatgtgagaaagcctctaagagcgtattctgattcccaatgtagctcaataatgattttacttgagctacttaaggtggaagctgaaacatttgaggatttggatttaaattctcgtacttatccaataatccaagatttatttaacaagtgttttgcattacttaaagttatgcaaaattaa

SEQ ID NO: 3408 - DNA, 603 bp, Cryptosporidium hominis
atgaatattggccaacagaatatctttttgcatggctttgatcctaatttttctctctattctgtaagcgatgaccacacacaggtcgagatatatgaggaatttgagcatatagaaggagaaagcaatcagaagtttattcttagatggatagatactcagctaaaagaatgggagaagctacttaaatgtcgaaagaaagcggattctgaaacagaaaaaggtatgcaggattccgctcaatattatcaaacaaaaagagacattcaacctttagttaattcgctagaggcatctgatggaaaagttgataaagaggttctcgataaattatttgaaattgtgactttgtgtaaccaaagagattacaataaagctcaagataaatatattgaattggcaattggaaatgcgccatggccaatgggcgtaactatggtaggtatacacgaaagagctggaagaacaaaaattttttcctctcatattgctcatgtcttgaatgatgaaactacaagaaaatacattcaaatgtttaaaaggcttgtaactcactgcgagtcgaaaagaccttctagagaacagcaaaagaaaagtatctag

SEQ ID NO: 3409 - DNA, 4452 bp, Cryptosporidium hominis
atgtggaaggtaacaattttttatttttatttgataatattgttaaaaacttcaaattgccagatacctggaggaaattatgagaagatcacggtagaaccatacttggcacaaaatggatctccttatggaattgatgtaaaagaccctaagccaacacctccatattatgaaactgtttggggtgcaatttcggttcctccattaatcactccatgtcaatttattaatccaataactttaactgtgggaaaccttaatagaactgatcccgttccagttgagttctcatgcgataccaaaaaattgagtggaacatccaagatacaaactcaatatggagttcttactatctcaaatgctgttgctttatctccactttgcgaagctgctgccacacttttaaacggaataactcctactataattcaaacctactcctatactaacctaacttattatataacaaatgatatgattgaaagtctaattcttaaatttccacaaacccatcaatctttagatggtcagggagagattaattggctttctcaacacatatttagtgaagtttggtatgatattaaagacgaccttggccttgcgcctgaattaagccctaaaatgacaataccattaatctatagggtatttctaccaagcgatgtacttccaggaaaaaatgttgttggttctaatggcgatcactattttgttgatgcatttaatgttaccattttagatgtttcatcgttagagcattctagagataatagtgacaatttgtgggttccaaagtatggattaggaggttttattcctacaattactccaacttatcagatgaaggtaattccatactttagtaacgtcacaactcactacaataacgctgctattacgtggggacaaacaaatattccatttactgttactccaatcagagttgtgccaccttcaagattacctgagcagactctgaatttccaaaaaaaatctaattgctcaagcaactttgatttttatttcccactaagaccttatacaatggttggaaaccttatagatgatgaagatccaagagatctttcgcttttactgagtaaaaaatcaggctccatatttcaaagaaatactcttaaaggaatgggatttttcaacaaatttattattatgaataaccccaaaagaacaggaatattagaagatactgggtcaccatcaattataattgaagagaattttattggaggatgtttttttaatggaacgttcccgtttacaccctcaatagaaaataaaggattttacgaacaaggacgttgttccagtgaacaattaaattttagtactaagtataaaagtccattttatcctccaccaaagaaatttgatggatacttccaaccttcgttagatcacccaggattgcaaactactattcttcaaacagtgagctatacccagaatggtggaggtcctaaggaactagatgactcaaaaaaaacctttatcagaaattatccaggaatttctgtagtcagccaaattttttatggaattttcttacagggacccagagttacgtggcaatcctcattgtttcatgaccaaaataatccaattataccggagggatctttttatgccttttcaccgcaatatattgaaaaaatgtttggttcctttaaccttcctgggggtggagccagctgcagagctgctagaatgcttccaattccaacggaaatggtagatgtaaaagtcacttggcaatgctatacaccagcaactcctgtttcacttttgtattcaactactactcttaaggatcaagcatttgaaacttgcatggaggcaagccctcctcctgcaagccttgcaaattgtattacggctgaaaagaagttgccatatactcttaatactggattacaaaaaggaaatacttggagcgctaaaattgagtctaaggagtatagcactaccaccccattactttttatacaaaataacacgtcgccgcacgtaatatatgggtattctccaacaggttggtggattgaaacattaccatatccaaataactacaatcaatggttcctccgtactcagacttgtgcgtacccttcagagattccaatattccctacagatattcctcaagtattcactatcaaatcagtaccgaaagcatgggatcacattaatacaggtcatcatttcgctacaataccttacacaagtcaaaatacatcatttagttttgaagttttgctgaatgaagtttcttatttctctagtatgactgaaattattaaattcgagtctcagctgttatgcgaagggcaccactctatccaccttgaaactttaccctctgaagctttagttcaagaaatactttctcctgaatcaataattgtttctgcaataattaaaccatttagcatactatcagagcaaaatgtaaactgttttcttgttttccgtgccttacctgaaaacttgaaacaggctacatcaatccccacagcttatggaactcttgcaaaccagattcctactgctcctataaggggaattggagaatatatttactttttaagtgcagatatgcctcctcaaatggaagaattctctattttgattccaaacccaggaaaaacgtctgcaagtgatactctttatcttcaaatacctagaatcgcattcccaacagcagtacaatcatctgtttttccttcactagggatcattgcatcatctgacccagtggtatcatcatcttcaagaattttaattataggagatcagctgcaacttttgcaacaatcaataaggctgccatcaacagaaaaagcctggtatgtttttctgaaagcttcaacaccgtctaacagcggttgcctaattccttgcgataaaagtctcaaaaatcattacatatctccttattgtagctacggaaatgaaccaatttgtccatatcaaaaagtaattatgaataatcaacttgagagtagagaacaaataatggaattaatagctgccgcaacacattcattatcctatttatctctttttgatggacttcaactcggtatttctttgttttcacagccagtatctcaatctcttgtttggaatgaatactttgatgtattgtatgatatgcttttagataacccaaaaaatccaacttctgcagattattcagcatctaaaattacagtttttggaatcttaaatatgatactccgaaatgcattagaaaacccaaagttacaaatagatacaattaagccgttcaattcgattatgaataatacattaatatctgaatgcgcaaatagccctgggtttaagttcctccttttagaaactatagaccttcttgttgcagtaaacggttgggatttcatttcatcaaatattcaatacctacaagtagttgaattaatattgcaatcaattggaaataggttatcattttcggatcctattagatctcaatttaaatgggatggacctaattcaaaaattactttcgagagtaaaacatttgcaaagcaggacttaaaatcaggatttaagttagatacaataaatattccgcctttttctctctcaaacaacattgaatttcagcttgcagaatctatttatatgattcagaatcctagatactttgatcaccagttagcgagttcttattggattccttcttgcccaaataatactctatctatctcagtttcaaagtatccaaatgagctgataagacaatccattcataaacatatttccaatgaagatcaagttgtaataccagtactatctacatcattttttgcatgctctattgactattatctaattaacattccaaccccagtttctttcaatattgatattgaacttgacatacaagctaatatcacaagtcttttgtgtgttgcaaggaaaggagatcagtgggatggatctttatgccaaacattccaccgctataatgagtttaatactagaaaatctcaaattcaatgtctttgtaatgcattatctagttatgctcttaaaggcacagttactcccttaaacaaatatcaaaatgatacagcagcttggccaggatttgatggagattttggtggattcattcctaatatttctgaaattcgtcctttattaggaaatgttgggtctgggtttattttccttcaaggagactcaactaacaagaagaacccaaatagcaatttagaagatggtcaggttggaagatattcggtcaattataagcgagaaaagaataatacaagcgaaattgttggccttgttcaggaacaatcagcatttaatggtattgcttactatgattatgattttctctattcgtgggaaccaaaatcatacaatttaacagtaaatgtgactattgaacattaa

SEQ ID NO: 3410 - DNA, 720 bp, Cryptosporidium hominis
atgaataatttcataaataagatatcaatcaagttaatatacaaaactattaaatgcatatttatttacatgatttttgctttacttttaagaaaactagaagataacaatcataaagtatcttttgattcgaacttatcgcttataaaggttctaaactcattcgataatttacaaatagatctaatggaagacccaaaagacctaaaattagttattgacactgaagagataaatcagcctgatatttctgaaaaaaataactcaacatatgtttccgataaattggaggctcatttagaagctaaaaatgacacaaataagaaaatgcatgttcccaagattcaattatctgaagaagtaaactcagtattaattggccaagaatcaaagtctgaaactgaatctcctaaaagtaaccaagataacgcagggaaatatgagttatccaatcattttaatagagaagatctagaaagtcatatttcaaaattaacgaagaaagagaaaaaacttctcaaagagcttgaaaggactgaattcatcgtgaatttatattcaaaggcattcctttcggattcaagtatgagtaatactataaaatatattaaaaaatatgagtttctaaaaaaatgtcatcaagaaaatctagaattacttagtaaaaagaaagcggaattagatgaatatcagaaaatgttgtctaaaaccgggatttag

SEQ ID NO: 3411 - DNA, 3000 bp, Cryptosporidium hominis
atgaaaatccctactactactactactacaagaactactactactacaagaactactactactacaagaactactaccactacaagaactactactagtacgagaactactactagtacgaaaaccactaataatacgaaaactactagtgaatatttttcatcaaatgaggaagaaatggatttaaaaaataattccatggaacaatttataaatgaaaatttctccgaatctaaagataagcatttaggccaatcgaatattaatttaggccttaattccccagatgggcatagtgataaaatcttttcagttttatctcacaatggtactgtatttaatataaacagtaaaaattgcccaaatttaaattttcataatgaaaattctggaataactaatgattctaaagggttaatcaattttactattaagaagagcgattttaggaatattccaatgctcgtttctaacttatttggtacaacaaacttgaagaaacaaatacttctttggttgaatgacaatgaaataagtttattcgacaatgattctacaatatctagcgtttctcaaatacccgaagaatggtcaaattcaacaaaaataaacctttcattatactgggatgaaagttccagttacttatttgataatacccactcgaagattattctttttgttgggaattataagaatggcacaaataatggcgacaaaatatcagtcaatgatgcaatgaaaattaacaatgaaatgctagcactttctaaatcaaataatgtttgcagtatttctaaaacaatgaatgtgtgcaaatcgaatgttgtttcaattccgtattccggcggtctaactaaaggaaattatttaaaatttggatttaatgttccaagaactgatcttttacctatttcgattagtttctttgattcaaacgatgcaaagtcattatttgttttaaatccagatggatccggaattttgaaagacatttctactgaatttgaaattaaatttgagcttggcttgataaatggtagttggctcggaggtgatatttttatccttaatagggaacacgctcttgaagctgtaaactattcaatcacttgtgctttctatacaaaaacatgttttgaaaagaatgaagcacattgtcttaaaccctctaatcgcgcagagaataaaatgacttttggatctgagaaagacttagcgacaactctccaatcttctaattctgaatattatctcttccttacatggaataactgtattcttggatatattccaattaacacaaataaaatcaacaaagttactcttgaagccggagacaactcaatctccacaattggatattggagtattatcgatggattttcttcttctttaattaaacatgcgcctataaaagaaaatggccacttgaataataaaggaaatcaaaatattcaaaatgaaataatgaaaccactaaactcaacaaatccagaatcaggtgggaataacttaactcagaaccaaaacacaaaacctcatccaggtgttagaccatatcctacagaaaagccctcaaatggtgaacatcaagaatctggttcagagcatgcccctgttacctcaccagaaaacgaatcaagttcaaaccatccttctgttactattccagagactggatcaggttcaaatcacgcacctgttactattccagagactggatcaagttcagatcatccctctgttactataccagagactgattcaggttcagatcatccttctgatactgaaccagagactggaccaggctcagatcacactcctgtgacaattccagagactggatcaaattcaaatcatccttctgttactattccagagactggatcaagttcaaatcatccttctgttactataccagagactggatcaggctcagaccacgcgcctgtgacaattccagagactggatcaggctcagatcacgcgcctgttactattccagagaatggatcaggctcagatcacgcacctattactattccagagactggatcaggctcagatcacgcgcctgttactattccagagaatggatcaagctcagatcacgcacctattactattccagagaatggatcaggctcagatcacgcacctattactattccagagactggatcaggctcagatcacgcgcctgttactattccagagaatggatcaggctcagatcacgcacctattactattccagagaatggatcaggctcagatcacgcacctattactattccagaaactggatcaggctcagatcacgcgcctgttactattccagagaatggatcaggctcagatcacccccctgttataattccagagactggatccgactcagatcacgcacctgttataattccagagaccggatcaggctcagatcacgcccctgctactattccagaaactggatcaagttcaaattatccttctgtgacaattccagagattggatcagactcaggtcacgcacctgtgacaattccagagactggatccgactcagatcacgcacctgttactattccagagactggatcaggctcagatcacgcgcctgttactattccagagaatggatcaggctcagatcacgcacctattactattccagaaactggatcaggctcagatcacactcctattacttctctagaagaaggattggactcagaacgcttaccagtcacttctacagaacaaaactcaaagccagctatatatcctaaccaagaaaatgaaaatcataatagtcaggaaggtaattcaaattttaatacactaaatcttccaaatcaacccaatctttccagcaagccggcagatgtggaaagttatggagaaaaggataaaatggttgatggtgagcaagctatcagtaaaaatgacattattgaagatacttcgaaagaaattagaaataagatgtaa

SEQ ID NO: 3412 - DNA, 291 bp, Cryptosporidium hominis
atgggttcagttgagagtaacgtttgtgaaataattccctttagttcacagcttacatgtattagtgacaatctagtcatagtgaattattctaacaatgtaattcagcaatacatcttaaattccatcgctccagtaaacctttcaaatgaatttgaatatatatttccttgcggaaaagatatacataataaagaaggtaatataagatgcgaccctatcacaaagcaaatccaaatttcctgtggttcaaagttatgtaagtttacttttaacccatttaactcatga

SEQ ID NO: 3413 - DNA, 868 bp, Cryptosporidium hominis
cagaaaaatgtctgtgtacttgtagctcatcctgatgatgaggccatgttttttactccaataataaaacaagtgtgtggagaaggtaataaggtatatgtactgtgtttgacaaatggtaagtgaatataattgaattcttctatgagaaagtaactatatttgctttctttcttttttaattaattaaatttaggagattactatggtttgggtaaacttagagagaaggaattattggaagcctgtaatgcattaggtatactcaaagacagaattagggtggtatcgaatgataaatttcaagatcaaccaaatgaaaaatggccttatactgatgtaattagtgagattgagtcctttgttgatgaatttaatattgatattgtaagtttttattttaatattcaactcaattctttttatatttgttaatttcagatattaacgtttgatgaatttggtatttctggacatattaatcacatttctacaaatgaatccgtcaaagaatggattcaagaatcaaaaagagagaaatatcccaaagtttatgtacttgaaacatctaatatactcatcaaatattcagggatactttctttactttatttatatatcttcccaaaaaatgaatggtaggttatattgaattatcaaatattctataaatttatcatctaatcattttagtttattagcaaaaagtttgaatccaatacattcattaaagtaagtttctattattcacttcttctcataaataacttatgaattcagagctcttctttgccataaatcccaagtcacctggtacagaatcatattcactctattttctcaatacagttatttaaatatcttaaaa

SEQ ID NO: 3414 - DNA, 174 bp, Cryptosporidium hominis
atgcggcacacctgtcaatttacgatagaaataggcaggtgtttaacattcgattactattattgcgaacctgagaaaaccactttgttgaaatcacaaaataataaagagagttcgcataaaattaatactattgatgttgtgaagcctgactatttgataaatagaaaatga

SEQ ID NO: 3415 - DNA, 77 bp, Cryptosporidium hominis
tgttttggatcattaacaactacgaaaatcagagaattcctaatcttaacagttttaatcaggattccatactttaa

SEQ ID NO: 3416 - DNA, 534 bp, Cryptosporidium hominis
atgtctggatatcaagatgacttgaataaagtagttgtagaacaattcccttatgaaaacattccagatagaccccaatattacaaccgtggatacaaaattcttgtgcctgaaaactttgatgttttccgtgatcaacaatacatagaagtcactgggcaagatggtgttgaatttaagggtatattttctttggatcagcctgaacttaaattacctactgaacaaactgctggcacctatgaattttacactacttccagaacctatgcagtatttaagggatatgaaaataagcgtatatatgctattcctgttattgaaaaggtgaaatgctatgtagatacaaactatggcaaagtgaaaatggcaaatgtgtgtaatttaactttcaatgttaattatggtgtattatctgttggagaaatggaaataaatacggttaatatttgtggaaaacgagtcatcattggtaatactattgaagaagtaattaatattggaacttccagacttaatgaaggttctgattaa

SEQ ID NO: 3417 - DNA, 2751 bp, Cryptosporidium hominis
atgaaaattgtaaaatttaagacatgtgtttttattattattttttttggttcgctattcagcaatattctccacattaaaggagcagaggcacctcacagttctgatgaaaacgaagaatcaaatgatggaaaaacttttcaaatgatagatcgtaatagtggtacttttactttaattcaagcattaattggtaattcttatgaaagcaactttttcatggaatgtgcattgatagagtcagctgtttatatggagttaattttgaaattgattgctttgtttaatgcagatgaagcaaatgcaaaatataaacctttaagtcatattttttttagctttcttttaaatttctcttttgagaagagaagcgaagtagttttgatcgataaagctaacgaaattaagaaattttcacagagtcaaaataatattatgcgaaggaaaatgatcgagttaatgaatgaaggctcagtaaaactctttgattttgtagtagagaataaagaagaattagaaagagaaattgcctcattgatggaaaagtttttacttttgttagattatggagtagataactttttaggacatatggctatttcaattattacttttttcgaagaatattcattaattttatctcaattttctgaaatatttttaaaatcatcaaggaaagatatcacaaggagattcattgcgaataaagagattttttctaacattcaatttaaatattgttataatatgcctcttttaaaaactacagaaagtaattcagattcaaaaacagattttgacaaattggatcttgatatggaagaattatgctcaattaaggtagtaataataacagcttttgatgtcttaaaatcaagtttattcatagtcttttttttcgaaaaaagctcattaaacgttcttttaaatgaaattttccaaaaggaagaggctataaaaagtattttagaaagaataaattgctctgaattatcagaggaaaaatatttaaatattaaagttaaaacaagagagttatttgatgctgaaaaaattcagtccaataatttagttagtgaatattttgatttttttgtagataaaagtataattattcacaatatgaaagaaatttacaagattttactagaaagtttgttaacattaaaaaaattctatgaggctgttactgaatcgaattctttttctatattatttcaaagcgtagtttcagcgtatgaggaagctacaaaaaaatgtgcaaagcaaatcaaacaaattgagggttattcagaagaaaaaataaaaaatttgcaattgagccagatacaacaaaatataaaggataagagagaacttagtaaaaaaaaactcttagctgaatttgaattgcataaaaaagaacaaagagaaaaaaggcttaaagagaagagagaaagagaagaaagagaaaaagcggatagagagcatagcaatataattagaaaagctaaagaggaaaagaaaagtcaaagaaaaaaaactaaatccaaaagagaatttcctactgtagaaggaaatgtgattgaagctacaaaggaaaatgtaggcgaaacacaaaaaggtgccagtccagctgttcctcaagaagttttatctggagttcattacggaagttgtagacaaaaaactaacaggaaagaagaaaagcttaagaaacttttaaaagaagaggagaagtctttaaaaagggaggcagtaaaaaaaataattcaagaacaaaaatccagtaatacttctacaagaaggagaaagcaggatgaaagaaaaacaaagaatgaaactagaagagaaagagaagaaagagaaagagtagaggagagagaaagggaaagggagagagagagagaaagacagaagaggattgaacatagtaattacatgtattcattattaaattctgtagaatcaatggagggattatttagagaagctgaaaaaagtagagatagtttatcagctttgattggatttgtttatggggttatttttgatgaaactgaagagaaaggaacaaataatgtgaatgatatttcagatacctttgcttcgctctcaatatcagaagctgataacttacaggcatcaggctctgcatcaggctctgcatcaggccctgcattggaattaggagcgagaccaaaaacaaagactataaggcctagagctcgctctcgttctagtactcgttctagttcccgctctcgtactcgttctcgcactcgttctcgtactcgctctcgtactaggttaaggtcgaaatcaagaattagaagtagttccagaactaggagcaaatctagaggcagatctccagaaatgagaatactaagatttgacggatttgaagtacctgattttccattttcagacactgaaaaagaacaatcagtaaaagagtcaagatttttaaaatatttttcgcaaagtggagacgaaaaattaacaggtaaagctttagagagatatgaaaataaatatttagaatttgaacaaagcttaattgatttatctataattactgaagattcaaccctagaggaaatattaattgcattagaacaatgtggtaatattattcaacatttacattcagatgtagctcgatgtgtatttggtcaagaattaatgtatattaaattaatagaaaaattatttgttaagaattttataagatttttagttttacttcaaagtaaaaaaagcaattaa

SEQ ID NO: 3418 - DNA, 1017 bp, Cryptosporidium hominis
atgagatatttttggtcgagattcttcctattattattttttacaaaatatttaaaaataacaaatggagcggaagctccaataaaagagaatgttcataaaagttcaagtacttctttaattaagaaagaacatattgatattgagagattaagtcatgctgtgggaatagttaatagtagctttgaggctaattatcttttagagttaacatttattaatttagctaaagtgttggaagcaatgttacggcttttaattatatataaaaatgactttacgaacgatttaatgtttttgaatgggtgtattcaatcgatgattttgaattctatgcttgaaaggagtgatgaattggttggtaaagccaaagaaaatcttcttttggatttctcaaaaagtaataatgatttgttattaaaactaacagaaatgcgtgaaaatttttcaccaagttatttcgaatttctagcagtaaataaaggtgagattacagaattagcagatgagttgatgactaagttaaatattttactttcatttgaagcaaacgaagggtttgcgcagcttattttttcaatccttgatcttggaacatttgttattgcttcatttaataattattcaaataaatacataaatttatcaagaagagaacgttcaaaacaatatgtttcaaatagacagaattttagtttatttgtaccgatttacaaaagtccatttatgaaattgtctcaaatttctcttgaaaaatctgaagaaaataaagaattagcttctaaatttgttaattgcttgaattcagagggtccaagtgaagaattagataaatcagctattttaagaggctattttttatttcaaaactattttgaatgcaaggatttaactgaaacccaaattttcaaaattgaaatgttagttttaactgcaataaataatttaagagcattatcatttattatttatatgtttggtgaggattcgaagagttggtcgacagatattgtgtaa

SEQ ID NO: 3419 - DNA, 2655 bp, Cryptosporidium hominis
atgaatataaagattaagataactttttatttgcttttacttattatttttggtctcattgtccaaattcaggctgcagatggtggtgaaggttcagattttgagaaaaatctacaaaaaaaagttacattaacccaagaacaaacaaaagaagctttaaacaaattgttattatttaaaaatgagcttgaacttaaatgtgttacttctaaatttttattgatcttttacaaatatatattacttcttcttagatttatctcaatttttgatttaagagaagttaaagaaaatctattcaaatttttgggcttatcagaattgttggtattagaattaaagacatttcaattttgttctttaattaaattagatagactcaatgagattcttgattttgttttttctaatgcaaatttaaacttgttaaaagaatttgaaggaaagtcggaacagggttttcagccaacattgaaatttctcatatcaaacttacaacaagtcatcgctgtattgaatttattgatttatcacttaatgaatatttatgttgaaatagatgatccagtgtttgtatttttaatttcttttatttctgactatcataataccgtattaaattatttaaaaagttttgcaatcgagttaagtaaattgaagctggacgaaattaaagaaatggccaagaaaatggatttgaaaagcccgttatttacattagaatttcctgatcctgagcaagaaactaaggaaaggaaattactggaagaaacaagaaagagaaaattacaagtaattaaaagacttaccgagtctggtgcaaaatcaaacgaggaaattgttactaagtcaaaatttgacataccaaacagtgaatcacttcaaatagaatatatctgtttattgagtcttttaacactttcttttgcgatgactaattgctcatttttcgatgataaatataaagaagtaattaaacaaactgaagaagtgactaaaaagctaatgaaattaatacttaacagaggtaccgagttagatttaactacagagaaagctctttctattaaattacaggcttattctcaacttaatatggatggtttaaggaaggctaatgctatgtttaggtctttttcatcacatgcttatgaagatagtttaattaatgattttgaaaaaatgttacgtattctttcgtcaactattaaaactcttgaaaaaaaaatgaagaggtgggaaagagacacgcatgtatctagcttaactgctttattgagggatttcttaagagttgggttaggaaatttagaactttttgtttctcctttgagaaacggagaagtacgatttaatttaaaatatctttcagatgacgatgaagagcaagataaaggaacaggaagtaggaaaagtcacaaaaaacataaagcaaagagggaaaataagtcacaaagtgaaactgtttctgaaagagagaagaaaataagtaaaagggatgcatggttaaggcatctgcaaagtagggaaagtacaatggaaactctgagagttatcagccctacaagctcaatggaggtagaaacaactaagagtgaagataagcccacgggaacaaaatctagtaggaaagaagaaaagattaaaagactattacaagaagaagaaaagtctttaaaaagggaagaagtaaagaaaatgattaaagagcaaaagtccagtaatgtttcttcaaaaaggagaaaacagggggagagaaaaactaaaaatgataatagaagagaaagagaagaaagagaaagagtagaggagagagaaaaggaaagggaaagagagagagaaagacagaagaggattgaacatagtaatcacatgtattcattattaaattctgtaggatctattgaaggaatgtttgaagaagctgaaaaaaatcgatatggtttgggagccatgatttcttttgtgcttgaaataataacaaatgatgatcaaagcggtaaaaatgtagatagtcttacagaagaaatatcatcactatcagtttcaacagaagatgatacaggtggtgcaacatcacagagtagattgggtagtagtagaagaagggcatacgaagttccagattcagggccaaggagaccaacgagcgatttttttgcatcaagagtgggggctccatcaagaaggagagaatctagcccttcaggacgcgacggaagccgaaggttaagacaagatagtattgattcaccaactcgaggtaatcaaggactattaacttttgatgggtttacaacacctgatcctttaactatacagaataaagacagccctgatttaaagtccaagtttttaaagttcttctcatctgatggcgaaaataattcagtagatggtttaaagagtgaatttttggtaaaatattgtacttttagtgatccaagtttttcgcatattacaggaaattcgtcaacagaagaaattaatgatgcattagaatcttgtggtatggagattcaaaggcttcattcaggtgttgcaccaacattaaggggaaggttactttttgaattaaagttaattgagaaggaattaattgcagcttttgttagaatgcttttacttttacaagaaaggagcaaagagagctaa

SEQ ID NO: 3420 - DNA, 1506 bp, Cryptosporidium hominis
atgaaacatataaaattaatactttattttttatttattgacttaatgctttttttattacattctggtgacttttttgcttcttgcgagtctccgaatgaacaagaagtagttgccagtactagtacatcgtcagtcgtaagttcggtgggagctgatctggtagatcttgctgtttattcgtcttctggtgagaaagttaaaaaggataatttagagaaagaactttatgaattctttcaattaactgaagaagaacaggtagtggaactatcgagatcttcaactagcgaaagcaatagtgatgatgaagatgaagtagagggtagttcattttcaagaggtagaagtgccaaaaggatgagatatacgcctatctatggctctcctggagagggaactagtagtggctcaagacgtcttaatccttatgatgaaatgccaacacgttttgctgaagcctacgatacttttttaaaagaaaacactatgaaactaataatattagagtttgaaagggcgttattttcttcttcaaacttatatttcacgtccatctggagagatagaaattcttttcaaggaaagatgatattcttactaggcttaatagaattttgggaaaatagaggtcatagtaaaaatttggctataaaaaacattatgataaaatactattcagttactaaattggaaaataggtttactattttgagagattatgctggttttaaaagctcgacttattttacaatgaataatttttatagaaatattaacgagataaagtgtagcgatcttaaaagaagtcttgctgtgataattcttctatttgagttcgatagtaaactattatcatcggcattcttgttttatcttctagtttgctcaattgaagagttaaaagagttggaatttaagcaaagtttagaattaataaaaacaaatcaagatcaaattttatcaaagattttgacacttggtaaaaagtatgttaggaaatttctcaaagcaatgaaagaaaatattccttcaatgtcaaatattaagattaaaagttacaagtttccaattaagtttccattagctatgtataaaatcaacattgaaaatttcggattaaggttttgcttatctttattagagctttcattgataagtagcctctcgttttctatttttaatttgatattcttttttggatcaagattaaaatctgcagctgaagttttcttagcatttgatattgttaaaattctcaggactacaatatcagagctatcagatatcgtttcagcaatattatttgatgaacgaataatacttcatatatctagagggattatggctctacataatattgatatttcaaatctgagaagcagatttgctgagtgcattcaggtaaaaaataagtatcatgaattaaggggcttagttatggttacagattaccaaagaaaagcactactaaagaaaaaatcaaaaagaagaagaagaatttaa

SEQ ID NO: 3421 - DNA, 549 bp, Cryptosporidium hominis
atgtcctttaaaaaatttatttccgcaaccatttttatcagtttcttactgatttttcagggtattctatttgataatggagattctccatccattaagcaactaaaatattcctttattacacttcctagaacatatagtcttcaacaagggtctaggaaggagagttgctgctccggattttggggtaggcttagaagtttctttgggtcttgctttggttcttgctccaagtcggaagaagaagaagaagtagagtctcttgagggaaggtattcacaatttcaaagtacagcttctggatttactttacatgctgtagatttgacccttacttgtgaaaaagaaggagaccgaactactactaaaactcaaaatgatttgagaaaattatttgatagttacggaaggtttatctgtacagaaaaagacctgagaccggcttgtaaagaattatttaaaagaattaagcatcagacgaaaaaattaaataaaaagggaatgggttgccaattatttttttctaacggcgtatttttgatagattaa

SEQ ID NO: 3422 - DNA, 1275 bp, Cryptosporidium hominis
atgatagggcagcaaatgaatattcgtagcaagtattttgggcttgcaacaatatttattgtcagcatattaagatactcattgtgtgagctaactgttttttcaattggggattggggtgaaaagacggactgccttgtgaatgtaacaacaaaaataggcagtttagaatctgcgatgaaccctaagtttattatttcggtgggagataacttttatcagaggggggtgaaatctgtggaggatgctgcgtggacagaaatattggaagaaccttttggaaaattaagcaagcatttaaaagttcattcttgcttaggagaccacgattggagaggaagtactacagctcaaattgataggacaaattacgctaataatactcgttggtatcttccaggatactggtggtatgaaaaagtaacttttacatcagaagttagtttgccatctctttttgagaaatcaggcttaggggaaatttcagcgaataatagttttcattttaattcttccaaaactgaaaattccactagttgcgaaattgattgcttgggtgaaatagttgataacttaaatacgatggttagtagaaacaactcctggaatgaggatcttagttataaaacctccatttctgaatattactctgaaaagcaggttaattccactgctgtgtttatatacatcgatagttggactttaacgcaagatcctttcaagaagacttctatttcttataaacactcacaactagagtttattgaacaaacattaaaggctgcagtttttgaaaacgttgattggattatcctcgttactcactattcaatttactctagtggtcttcatggacctcatgcaagacttgcaagtatccttctcccacttattaagaaatatagagtagattttattatttctggtcatgaccatcattctgaaattcttgtgccagaagattttaattcctatttccagattgttggagcttctagtaaacctagaacaagctttggagcaactgacgaaaattctatttttaaatccaatacttgctcttttgcttcattcacattctccaaagatattgctgtatcaagaattttctctattaattcgtccttattcagctatttcaaaaggtcaaataaatttgagagatctaaacttaagatagaagatactcaatatccacattttgtttcctcactcagggtgaaaccacttattaatgtttctggttggactttgtccctttcattattctcatag

SEQ ID NO: 3423 - DNA, 1413 bp, Cryptosporidium hominis
atgaattcaaatatgagcaagcctcttttggagattagaggcaatggatgtcgtaatctttcaagaagttcaatttcaagttataaaaccatgaatcgaacacagtctttggctatttatggtctttttgaagatgagccagaaacgcttccaggacttggtggtgcaattcaaggatcttctttaagtgaggcagtttcagcaatggttaatactatgcttggaattggtactctagctatacctttggcgtatgcagctaatggtttattacaaggaatattacttacaatcttttgtgcatttttatcatctctttcactctatctcctatcctcaatagcaatggaatatggcgatgatgtcagcttttattcagttactgctaatcatatgcccgggttaaagttgattgttgatagtgcaattgttatcaaatctttaggagtatctacttcatatcttatggttgttggagatttagtatactcgttattcttctataataattcttttgggattgatccaaaggttctgagagccattgttctattaacatcagttgttttttttattgctccagcatcttttcctcataaactaaaatccatgaaatataccaactggctcagtgttatttgcatattatatgtagttgctgttgtattcttcagacttatgtatagtgtaagaacaacgtatttgcctgggcttgaagaacaacctgcctttttaacagggaacttagattacttcagtacactttcacttcgtagaacacttgagacttttcctatactcatttttgcatttacttgccaacaaaatatattcacagtatcaaatgaacttcacaacagaaccttgaatagactttctaagattattatcatttccattggaacaggtgttgttgtgtattctatcattggaatttctggatatctacttttcggtaatctaatcaacaaagcaaatgtattggaattatttaaaactaatactttggacatttttattgcaaaattcttcattgcagtatctatggtattttctttccccattcaatgccatccatgtagaagatctttatcaattttactttatagtggtgtaactgaaatggaacctaaagcagagaaaagagctttgaaccttattacagtttttattcttgttttaacaacatcttgtgccatttactttacaaatcttggccttgcttacgaactcgttggtacaatatgcagcaacaccactgcctttattataccttctcttttatatattaaggtctttgatcacaaaggactaacaattgaaaaactccttgcattctttttactcattatggctgttttgattcttatattgtgtttgagtgcgatttttatcgggttattgagaaagtag

SEQ ID NO: 3424 - DNA, 2850 bp, Cryptosporidium hominis
atgttgaaaaacctcacgtttaaacctccaactcgttcattcatagcctgttgcattgaatttcgagaaagacaggaattttgtagaacaaatattatacctttactattaaagaggcactcaatttctaaaaaattagcaataattaaatccaaatcagcggaagaaaatgctgtatcttcaaagaaagaacttaaaatcttgatccgtgagattaccaatgcaattagaacttccccacgtaaaagaagaccaagtataagggaatgggtaggagaggttaaggatctcataagagctagggaagtggtggcaaatgaaagattgaatgaacttcaaaataagcttttggatgctaaagttgattattcaaataacattatcatgaacgagtcaatgttggataaagtagtgataaggataaattctttagtacaaaggcttgatggtttaaacttccgtgaagaatctatattagataaggtagattacttggatttaaagaaaatggaggttttaacccaggtgagtgattatctcaaagagttgcttgtattatcaaacaaaattgagcaagtttctgatttaatgaaaaaatcaaaaagcctgaaaagctcggaaatatatactttattatccaacttaaaagattgtacattaaaaataagcttgattgaaaatggaagaaatgttaaattaaacgtaaagaattctatgtacagtgagatttcaaggattttggattacattttggagattttaattaaccagattactttgtttttgaaaaattattgcgattggggccagcttgataaaatagtacagcaagttcttagcagaaaatcttcacaatgtgttttggacagccctccagatctttttaaactagagagaaacgagagaatttctcattctattggtattttgcttgtattagcttctatttgtattgaattaggatttgaatgtagagagctaaatggttcagcgagcatagaattgagtaatgactacaagatttcaaagattaatgtttgcgaggaaataatttctaggatcggaactgatattgcaaataaggtcaagcctttgtttttttcgagaaatagttctctttcgaacatcgaaaaaccagaatggcttcttgagacatatttttcattattcaaatctcattctgaatatttgaataacctttggaatgatttaaataaaaattttatgaaaataaaaaatattgaggaaaatgatgctataaaaacatatacgagtaagcatattccatcttatatagataaaaaaaagtatatagaagagatgaataaaattgttttagttgaaccaaagaaaattctgagcattactttaatctacaatcttcagaacgcactaagaattttcctaagaagagccttatataaggatggagtagccataagagataacaagacagactgtatatttgagaagttggtagaacatttattattggtttatagacaatggaaagatatagatgaagaaacttcaatgtttattccattcgacttaataacaaacttaaatgttaacaagttatttttaacaaagaaaagttcaatagatgggttatttgacgaggataataatattctacagatggaggatctttcaaaaactgctgtcagttgggcaaaatctgctttcacattggttatgggaaatccagattctgagtaccttgaaatgtttaataagccttcgactttcccatcagagtgtggaatattagattggtattgcatccttaatcgtatatatatagcagggcagactttgggatacctatcagaatctttgatttccagttatatagataaatttaatatgaaaaggtcaatacatgatttatattcatctatttgttcccactgtggttcttctgatcagaatataattttgaagtggttttcagaaactgtggtttatatttcaaatgactctttatcaagaaatggccagactttgataatgcctattaagtcttcatctaccggtaatcagggaattagtaatcttattttagttttgggttactcaatagagacagttgaacttttgaatgcattttcaggaaaggttatgctgcttgtggattcttgtaagtctttcgagaagagtcaatattatttggataatgacgaaggtggtaaatataggatcaaagatataattttagctaaattccatgaaattaagattgaattggattattacccaccaaaggttttcacagaaaccttttctgtccctattgttgaacaaagcattgttaaagagtttattaactatgttagaaaagaatggaataaaattggacataaggtaggccctatgattccaatggcttcaatattattagagtctgttgatattgtttactttactatagtcaatttaggccaagatattaatgctaatagttcactcatatccgagtctaaattatataatgacttccaagaattaaaactaaatctcaaagaagagaaaaaagagaaaatgggatatatttctactatgtatgacggaccaatggtaatgcttaaagaactaaaagaagaaatgattaatgacataaaattagaacttacagaagtaataatcaagcctttaatttatagcgagatagtaataccctcactagaagacttattgaactcgaattcattttcaggtaacgctagacttctttttgatgataatcttgcaaaaaaagtcaatgaacttaaatacacatttgtaattttcagtctatttctttcaaattcgaatcttactgaaatatcaaaggcattatctgtctga

SEQ ID NO: 3425 - DNA, 3750 bp, Cryptosporidium hominis
atgtctcaaaacctttctccttcaggaagcattcagagcaatgacagctccggatcacggctagcaagctttgagagggtcagagttatggcaaactacctagaattatccgcttttgaatatattcaaagatgctcagatgattcaggttttcagcctagtgattcaacaatgcctttgttttatattttgagctgttggaagttactttggtgtctttcaattaatgagttaataggtgagagtttaagaaacatgattgaagcaagttttacgtttagaactgatattggtggcggtgggaatggttatagaaagctattgagtattccagaaatgtcagaaggtgaagtttcgagatatgctatggcatattctccaatcttcagagttgttttgggggtattgagatggcttagatgggaatcgagagtaaatccatataaacagaacgatattgtattcaaagaaacttactacatggattacccagaatcaaggattttatggaaaactttaagaaatcaaaaacgattttatagtctagattgggcatttaatgttgacaagtcagcaatttctcaatcagatagggaaagtgtcgaagaggtattcaaaatagcgtttatgctacttagaaaaggctgtagaatgcaactggatgcatttcttagggagagagcaaaggctcactggttaatatgccttgtggatggaatggattcgtatctgtatccagagaaacaaagtgaccactatgtagatctttcagagtttattgatgttctaccaaaagttgatgatatgtggattaattataatgaagaggatgatgcaatggaattggacggggttttaactgggaaagcaaatgaaggacaacctgtaaattctatgagcttaataaatagggaattagctttaaatgatgctttgtttaaggtctctttcgaatatattgacctgatggagagaagtttaatatttccatcttctgaagattccacaaattctaaagaggttgaaattgaaactgaaggtaatataaataggccactgcttttccattttctgagacaattgatatctgaaaatagaaatcaaaatacaaagttggaaaataaactaggagaatgggagctttctttctattcaatcttatgtggggactttgaccaactttattcagtggcaggagacaactttgacaagttgtttgcacttttccacactgagaaaatcaatatatttaacggctgggcagactttctggaatctagaactcagtcaggaagaaatcatattttcctcggaaagacataccatgagaagaagttggaaaactccttatttaaaaggttgcaactattaacacaggatttatatccagaacttacaagctattatttaccagaggattgtgaatctatttctgaatataacttgatcaatagtattcaaacaaggattgatttgggaaatgtctcaatactagataaagataatgagacagacattattggttataatagcagctgcttttgctacgaccaggataccaaaggcgtaatcaatatgatggaactagagaagcagctaattgattctttaattgattctattgcatgtttagattttgatggaggtaaatcatcgtttgaaggccattttttccaagtatatttgggaattattgtctctgcattgaacattagagaacatgcagatgaccttgttcgagctcttgaaaattttatgaattatatttcgacattatcaaatgagtcttcaactcttgggtctcttaaagcgtttatctctcagattacaattgcccatcttgaaattgaaaattctcaaaagcataatatcaaaaattactcagtgaatatttttgacgagttcactttggcttcattgccttctatggattacttcgatactttggagccttcccaagctagcattcaattagaaatactctctgatccaatttctatgcatcctttacataatctttccaagaaccaaaaagataggtttgtctcacaatatttgaattatattcttgagagcaacagtcagtccttggatgtatttttgataatgctagagtattcatctgaagaatgtaaattggaatatatacttaaaatactttcaactcatcaagctaatttagagatcccaagctttcaaaaattggtttataatctaattactcagtttcctacagaaactatgcaagttactatgaccttacaagaccaactatatggggaaatacatactctattcagtagagatggaggcaattctcccgaacatatagattccttgatttcatatttggaattcgttgttttactttttggaactattttccagtttctgataattaggcaagactattctccttcatctgaactaatcttcaaggttctgcaatatataaatcacagacacacaggattcaatggaggaggtgtagtaagccacagttctaattatttgggagaatcactcaagtctctagagcaaaatctactatctgaaaatccttgtaatcaaacaacaagtgaagtggttattgggttattcttcctgagtcagctaaaccctctttgtctattattgtttgcactggaaattacaaaactttctggatctcgcgatattgacacccttgaatatcaccaatttgtattgtacgttacacgatctaatgcatgtatgttcgagtttattattccgttagttttagaaccaattatgatcagactaattactgtattggcgtctaatactgagaatattggtccaaattacagcagatataaaatttcaaagttaaaagaatctcatggaattcttcaagcttcaaattgggagcaaaatctagcaagtatattctcaatagggaactttattcaagtgcaaaatgtatttattccattttctccaattagatttctaagttcacagcttacattctttaaagtactaggcttagtaaaaatttatcatgagtctgtagagaggctttgggattgtgttaaacaatcagaacaagatgtttttaataatgaaaaccttcatcaatttgggttaggaggctctattaagcatagagaacatttgcaaagccccgtcatatctcctggaagtagcttactttcatcacctttcaataagtttgcatctcctgcatccaataatcgaagaagaagctctcttcagcaattaaacttggatagacaaattgatagtgtaaacgaaagtatatctcaggtaatttcaaagatagaagttgtattacagaactggttagtttttgatccaagccagtacaataattcacctttaatagaaaattgtcgagacaaagaatctcaagaacaaggtaaaactgatatttctcagcttataggatttcttcctgagtactgctcgtttgataaagacaactttggattagacatcttttccgttcatcattgtaataacaaggaacttttaaaaaggtacagatccattaatatccagaagctatttgaccagctgattctcacagtagttttccaccgtgatattgagattctttctactaagaaaaaccctattttccctagaagatcaatagactctaacaaaggtcactatttatctgagctcaaatctgtatctttcttaaataatatcttaggagcaattgaacgtagtggctggatatttatagagtgggactag

SEQ ID NO: 3426 - DNA, 408 bp, Cryptosporidium hominis
atgttaggggttacgaaacttccaggtcatggttcatcaacaaacgatcagaattcaaaagatgatccatcaaagagagtaaacaactgccaggtacaaagtcctgagttatataagagatttctggttagcactggtgtttatgcgctatttggtacaattatttctggaactattggatctattgcattaaaatctccaatatcaagaaggtttgcgttgggagtgggttttggagcaggattgggttggggtgtcaaatctgccaatgattttattaaatatactgagaggaggaactttgtcccaccatttcctaaatcatctgatgagtggatagataaaggcgttcttacattccagaagttcaagaatgctttaaagaatgcagttgataagaaggaataa

SEQ ID NO: 3427 - DNA, 369 bp, Cryptosporidium hominis
atggattttgagttggtaatccagccccacgataatcctgaacaagaatctatgacgttgaagcttcagggaaaaaacatggagactgtgggaacatgcttattttttgctgatactgaacctacaaataaagatccatcggatggaaaaccaaaaacagggataaatgagaatcatctgcataacgatttaaatgatgataaagacgtagaaatgagcgatcaaaacagagctaacagcagttcagaaataaagccccactcagagacacaaaatagagaatccgatatagttaatgatggaagcaaatctaagcttgtatgtataggaaagtgcaaaaaagtagttcaagcttttattgaagattag

SEQ ID NO: 3428 - DNA, 1347 bp, Cryptosporidium hominis
atgactcaggaatatcaaaagagtaatcatgactgtgattttgacgagggagaggcaagtggagatgacgtagatgaagatgttagagaagtggagatgaatattgatgaaattgaagatgaggttacagatgatgaggatgatgagagcagtgaggaaggtagtgaggaggatgaagaagtagaaaaaaaggtccttccagagagagcttctagagggaaaagatacactcagcttctaggtgaagaggaggaaaaagatgttaagttttggggccatgatacatgggaagaagaggaggaagacagtggatggtcttcagaggatgagaaggttgagcttgagatgctgggaggtgaggacacaagcacagattctgagaatgataaccaatctgatgatgggatggaagaggaaatggaggctatggcggaagatgatgatgatgacgtgatcgatggtaaaaagcctaaaaaacctaaacgaatgtttagcggaaagtataaggacccatcattatttttaaagtctgctcagaaggaaatgcttaaaaaggctaggaaaaaaacaagcgggacaaagaagactggtattgtgaagaagagcccagctgtgctggaacctagaacaatgtcagttagagcatccacaactcaaaagaaacaagatttacaagaatccattaaaaggagagatgaggaggcccaagacaggacaaacagaaaaagattaaagaagagttccacttctaaagaacaggcaaaaacagttatgactcaggaagaaagacttgaagcctgcaaggaaattgagaaaatgaatatagaaagcttaaatcaattggaggcatttgaagagcataaaagatatttggacaacacttctgctagtataagaaaacaactacaatctggttctcttaacatttatatatcttggtcatcttaccgtcttatggaatcagaaaaaaacaactctgatgaaatacttaatagtgatgaatattgtagggagatgattatatatactgatgggaatattcctcaacatttagaccaaaaaaaggattcaaatactaatttgcatgtcaaaagggaagatggtaattatccaccaatatgtagcgtttatggcgttcctgccaagtatttagatccacttactaacaagtattatagcagtttggaagcttttaaaatgattaggaagaattatcatgcttcaaaatataaagaatttcttccagagattagagaggttcaggatctcatcttggaaactaagaagctcattggtgaggaaaccccagattaccagttgaataactcttttgttaaagctgaatag

SEQ ID NO: 3429 - DNA, 1254 bp, Cryptosporidium hominis
atgatcttatccccaaggttcttgaaatgtgcgagaggttttctaacatcagactactacttttgtgcaaccctatgtcctcaacaaaagtatgcagatcatgaatccaatttctggggggaagactttactacaggattcggtggaaatctaattcaagaaactcttactagtgagactgaaaacggaggaagtggcctcgttcttgctgattacattctcttttgcaattcaaggcaccaatttgtggccacttttcgtagattctctattggcgccagacccaaaactccccccgtaaagaattcctcctacgtaaatacgagctctcctgatgagatctttggtgatgaagctgaaatatgccttgtcaacattatgacttctgtaatccgtagtcttgaaggttccaatgaacctacaatatatacttcaactgacaaatttattcaggaagtctcgataaatcctggaggaacaacaattacccaacccaacggttataatagacaaatcatgcaaacaattaattctagggattacccatttgggaatccatccagaggaaataatatttcaattgaacctgatgaaactaattttgttgggacaaactcggagtctacattaagaaggagggctgaaggaattgtagcatcaagcaaatggaatgagagtcctaactcttccctttccggagctcaaagttttcaacaactttctgatcccagtggagggcagtatatctataattcagaggactttatcggagttaagaaggatgagagagcgagcatatatgttccaagttcgagtttggaaatcgaagatccgttttcgaataagcttgaaacttattctacaggttatactgatgaagactcattttctacttttaatgattctggagcccaattatcttttagttttgatccacaggatgccttagttgttgagtcatccactaattgggttttagatgttttgctcaataagacatcagaaaatcagacctatacacagaatcagattcaaaattcccaaggcttacaatctcaccagcctagaaatttctcaaatgacttaactccatttgatcgttcttatgatacttcagcacttaagaatcagagcaactccaccatgagcgctaaccagaatcctaatattgttggcaatcttgtaactaataacgacggatttgattacgaaaatgaaaacatctctacaggaaatgacaataattcctattga

SEQ ID NO: 3430 - DNA, 861 bp, Cryptosporidium hominis
atgtgcaagggaagtcctgattgtccttcaaattgtccaaactaccatgtggttggtcttggatggggatgtaaggtagaaatgaatagaggaggtggaacaatgagaaaatatgttaatacttggcatgagtgtcttggcctttgcaaaattactgagaattgtacttattggtcattccaagggatctctggagttgaaacttgtttattagttattggtgaggttgggtgtacatatcacgctcttggatggatatctggagatgttaatgttgttgcaatagattgtcccgtcaaatgttttgtaggtgaatggtctagctggtcaaaatgcccaaatgacgatgtttgtacacaaaactccatatcaaagagaagtaggcctcttatttctactcctccagatatgaatcaaaaaatgtgtcctcaccttactgagagcataatgtgcgaatgtgctacaaaaatgacaagaaatacagcatttgatgactttaatagaaacttaatctcctacaataactctactactcaagattcttttaaaaataatccagaaattagaagaatgtcagcatcgactaataggatgtctaggtctaaaatgggagcatactcaactgaaaaccttcttaaaaacctttattttgattttagagaaaactatcaaattttaaatgatcaaaatcattcatatcctagaacacaagtggatgaagaaagtcagaacgaagattttacattgagaaagggaatagataactcatatgatattcactttgctctatcatcgtacttgcttggagttaactatacaaacttccgaaattctacattagatccaaatttgttcaactaa

SEQ ID NO: 3431 - DNA, 270 bp, Cryptosporidium hominis
atggatcaatttaggtctagagaaagacttatatggggtgtagtaggggaagaagctttaaaaaactctaaaatattaattttagggtcgtcttctatattaacctcagaattggcaatttcattagcatcttccggaattggagagatagtattggtggactaccaaatcgctactgaggaagattatggtatatgccttagccttgatggtgagaaagcaaacattgtaaatcagccaaaaatatatctactaaaagatttttgttaa

SEQ ID NO: 3432 - DNA, 1035 bp, Cryptosporidium hominis
atgggaaagcaagttatgggttctgtaggatttaatcaattcctgcgttgtgattctgttttgtatcttttggtttaccctcaaaaacctctttgcaaaacaagaactatagaaatgattaactttgagcaacttcctgcaggtcaaaactcttctgttgctgtaatgagtttcgcaggctatgatattgaagatgctattgttatgaacaaagcttctgtagatagagggtttgctagatgttttgtaatgaaaagacaaacaatagaattgcaaaaactaccaaatggactctcagaaagagtagttagacctatatcaggagcattaggcaatactggaaatagacgattttcattcaaaaatgatggtatattagataatgatggagtatgtaatgtaggtgtacaagtttctgaggatgatattattgttaataaaatgtctcctataaatacaagagaatatgttggagacccatctcaatttgacctttctgaatataaaccctctccagtaaaatataaaggtccaacatcatcttatatagatagagttatcctcactgaaaacgcagatggaaaccaaatctacaaagtaattactagacaaaccagaagaccagaacttggtgataaatttagttccagacatggacaaaaaggagttgttggattaatcatttctcaagaggatcttccattttcagaaactggatggtgtccagatctcattatgaatcctcatggtttcccatctagaatgactgttggaaagttacttgaacttatttctagcaaagcaagtgtcttagatggaaattatagatatggcacagcttttggaggcactcctcttgaagaatctgctaaatgtttagtagaacatggattccattattctggaaaggagtatcttacatcaggaaccacaggagaagcaattgaagcctatatttttgttgggcctatttattaccaaaaattgaaacatatggttcttgataaaatgcatgcaaggaggaaggggtcctag

SEQ ID NO: 3433 - DNA, 2187 bp, Cryptosporidium hominis
atgatggttatgctgttaaaccttggatcaaaaaacccagaaaacagtatcattattaatattttagagttctttattcaaatatattcatcactatctaatgaatttaaagaaaggatctggaatacaattctagaaaatacaaataaacaattagataaatcaagctcagaactatctcattctcatctttatttgctttataaactgacagaaactgctggtttcgaaaatcagtgcttatctcaaaagaatgagcaagatctaattcttatttgtggtaaaaccttgaatataatgattaattctcaagatattgagctatgtctcataagatactttgcttatattggtttcttcatgattaattcaattgaaaatatccaccagaaaataaaaaatgatgaaattagggaggtttttaactttgaaaatcttcaaatattgatccagaatattattaaaaaaaaccatacttcaacttttactgaaaaaattcattatataccatcattagtctccatatggaattctattaattactctactgattttacagaaatcattgttgagcttcttgtttatttttactcttctagatctaataagtccagtttacagaatgtaatcttctttttggatactgtctcatctttgaggtggtttctattggataaaaaggtctcattttcaagcttgagacaagatttacacttggattttgaaactttatcaataaggtactttgagaatgaaatatctaaactagagaaagaaggagtaaatgatgatattgttctgatgaataaaccaccaaactttactacatttgttgggatgatttacttattctttttagatatctttagagttgagaaagatcttaatcttgaagaagataccattttagaaggaacttccaaccagcttgtttacctcagagtttaccagctaattcatgagctaatagttttagaatcttttggagatgatcaaatacaattggaaatggtaatcaagtcaaatcaaaacttattactaatacacaaaggaatttcattgaaaagttttggttctgactcaaatgcaaaagaaaggattgctaaagaaagccatgaactaattatgaataatatgagattcttggttgggaaaagacaattctctgtactaatatacactcatattaattggattgaagatgaaatcagaaactcaataattaattttgaattggagtgcctagaaatagattactatataaatttaatagacatgctttttgagattttaatagagattcagggacttagaaaagagattcaaattgaaaatgaagatgataaggccatgattgagaaggtaacaaaagtaattttccgtattttcaaatatcaactttattctcaaatatatagtcacccaagttactttgaattgttcaaaaattttactcgagatcacaaaatatgtgaaaatgaagatcaaattcaaattccagatttttcaataatattaaggcatcacaagaaacttgaaattatgagcctgaataaacttgaggagcttcttgaaaaaaccaatgaatataatcatcaagtatttgacttattagtactttctttgttaccttacaactatacatataacttagagtatggaaatgctagaaatctagtaaatacacgattatttaagagttgggacattttaagaaatttggttttaaatgaaacaagaaaaaaaacagaactttctctagaaattggtaaatcttctttgattattaaaataaagacatttctaaacaaatatttagaaattttaaagaaactgaaccaagatgatttttctatagtcttgccatcttcttctgttgtaacttggtttcaagctttatttgaacaggaaggaagggaaataatagaacagttagaaaactgtttaagtgataatgagttaaaacaagttgaatatgagttttcaaagtggattaatatgggagacttttatttacccacaggacatcaagaaatctctatagaattattatcaaaacttataatataccaagaagatgagacaaaacaaggtaattcagggaaaaaagaatggaaaaatatttgtgttgcttctattaaagaattagaaaaggaaataaaagaaatcttagaatcaattaactaa

SEQ ID NO: 3434 - DNA, 1158 bp, Cryptosporidium hominis
atggaaagtaatgaatctgaaacatggaccatctttgatgacgaaaaagaaaaccctgttattcttctattcaaggatctgaaacgatggctagctttattatggactactattgaatctttccatctttatattgaacttttagaaatgcttaaccaaaatgaaaaatctcatacagagaatactaaactagaaaagtttcttatgaaggcttgtttctctattatagaatgtttgctcccttttatacctttaagctggacaaagttcttcccagaaacaaataatgatccctcagcttctgaaattaatcctgaacttggatctatattatgttctccttccagctccctcgaagatgttggagagtacctcaggaactcttcattctcaaaagacacaattaatccaccttctggaactaaatccaatgatcatatgaaagtttttctccaaactattgaaaagtttattttcccttatattggagatcagaactgcttttcaaaatccgtacatattagtgcattaatcatgtctctaaaactttcagtttataagcaactaaacaaaagtctattttcttacataaatcatcctccaatttcaaatagatctctggccatgcttatttctgatgttgcatcggatcaaatactaatgttagatttgaaggttccatctgaagtttttccttcacccaatctttccaatattaacgaaatcaaaaaatacaataatatatccatagccttattctcaaataatgatatattatctcttccagaatataatagctacattaccactaaaaacgattataatattacttctagccttggacttatggaatctatgctaccttattcagaatttgcctctctgattaaccaaaaaatggtcacctcaaaccaacaactggaagtccattttagaaaagaaactgctcagttgctttctaatattatttcagaaagtcattttcttgatcaaaacaacttattttctcatgaaaccatccaaaccatcttcagaatactccttaaaaggtcaatccatgttgctaaattctggtcatctgtaccttcagagtcccaatactaccaacaagaaaactcaaaatgtgaaaatacaaaatttgtttccattttacaatga

SEQ ID NO: 3435 - DNA, 2514 bp, Cryptosporidium hominis
atgaagtcttcaaagaataagagccgagggggtgctaaaggactgaaatggaaggaggttgagttaggcagtgatttattgtcagaattcacaaaatatggagtaagcatgattgaagaaatttcagacccaactgatatttctttttatgagttgggaaaggataataacttaatatcaagccctgattttaataagagtgaaatggaggctgagaagcctagtaaagttaagaaatctaaaaagagagctaataaagacattaataagggcgaggttgagctctcagatagtattacgaagaagcagaaaaaagctaaaaaatcattaattgaaaacaaagaaattaacaataagactcagaaaataagttctaaacagaataaccagatcatcgatccagaagaatattgggaagaatactatgatttaaagcaaaaattatcaaactggacaaatattattgatgaatctactaaaaacatgagcaaaaaatcatcctctgaagaaatggaagagctaaagtccccagatttagttatccacccaagcattttaaaaggattatcagagctagggtttttaaacccaaccccaatccaagctgcatgtttggttcctgcaatcagggatagaaaagatatagtcggagcagcagaaacaggctctggtaaaactttagcgtatggaattccaattattgcaaacataatgttttcagctcaaagaagaagagaaaagcttgaacaaaaatctcttaaggaatatgatgatggctttgaagaaccagatatccaattgggtatagaagaagatgaaggctttaaagaacttgagagaatgggatttaaaatgacaagtgtgtcaaatatagatagtaaagtttcaaaaaataattcgtttaaatctgatgaagctcttcaagcactcattgtacttccaagtagagaacttgccattcaagtaagggatcatcttagagctttaggtaaatatacaggtcttggtattcatgcttttgttggaggactttctttagagaaacaggaaaggttaatagcaacaaatagagtacaagttgctgttggaacccccggaaggctatctgctttaatttttggggagtacgagaacgaaactttgtttggagatgaaagagaagcctctaaaaaacaagttaatacaaccttatcaattgatgaaataagatttttggtacttgacgaagctgatagactaatcgaacaaggacattttagagaattaaagcaaattcttcagcttatttattctgataataaggagagtaaaactcccaggaagattcaaaactacttattttcagctactctgactctgccaaatcacttacatccaagattttctaagcttaatacaagaaacacaggtaaacaatcaaaaggtaaaaaagatattcagaataataaagttatgtccataatgccagaaaattccaataaagcaatgcagagtattatgcagtatgtaaaacttagggagaatcagctattcataatagatttatccagattcaagacaaagtcttcattggatgaaaatggagagcaggtccaaactatgagccaaccaaacggaattatacagcttccaaaaggactcaaaatttcaatgattaaatgtgaaagcgatgaacttgaaatgagattagttttatacctactaaaatactttgctccaatatgggataccaaggtaagaaatcagccatgctctctctgtccaagttatattgaaaatgggaaaatactagtctttgttaattccatatcatatgtatatagactagctcctcttttatctttggttcttgtttgcaaagatactcatgaaaaggagcttcctagtccaaaaaaaagaaaaaagtgtagtaaggcttgtaacgaaaaatcactcaagattattggaatacatggcaatctctctcaaaaacagagaattcaagctattgaatcgtttaaatcatccaactctgctattctcatatgtacagacgtcttagcaagaggtcttgatatcccagaagtagatgttgttgtccatctccaagccccaagaaatatctcacttatgattcacagaagtggaagaactgctagagcttccagacaaggcgaatgtgttcttttctgtactccaaaagatgttcctgcatactccaaacatcttaaagcaatttccttaagctttgaatctgttggaactccagatgagcttcaaggtttactatcatcacaagtatcgcatgtacaacaacgtttagaacttgcaaatgaaattgaaggtcttggacattctattctaagaaagaaaagaaacaatagctggatgttgaataaggcaattgaggcagatttggagctttcagatcaagaagagttctccttttctcctgaccaaatgaaggaaatccaaaatttaaacttaaagagaaactatttctttgactttgtaaaaaattttcagaaattctaa

SEQ ID NO: 3436 - DNA, 3396 bp, Cryptosporidium hominis
atgttggtaatcaaagaagaggattacaactctttgtgggcagaactacaatgggatggagagaagtttgataaagttatgggatattttcgtaagtatgcaggattggaggaaggattgagcagagaaaagctttctaagttattgcttgacttaggaaaaagctgttatacaattagaggaggtgtgagctcgatgacagagagaggggacctatgctggatcatgagtgggactgacatgttaagcggctcccagtttatgtgtttggcaggactattggataattcaactccacattctactagcagcccagcaggattgttaagattggaaatgatatttatgtattatgataaagggaataaaggatactggaatatgtatgattgggagcttttaatgagagatattcaataccctgcaaagaatggtgagaagttggtcccatatccacttggagctgaccaatatattaactttgaaactttgaaaaagttggtagatacaagaaggcttagaggtacatctcaacttttgagagtttcttttgattcagaaaatccagaaaagaaagcaaatatagaaataattaaagatagtaatattacagataaaaaagtagattgtgagaacttaatctctaatgttaacaagccattaaatgataataatacatttagtttgaaagaaggtaatgtagagtatattaaattgagtgaaaagacaacatattcaccaataatccaaagcagaggtaaaccagatgaaaagttttcaagcaatgtaaatacccataagttgcaagttttttctccacgaaagaaagtggcagaaaagaaatccccatctaaaaaaaggcttcaaaaacagaactctggggttcatgagggatttaacgcgagccaagatacattgtctcctcgaccgttaacttctagagggacctttgttgattataatacaaaatcttcagcttatcaagatggagtttcctcttatatgtctagaatccccgttgttacaaatgctcttgactcaaattatacaccaaggttagcatttagaggaagtgttgcaccaaattcttattacacagtaaatgatggaaggcaatttatagctaaccaagtaactccgtcagttgttccaaatgcaattcagcatataccttaccaaattcctgttaatgtaccatatcaacaaatgccaattcaacaattcatgaggccaacctcaaattatatctccccacatattgcagctcaaataaataagggaataatggagcccggatcttcgggctcaccaatgatgaattcttcaaatgttagagctgatgaccgaagtggaatgcaaaatttcaacaaatttcaaacttttggacaatcacttcaaaatatgggtcagtcaatcatatccatgattcccaaagtcttttctgtgcctaatattacagtaggagcaggcaactattcttatgtatctcaggatgatattcagaagagaggtagcaaaagtttgaatgatggagtagttaatcctcactttcaaagctctccaaagtcgattattaatacaaatgaacaaccggatacaaatagtatatatggttcaactaaaaaagcaagtgataacagcaatttcaatatggggggtgagactatgagtaatggaatgatgcttccaaatttccactctacttattcaaatgagaactatccaatgtcaatagatttatcaaaattgaatgctgttacattaccagtgattcctgagagtggtagcaatttcaattcttatcaagtaggaaattctggaggtgagatagtgattaaagaaagtgctaatgaggtagaggatgttaaactaaacaaaattattagccatgaaattaaatcagagatagagattggtacaaaaaagccaattaaaattgaggaagtagatcatttcttcacttttatggagcaattactatataatgaaatagttggcagtgctggtctttttgataaggtattagaaggtcatgaatccaactttcaactttcagacaaagaagagatattgattggcccattaatgcagttaactacaatggatcagtttgtgttaacatttgcactaaactgcgtagtttcacatcagaattctggtaattcatataaccaaaatgaaggagttcttggaaatggggtttcaattgatgttgttggtgagaagattaattctcttatagatttgttccatcgtatctataggatcatgtatcaggatttaagaaatgaggttgagagaaatggcgatgctatattgagttcaaatagtatagatgaccaacaaaaggttcaagataaagacccatttgttggatatggttttcttccatatattgttaagatggtatgggagaaggttagagcagctctagagggagacttggatgttattgaaactattaaggacatttgtgttgtttattatcattatttattggagtcgaatggatcatttgccactgagaataactccgaagaaagttctcaagttctaaagtgtagttctattgaggaaatgattgaaattgttaggcaaagatatgttgtagctatgaagatgttatcactgaataattcggccaagactaacagtgcagaagcgaagaagattaagaatcaagcttcagtagtaagacaagaaccgatgccagatccatcaatttcaaagattagtcaggctcctcattcattacctaaaccacaaacttgtattgattattctcatctccaaaataagggtaggagtattgggcagatacagaaccaaattcgctatgaaaaccaacttagaggagaaaatttcaatttgatattgaaggaagttaataagagtgtctttgtacctgttgcaaagagtagagtcaacaattcatctcctcattatcctttaatgacagcaacatcatcccctaattacaatttaattcaacaagagaatatagctagggatacagagaagaaagtagtggttggaggaaatagctcaagaagaagtttgaatttagactctggagagtctaatccaaatgtaattccgtgtgtactgcaagaatcgatgatagatacagaaaattctagtcagcatcatcataataaaatactgaatcatcaagaatcagtagtaagtaaaggcgataacatgatgggaggcgcttcatccattatgtcgtttacatcctcggctaataggaattattcatatattaataacacaaataatggtaaagcaccagcaaatattgctagttattgtccagcagaacatacattaactgataagatgccagaaactagattagaaagaaaatctagaattccatccagaatcttataa

SEQ ID NO: 3437 - DNA, 489 bp, Cryptosporidium hominis
atggatgtttctctgctaaggcttagaaaagaatttgaagatgttggattaccagagttttgtaaggtaaaatttaatacagaaacagctcttgataatgatactatagaaaatctatgtgatacaagcaagttagatcttgataatatatctaattgttttgtagtagttttacaacctaaagagggtatttggacagataaaacactacaatttattattagggtaccaaaagagtacccatttaagcctccaaaagtgaagtgtttaagtaaaattcttcatccaaatattgataagcttgggcacgtttgtattaatataattagagaagactggaaaccaactttaacaatttccatagtaatttgtggtttactcaacctcttaatagaaccttctaactctgatccattcaatgagtttgcctccattctgtttgagtcaaacctctcgttatttaaatcaattaatagatccctttattag

SEQ ID NO: 3438 - DNA, 678 bp, Cryptosporidium hominis
atgaaggaggaatctggtaaggttctaattccaggtcagccagttagacgtatagtagaggccaaagagccactatatggagtctatatggatgataatggagatatgtatgcctctttaatgtgtagagaggaccagattggtaaaatgcaagttggaaacaatgaaggaggaaaagccataggcgtagtaaacagagttttacctagaaaaggagtggaagttagacttttagataggagtggtagaggatataaaaatgaaatagagggtgtaactggcctaatacgtccacaagatattggatgttggaatatgaatagtgatgcagatccaaatgtaacatatgcatcctcaacatccggattttcatccggttcagcttcagtgggcttagctaatgatcatttagaatctcaggctagctattggatgaatgactgctatagacctggtgatgttgttaggtgctctattctaagtgttgttcctcagattttgctcagtacaaactctcaagatcttggctgcatttttgctccttgtaagagctgtaaactaggtatggcttatcctatatcatataatgctgtactatgtaagaaatgcgggacatcaatgcttagaaagactgcaaagccaaaattagactctgaagatagggagataattgattaa

SEQ ID NO: 3439 - DNA, 1008 bp, Cryptosporidium hominis
atggcaattacgagaagaagaggagcggaggaaaataagccaaagagtactccctctagatcagccagaagaactaaggaagaggatgtggaatttggtttaatggaagtgattcgagaaaaagtatatagtatttcatttttatttaaaagtatgataccatcttggggattattacttttttggttattttcagctctagaaagtagctttttttatatatacgtatcattattctccccacttcttagacctctaatttttgagggccaaggccacaaaatattaatgagctacttgggaaatcagagtttctttcctttacttcaaaaatacaagataataagtcatattgatcaagttttcggatggttaagtacatgggatcaaacaaaccaactaagatttttagcattctgttcatctttcatttttggatatgtaatatatagaggatatgaggtttgcccaacttactcaatggtaaattaccaccttggtaagtatccaagttttggtataatgatggggtcggtaatatcttccactttgggaggagtaatgggtggtattttattattttaccttgaaaatgaatatcaaataattccaaaatatctacttgagggtttgaagcatggggattacagtcttttccctctgagcagtttttttggagaagctctactttctttcctctatagtcttggagttagcattgtgtgtagggttggaccagggttttttggagcagcagaaatctcctggttttcaaatgccaatattagtataattgctagttccatgagggctcctggaaacttatctctaacttattctgctctttatggtgcatactctggagattatataggagccacaattcttggaattgcaaatatcacaggaactttgttaatgaatttccttttgatgtttagaggaagttcaattgcaaaaaagacccaagttaggcgcaagaccacaaccaaatccaaacaaaagtaa

SEQ ID NO: 3440 - DNA, 1713 bp, Cryptosporidium hominis
atgacaaagagtagcaaagatgatacgacaaaggtacttaagaaaggccagaaggtgtcttctggcgaacaaaagaaaagtggaggaatgtctgggcttgatatttatatgaagcagtttccgggagcactgctacccaagacacaaataatgggatgtgagtatcgacaaaagtccgctcagaagagtttgggcaaacctttgttaagacttccagaaggtatggatcattcaagctctaatctcattagaatctggaggccagctctagtagtgcactgtagagagagaagaagggcaaaacttaaaggaagcagtactaatcctgcaatgaactatgactactatattcactgggaaggaacagatcgtaggttggattgttggctaacatgggaatctttgagagttattccaaatgaatacttacctctttctcacagcaagccaaaacacgaccatgaagtccagaattcagaagcctctacttcgactaacgaacctccaaaacctaaactaaaagcttcggatatttctgttgcaaaagatgacataattattggggagattccttattatcatgacatagcacatgaaggaatggatgaagaatacttaaaggagcacgaagaattaaccaaagtaaagacaattggcaaaatagctatgggaccttttgtggttgatacttggtactattctccataccctaaggaagtacagaatgttgatattttatatatatgcgaattttgcctctcattctttgctcattcagatgaatatactaggcatcagagatgctgcattatgttctatccccctggaaacgagctgattagacaagatggactttccatgtttgaagttgatggaaggcttgccagagtttattgcgaaaatctatgcttcctttcaaagcttttcttggatcataaaactttatacaactctgtacatctctttttgttttatgtccttactgaatgcgacgataaaggttatcacattgttggatacttttcaaaagaaaagttcagcaagaataatctttcttgtataatgattcttcctcaatatcagcgtaagggctatggaaagtacttaattaacttttcatattgtctttcaaatcttgaacaaaagccaggctctcctgaaagaccattatcagatcttggtagagtctcttatatatcttattggggctatattttactagaacttttaatggacggctctcaggatgtaattctttggaataaaccccaaaaagaccaacctcaggagaaatcattactgaaacaagctgcaactataagtaatttccaagatgttattcatcaaactcagtccactcagaggactaccagatcttcaaaacaaaaagagagaaaaatgaattcagacgcaaattctgataaatcttcttgtccttccattggatgctgtccaaataccaggttcatcactgtccaacagttaagtgagatgactagaattgaatgtaatgatattcttatgactttcaatgaatttggtcttctaaagtctctcagcaatggggaaagctttgttttccttcctgtacaacttattccccagctactccaaaaaactggaaaacctgccacacaaatgtatctctccaaaattaactacacttcatatgaaaacttcttggctccttttgaatgtaatgctatccagtga

SEQ ID NO: 3441 - DNA, 2367 bp, Cryptosporidium hominis
atggatgatccgagttttgatccgggtagctcagagatggctttgatggaggtaatggcaaagagtttacatcatgtttttgagactttccaatatgaagccaatacaacattaaggaataaaagcgaccaagcaatatctaaatctctggagcagtatgtttccagcttgaaaaatgtgttttctgagtcatttggtaatttgagtacttactttggtaatcctgatgaacttcaggaatcaatggacatgtttttcttcagcgcatatatatttgagctattctacatggtattttattcggatgaagatgaattaataaataatttgttcaaatggtatcttaaatatggaatgagagattctgtttctcagttagttggacagttaactgaagcttctgacaactttttggatttacaagaaactggtagggtatcggaagctatgcatgcagaagaaaggcttggaaagctccttacaagagctctattattgggagaggttgaattatttaactcaagtctttggagtttgtttccgaacaataaatttatacttactttaagtaatttgctaagccattattcgaaggacatttacccaattagcagaggcttaaccaaagaacttcaatcattgaagaatagtcttcctgctgtagttcagactgccttagaaggaatttttggtaatggaggcgtaattcaggactgttctgattcttggttagaagcttttgtgttttcttcaaggtatgtttctggaataactttggataactttcctcagttcttatctgtttacttggagtgtttaagccagtatacgtctccagtgtctggactcggctcttctgtgacgagatcgtcacaaaataagagatcatctgctcttaggaaagctcctcaagatatattagagcatgaacttggagctttgtatttgctttcaagggatttaagcaaattaattgttcatatatacgagtcatctgaattatatgggccatttcttgctgtacatttgtttgatcctctcttttatgaaggatttcttgaggaagtacctttggaactcaagtcaaagaatttgagatccagagttttaatgaactatgctctttggctggtagagactgatctttgtgaccctgcaatttatttacaagaatgctcagactcaccagatttaaaagatgatgtactaagagcattgacattgatttcaaataagattcctttcttatttgaatatatatcagataaccttgaaacagaggcagatgaaatctttcttatgagtagtggagaatcaagcgatttaaagtgtagacaatgttttctaaatgagtatatcccagattggagcatggatgaatcaatttcagtatttctcaagttaatcagagatttcattcatcagattgtgcctttaaaagatcaacagatcgatttttctagaaaacttatagtggagagatttaaccaaataactttggagcttcagaaatcattcggacccaaaatatctctaaaacaactgcttttgttattggaaaagataattcttcttatagaattggcaagaattgaaggtacaaaccagatagtgtctatttggatgattttggagcattttgtaggtgtttctcctactctatttctgaatattatcaacgaaaaaatagatatgtattcacagtataactttcaagaaaatctcccggaagagtacatggcagaatctgttccaacaaaagatatctctcttgataaacagcttattttaataacagaattttatccccaaagagggattttggaaacaatttcacaactaattcctgaattctccggtcaaggatctaatctaaagatccctccatttttaagaacaatgattgaattttcccagcatattaatttgatattttggactgttctctctcctacttggaatgaagaaaagcaactttgggaatctacatcaaattttgatagagatagtcttgcaaaattgagctgtttaaaaaatcaactttgccaggaatgctctttctaccagtcatcctcagaggaagagatcttagatgatgcagctaaaacgattttatcagtaaaccctaacgccatacctcaaattttagtacccttatattgtttatattgtcataagctccttgaaggacatacatcggggaacattcagaatgtagatgtcgtttctggtatctattcaagctggatggatattctctttgcccatgcagtatccgatacctgtcatcctttcattaataactcaaatttaaattcgacaattatttccgaagtttcaaacaccattaacaattctttcctttga

SEQ ID NO: 3442 - DNA, 222 bp, Cryptosporidium hominis
atgtccactctaatgcctacccttcatattcttacaaattatgctaattcttttatttattatattttttcctacaaaatgataatatttattattgctgcacatttcccgccaaaattgcatgacttgaacaaacaaaatatcgagttagaaaatagtaaagatgctgagtatagaaggaagtttggtaattcagtatttatgagcattatttacccataa

SEQ ID NO: 3443 - DNA, 1152 bp, Cryptosporidium hominis
atgggtaattctataggagttgagatttttagaaatcaagctgatatttgtatagcaattaatgaactaaccaacaaaaaagaaaaggttttaattctagaaaagataattaaaagggatgaaatgaaagagaagtttatggtattgggaggatcattaaaggatatagaactggaggaaactaaaagtcaaagatttttgttgatatttattcgaataagtttgttggattttaagagaataattttagaaattatggaagaaattcaaaaaaagattcaaatttcagtaatggtagaagataaacaaaatcaggaaagtttttatttattgaaggacagcttaggtacagactttgataagttagaggttcttttgtatgaaaaagaaagtacttttgaccctgtaaggatgctgaaatacaactttgaacttgaagattttctggaaagatatacctttaaaaacaacttcactaaaactttaggtatatttaattgcctggatgagcaagaacccatccagcttcaaagtttaaataacaatatagatttaacacactttattcatatcaatattggcaaatcatgcacagaattcctccattctacggaaaattcttgctcaaaaagagttggaaatattgaaattggagaatacaccttctggggtttagtaaatatattagacctcaagatagaaaacatgggggacattgataagattgtttctaagggtaatattcaaaactgtgatttaattgttaaagatatttatggacaatcttatcctgaaattaatcttgaaggagattctgtggcttcttcactgggaaaactacaatttcttaactatgatcagaagaacttctctccagatgatctaattaagagtatcgttatactacttacaaaccagcttgtacaaaaaggaatattgcactctcaaattctccaagaaaacaacattatcatctcaggatttgtcactagctccccaaaaattatggcagctattcacaatacctttcaagttttatctgataaatttaatgtattcttcatcaaatcaattattaatactgcatgcatttgtcctaattttgaagtaaatactaacatcacttccttcttctcctccactacaaattag

SEQ ID NO: 3444 - DNA, 498 bp, Cryptosporidium hominis
atgtcaaataaggagcatgaagcaaaagagcgtttccgtccaggagacatctttgaaggatattatttcccaggagttctatgtggtagaactttatgctactatagggatgtggtaagactacttaaaggctataggagaaagatttcaagcatggatagagagatcgatttcaagaatccaggcacctttaagttgtttagtcaaacatatagagagatgaagtttagtgcagtacaattttgtactgaaattgaagagaaggaggaatgctttcagattctacttggtgttgttattcgtctttttaataagagattagagcttgatttaccagataatcataatactaattatcaaagtgaaaatgttccttggaaaattagtcaagaaaagattggtgaatttcaagctaattccgacagttctaaggatcaaaaagctggaaataaggaagacattttggatttgaatgttagtattatgattatgggatag

SEQ ID NO: 3445 - DNA, 1158 bp, Cryptosporidium hominis
atgagaaaacttctcaaaaagacattgttctcaaatataattattttatgtctttatttaggaatcttaaaatgtgttaactcacacatttctaatgaaatccaaaaacaaaaccaaacttttgacaaggaaaacctagaaagtaaaaacactcaaaacttacaagaatcaaaaaaccccacatctaaattatcccagacaatcctcaaagaagagtttaacttcctacctaatgacgttgaaataaactggaaaggaagggtactagtaatcggagacatacatggagatctgaaatctttaattacaagcttattcctctctggagtcattaatagtaacttagactggattgcaaagaacactctccttattcaacttggagatgttgttgatagagggtcccacgctttacaaatttataagctattcaataagcttaaatctcaagctccttctcttggaagcaagtttgtgggactattaggaaaccatgaagtaatgaatttatgtggacaactacattatgtgacagatgaagatttccaaacttatggaggaagagataacagaacttttgaatggtcgaaagaaggttttgtgggtaaatatctaagaacaatgaagcttgctattagagttaacgattccctttatgtccatgcgggtttactcccaaaatacgcaaaacttggtctggataggttagacaaactatctaatgacctattggaaggagatttttgtgacttttattcatctctcttttttgtggaggatggacctctttggacgagagatatttcccttggagaggaggagaaagcttgcaaacttgttgatgagacattacaaattttgggtctaagtagaatggttgttggtcatacaatccaacatgataataggattaacataaaatgtgataataaacttgtactagcagatactgggttttctgaagcaatatatgggaaaccatgtatgcttgagattctatatcataatgataatccagatccttcaaactataagtccttccatccttattctataaacgagctacaagtcaaaagtaatccctcaaaacctaacattaaatatattcaggtgaccagcctctttttagacaaaacatctacaaaggatgaactatag

SEQ ID NO: 3446 - DNA, 279 bp, Cryptosporidium hominis
atgatgtttaccaatatgactgaaaaaactgcagaaacaactgagatggactgctctggaaggaatttcctgagaaaaattggtgacaaaaagaataacccacacggaagaaaaactagggagattgtaaacaagacaaactcagtaagaactttcttgttggaagattctttcagtaccttagaaatcccaaatggagcaggacctacgcaagagtcgatagatttggctttttcctttgacattccttcaaatattttcaacaaacaaaagtattga

SEQ ID NO: 3447 - DNA, 1035 bp, Cryptosporidium hominis
atggtttcagagaagaaagaaaggaataatagatatttagaatgtacgacagaaggcccgagaaatgtaggaggatatggttacataggaagcaatgagttaaattcaattattaagggagataattatagaaaacaaacggttgaggaaataatagaaacgatcgatataaaagtgaacgagcttaagagtgattatattaactttgacatttctggaatagatgcatccatagcaaacgctcttagaaggattttattggtagaaattccaacagtagcgatcgaaacggtccaaatttaccagaataatggagtaattcaggatgaggttttagctcacagactcggactaatcccaatgctaatcgatccaaatacaatcgaatttagaaatgaagatgaagacctcaatgaaaagaatagtgtttgcttcaaactgaatgtgaaatgtactaaagatgatataaatcacgaaaaaggaatcacaagtaaagcaatttactcgaaagatttggtatggattccacttagtgataatcaaaggaaaaagtttggaaagagtcccccgaaagttgttactgatgatatattaattacaaaacttagacctggccaatcaatagaggcaattctttactgtgaaaaaaatattgggagagttcatgcaaaatggagtcccgtttgtactgcaagttaccgtcttttacctgaatttggtttcccaaatggccctatttctggctcggatgcacttaagctaagagatacagtatgtcctatgaaagtttttgatattgaagatgttactgggaatgctgtccctactaacccaagaaactgtaccacctgtagagcatgtattgaaaaatttccaaataagataaagctcttaaaggacaagtttcactttattttttcgattgaaaccacaggatgtattcctcctgttgaactggttaaaactgccatagatattttgcgaaagaagggtgagaagattaagagttccgtcaagttgttttatgagcagtga

SEQ ID NO: 3448 - DNA, 723 bp, Cryptosporidium hominis
atgtcttgcatgctcaagtattgtacaatcaaaaaccaagatcacattaattcgcttttgtgtttagtaagtgagttgaaaccggtaaatgcaagacttgattttcaactagaagaccatgaaaattctattatggactttaacttgaaaatcttacagaccatttcggagatatatccaggtttggttgaaaaagcaatttctcttatagatcatggaaagattgatgtgtatattgaaaggaaatcctgtagaagattttatattatggaggcaactacaaaaggacaagatatgagttatctggtcatgagacatttttgtacgtgtcattcttacatagacaaagtagtgttgcaaaagaaagagattacgtgtaagcacgagcttgcatattatttgttggattcaatgtatatatctgatattattattaattcactggatactgattctaaattgtatccagagtctggatctgaaaggggcagtgttaagaaagaatatgaacaagtgaataaaattaatcaagagaaagaagtaaacttaatgggtagttcaaatcctttaataaaagttcacttggtgagtgagacaatgttttcagaagtatatttagaatatacaagtaggttctttatagatagtggtctatttaagaaaattgggggaaaaaataaaggagctcaagaaataaaggaaaatttaattagaaaagagtaa

SEQ ID NO: 3449 - DNA, 1632 bp, Cryptosporidium hominis
atgaactactcaaataaaaataagttagatgctatggacagtgagcatttaggatatgcaggaatatggccatctaatggtaaagatgctaagatagtacctatgggtactccgggagttcctttaacagatatttatgacgaaatgatacattcaaacggccgaaataactcccacaaattaactccaattggtgaccattcctatcctataccagttcctgttccagtaattacacccagaaccagagatttaacaagaaatataattcaaggagaaaataagtctattactggaagccaaacagtaatgaattcagcagctttaagaccaaagagaaggtcttttgagtctcttagaaataagagccagccacctcaacagaatctgatgagtagcaccaggaaaatcccctctaaaacaggattaggatcaaacgaattagacagatttcagagacaaaatggaaattccatcccaaatagaaggtcattgggtagtgtttcaagcacagcaggaaataaccccgcaaattctagatcaaagaagtcaattaatgaaatgaacgccagtaattctggaattccaagacgaagtagcagtgtaacaacagctcaaaggaacaatcagtctaattctgatgttgagagacacaaggtacctgaagattatgcttcaaggcccagttttacaggttgctattcaaattacccaaataataaaactgaatatccaacagtgccatacccgttttcaattgattctgatgacggacatttgagagataatatcaaccaatctttttatcaaccccaagaaagacttccagagcgacaaccaaactttgatcaatttccacaaaaaagaaatccaactagaagagttactcaaaatgcaccattaaatccgccatcaaatgttaaaaatttcatggctggaaaatccaatgccccttacaattccaatattacccattataagggggaatacttacaaaactatggagataactactataacagagaagaactatactcggctccaaattatggaagaagctctagtgctggtagaccaacctttacaaattcatcaaccttaaacccatttgataactgtattcctcaacgaatgaataatcaatacaattcggaatctcttaactgctacagtgtgccaaatagatataagaattctgtccatgactttgcaagagatgatacgtttgcagactcagcttcatgcttaaatccagccaagacattaatgtattgctttggtgaatacggtgccttagaggctgagaagcatattagacaaaactactccagtgcaaatgaagtatttaaaccaatggtttatgaaactattgtctttcctccagggtactttgaatacaagaaacagttagaagaattaagaaaaaaatatctcctcgatacaaatccaaatgcattctaccaaatgaaacagaatggtgaatttattgatcctaacccaactaatggaggatgcatgtggaaaaatggaaaacaaatgaataaaaagaggagtcatcctgtttttgttagaactacaggaaccattgatcatttaaacagaataagaccaagccctgcctgttattgttaa

SEQ ID NO: 3450 - DNA, 402 bp, Cryptosporidium hominis
atgggcccaaacggtggaatgggtatggttcaacaggttcctggacaatattaccagcctcaacatattccagggttcaatcaatatgcaggtttaatgagaccagagggatttccagtttatacaactcaatggccaagtgcattcaatggaggagatccaactcaggttcaagcacccatccaaagtcaatatctacctaacgaaacccctgtatattatgcatcagcacaatgggatactcaatcttacctccctatgagctattatgcaggagcttatgacccaaatggaatggcttatccattccctcaatctggctccttccaatacgtacaagatggtccagtcattccaagaaagagaggtgcaaagaaacgtttattcaagttttgttgctaa

SEQ ID NO: 3451 - DNA, 234 bp, Cryptosporidium hominis
atggataaaatatccaatgtagcaccatcattcacagaggaggactattcattttatataacaagcattgtcaaggatatgtgttttaaaaattttgatttttcaaaacttacaattttagaaaataaactctattggaatatttatattgatgcaactatcctaagttttggaggtaatatggttgattgggtaactatagcaatccatactgctttaagaactacaaggtaa

SEQ ID NO: 3452 - DNA, 1500 bp, Cryptosporidium hominis
atgattaaaccagaaaaaaaatttgttactgaatattcagtaactggaagactgaggatagcctccattttggatggggaggatggtggggcctcttatattgggaagaaggttacagttggaggatgggcaagaacagtcagaaagcaatgctctgacactttgcttttcatatctctgaatgatggttcgacatcaagcaacttacaatgtgtagtggagaagactgttaaagggtttgaagagggtttaaaggcaacagcaggatgttcatttaaaataactggtacaatagtaaagtcaccagctcagggacagtcagtagagttgcttttgaatacaggcgacgatgagctcaaaatttgcggattgtgtgatgcctcaaaatacccacttgcaaaaaagcatcattcaaaggaattcttgagggaagttggccacttgcgtccaagaagtcagttctttagctcagttatgagaatcagaaattctcttgcttttgcaattcatgaatatttccaaaagaacggtttcttgtacattcacactccaattattactgcagcagactgtgaaggagcaggagaaatgtttcaagtaactacagttttaccacctgaatctagaaacaatatttccaacatccctgcatcgaagattgagggaagccaagatatggcagttgactataaaaaggatttctttggaaaggcttcttatttgactgtatctggacaacttgctttagagaactttgcatgctctatgtctgatgtttatacatttggaccaactttcagagcggaaaattctcacacaacaagacatcttgctgaattttggatgatcgagcctgaaatggcatttgctgatcttagtgataacatgaaacttggagaaggacttcttaaatacactgtagaatacgttttaattaacaatatgccagatttattatatcttgacaaaaatatagaaaatggacttgtagaaaggttaaagattatttgcaaagaagaatttgcaagaatttcctataccgaagcaattgaaatgcttaaacctcatgataaggaatttactgttcctgtctcatggggcatggatttgggttcagaacatgaaaagtatattacagatgtactcgagaaaaaaccttgcataatctacaactatcctaaagatatcaaatccttttatatgaagctgaatgaagacggaaatacagttgcagcaatggacatcctagtcccaaagatcggagaggttatcggtggttctcagagagaagatgacattgaaaaattagaaaacgcaataaagagcagaaatatggatccagctccctattggtggtataatgaactaagaaagtatggttctgttccacattcagggtttggtttaggatttgaaagactaatcatgatggttaccggcgtagagaatgtacgtgacgtcataccattccctagataccccaatcattgcgaattctaa

SEQ ID NO: 3453 - DNA, 669 bp, Cryptosporidium hominis
atgattaacttcatcttaaatgaagccaaggacaaagcaaatgaaattgaggcgaaggctttacaagattttaatattgaaaagttgaagttagttcaaagctataaagagcagattcgtcaggatctcaagaagaaagttaagagattagaggttgaaagagcaatcgctagaagtactgcaattaataaggctagacttaagaagatggcagctagagcacaagttttaactgaagtagtacaacaaacaagaaagaaaatgtgcgaaatttctactaatccaaccgtctacgagccacttttggtagatttacttactcaggcaatgttgaagctcttggaaccaacagtaattgtaaagtgtagaaagtctgatgtttctgttgtagaaagcgcaattccaaaggctattaagaaatataaggagattttacagaaggaatgcggtgtctcaatgaatgttgaggctaaggttgacaaggagaacttccttttccctgctcctacaagtgttgagcagaattccaaatactgctctggtggagttatggtcactaatttggatggtaagattgtttgcaacaatactttggacgcaagactggacttagtcattcaaaatgacgctccaatcataagatctactcttttcccaaaggctgcttaa

SEQ ID NO: 3454 - DNA, 3729 bp, Cryptosporidium hominis
atggataagaaaccaaaacaaaatttaagctctcagagaggagatcgccagtcaagtatcctttcattcttctctccaaaacctggagttaagaaggaagcaagtaatttcttacaaaatacatcaactccaattccaaagaacaaaagttcgaggttggacgatatattaatgagcgaagacaaagatattgaaagggagcttttgaattcagaactgagttttagtgaacaaaagttggaatctataaatagagattcaacaaggagacttagagatttagaaatgctttcagcagatgggaatgcaactacatgtgagactacaccatgtaagtcaaaaaacctaaaatctgacaactttggtgtggaaacaacaggaagaagaattcgaagaatttgtgattcagacgaggaactaaattcagattcggagattctttcacgtagaatcaaaaggagatttaatgatgatggattggaagacaacaataatgaaagaagtggtttaccagcttcacagatagatggagatatctcaaactttgggtacgatattaaggatgatgaggttctggaggcggaaatggcagcgaaaattgaggaaaagattccttcagactttacagatttaggaaagggcctgccaaaatcccgtagaaaagagacggaaataaagtttcaagaaggaggagattcagtaataaatgcagatgaggagttggggaaagaactccttggtacagctgcggcacagagtagtctgctatttagggattacgtcgaggcaatgcttcaaataggtcgtaatttctcacttccatcttgggttcaattacgaaatattagggattccaaaggtactcgtcctttagatccatgttatgacccatcaacaatttgggtaccaagttcaaatagtagagaggcaaaagaggagagaatgcactttactcctgcaatggagcagtattgggagcttaagaaagaacactttgataagctattgttctttaaaatggggaaattttacgagttattttatatagacgcttatatttgtcagaaacattgtgatttaagatggacatcttcggattctaagccgcatgttgggtttcctgagacagctttgcatgcatatgcaaataagctagtggagttaggatatagagtggttgtagtggagcaaatggagactccaaaggagttggaagagcgaaatagaagtgcatcaagaggggtaaagaaagataaagcaataaagaggagcgtaaacgaggtgtttacaaatggtactttggtacgccctgatatgttaagcgatatggccagcattttaatgactttatacttttcgaagaaagattctgaagatttggcttacgagattggagttgtttgtgttgatattactacaggcaaggcagaacttataaatattgaggagaagggagaccaatttttgcaagtcaggacaattgtatgccaggtacaaccaaaggaaattgcatatttacctgggaatatgcctttgtctattttgagatacttgagttccattgtcccttcaatccagctaaccaactttagagattttgttgactcagttttagcaattaatgatattttggagacttttgaaaagctaaatgttccggttccagaggtagtaaaccatctttgcaatgaatcaaaatctctatgttgtgcattatccggtacttttcggtacttaacaacaatattactttgcgatagattaattatgacaggaacatttactgagtatgatccatctgtttctaggcatctgatagtgaatgttggagcaataaaggacttagaattattacagtctcagcatggtgatgaaaagaactctctatttggctttttaaaacatactattactccaggaggaactagattattaaaaagatggattacatatcctttggtcaacactgataggattaatgaacgcttagactcggttaagtggttaatggataactctgaaaagttgtatgaatttagagatgagcttagagctattgaaaggtcagcatcttcagcttcaagaggttcaagaaagaagtactcacaacacctagattttgagcgtttgataaacagaattacttcgggtgttttgcagaataagagaggagcagtttacttttcgaacgttgttcaaagaaggtttgatgagtttgttaactcaatgaatctttttgactcagttcttcaatgcattattcgtgtttttggggatgagaacctaagaaaagatatgcctaagcttttggctgctttaactggaatcaaggatgaatcttctgagggattccttgagaatatatttgctactactgaaagattaagatctttggttactttggattcaaatggtaaggattggattcctgttcctggtaattgcaaggaatatgatgatctattagagtccataaatgagacaaagttatgttttgatgaggaactcaagagaataagtaaacaaatgaatactacagcaatttcttttgttaacaataaatacaggtacgaggtagaatgcccagaaagcattccaaagtcaagattcccagattctgcagaaattacatcatcaaagaagggttacgtgagatttcatactgaagaaattaagcaacttgtatacgatcttgaatataaggaggagcagctagagaagagtttattcccttatttacatcttatgtgcaaagagtttcattcagaattatcatcttttatgggaatttcagattcaatttctcagttagacgtattatcttccttggctctagtttcactggatacttcagatggtccattctgcaagccagtttttctctctaaagaagaaaccaatgggctacctatgttagagctcaaggagagcagacatcctgttgtagctaaactcaaaactaattatattcccaatgatatattgttgaacggaggttcctcaccagctccttgttctttagttactgggcctaatatgggtggaaaatctacaattcttagacaaacatgtatttctgtaataatggctcagattggatgctatgtaccagcatccgagtgtagattaacagcagtggataagattttcactagaattggtgcttatgatttaattattgaagggaaaagcacattcttggttgagcttgaagagacagctgatattcttaatcattcatctgaggattccctggtaattattgatgagcttggaaggggaacttcaacttttgatgggacagcaatttctattgccactcttgaatacatttcaagagtaatcaaatgcaggtgtcttttttcaactcatcttcacttactttgcgatgagttttcaaatgacacaaaggttcttccatttcatatggatttaaagctaaataatgaaacaagatcaattacttttctatacaagttcatttctggtatttgtccaaaatcttatggtatgaatgttgcacaattagcagggataccacaagaagttattgataattcagtggctttagctaaagatgtggagtcttccactttacttttgaggaacatttctgagactaagaagcttttaatggatgttttaagccaagataacttttctaaaatacaagagtttttcaagaacaacaacaaatctattctaaactgtctggaatcattatcctaa

SEQ ID NO: 3455 - DNA, 942 bp, Cryptosporidium hominis
atgaatggaatattattaaaagatgagtatacagttgctagttatggtcttttatcagcaatatttaaaaaattggcagatgatatatctttttttaagaaatcaaaaatagtaaactatgtaaatttgaacattaaaaatattaaaagaatatcttctaatggagagatttattataaaatagattctggtgaaaagagtttatattcaagatttctggtaataaatgatattggaaatacattcgaattagtaagagaattgggatattgctctgactggatagtattgaatatgcttgggaaattccaaacaacaattaaagaaggattaaaaggggtggtaagtagcatgcagagtttatctttgccagagtctacatcagtttatggctttccagaaattaattcaaaccaaagaattcgttttttggcttcttcatatactcttccaataatatggttattaaaatccatgaatttgagtgatggtatatcaataaatgatgcttctcccaataattttaacttatttaagagtactagagaaaaattattaagaagcaaaattgaaaaattggagataaaaattccaaagttggttagtgagcaaattatacaaggaagtatgaaaattattccatcactcaatttgagccagctaaaagacaaacaacaaaattttgatatttctattaatcagttattagatgtatcaggagagaagaatcaagtaatactggatcgttcaaagattcatactgatgagaatttgatcttaaatatttcccagcctaatagcggtactatatgtataaagagtgctactgatgacatgataactatatgtaataagcttgggatcaacattaacgagagatccttaaaagcagatattcctgagtatgaagtgcatgaaggcaattttcaggatgaaatgtag

SEQ ID NO: 3456 - DNA, 549 bp, Cryptosporidium hominis
atgagtgaaaaagagaagttcaatattcatttgaagaaagataaggtaaaaatctcaaaatgtattacatgggacgaagaaactattgccatgcatgatgctgagagaggtaccagaatggaaattaatgagccagataccccatattattatggtagctcaagttcatctgatgatgaggaatcaaatacgaaatctaaagctaggcagaagttttctgtagatcttaatgaactttcttcaaaattatttgaacattccaaccgaattgatgaatctttagatgaattttcattttcaaattttaacgataatacatcttctccaattcataaatctaagcaagatctttttaaagaaaaaagaaaaatgcactatagagagtttatcactgccaaatctaaactccctaaagctaatgattctgactcaagctctagttcaggttcgaattccaattcaaattctgattctgattctaactctgattctgattctgattctaactctggctctaaaccatattctaattataagccaaagagctga

SEQ ID NO: 3457 - DNA, 573 bp, Cryptosporidium hominis
atgaaggacattttcacttatgagtcattccgtgttatggaaggaacaacagtttctgttaagtctagaactgttactgttactggaaagtttggtcaagttacaagatctttcaaccatttaccagtagatattaagttatgtggtaatggtaaggttgttagaattgaagtatggttcggtactccacgccatcaatcagccattaatactgtttgttcagcaatcaagaacatgatggttggtgtcatgaagaagtttgagtataagatgcgtcttgtatattcccactttccaattaactcaaatatcttaaacaatggcagtttgattgaaatcagaaacttcttgggagagaagagggtcagaactgttaagatgcttccaggagttgttgttgagaaatctaactctgttaaggacgagttaatcattacaggtactgatttagagcttgtatctcgttccgctgctttgattcaccaatgcgctcttgcaagaaataaagatatacgtaaattccttgacggtatttatgttagtgaaaagggtaccgttgttaaggatgagtaa

SEQ ID NO: 3458 - DNA, 963 bp, Cryptosporidium hominis
atgaggtttatgctgaatgattcccaattccagaatttaggatccattattaaagatgttaataattccagaggtttagattgtaatacaacatctatctgtcaaatttcagacattttatttgtagaatctgaagaatccactactcctaataaatgcaactgtaatccagaagttaataataataataataatgataatgatgatactgaagaattttcttattgtgaagaaaaagccttgttaattaaagctggtttctctgcctgtattagagcttttacttttgaaggattttcttcccaaaatactattgcaaaagtaattcgaatccttagaaggttattaaaaggtgcttctattattaatattaattgcaacattcataaagaaatattacaaggattaagtgtgatcttcggtatgataccagatttcaatattttcaaagtacttcaagctcctcttaaaaactatttgttttggtgttattcacaatccgaagatgattttgttattaataattctagaattcttctttgtgctattacttggatgagggaagtttcttctggtaataatagtaataatgataataacaatagtaatattaccaataataattctaataataatggaccaaaatatggactcacattattaagtcaagatttacttaactttctaatttctgatataaatatttcaacagagcagttccaacaagaatctaaacttactttgaacaatccaaattcttatattttagaaagtaaaaaaagaattcttcgaaaccttgaattattctctaatcttatcatatattctggattttatcttccaccaaattctaatatatcaaataacagccagaatctttttaataccggtgggaatttagaaaatacatgcaaaaaagaggcgggaaattttgttaccacactgattactcctcaaattatg

SEQ ID NO: 3459 - DNA, 3208 bp, Cryptosporidium hominis
  misc_feature (2784)..(2784): n is a, c, g, or t
atgagtattaatgaagaggatccaaattcccatattgggaaaacattggaagatgagaatgatgagaaaaacaaactcttggcgagaattaaagagctggaaacagaaaataagcaattaaaagaagggaataaagatgaaactatgattgatgattttaaaaagttgatagatgatatggatggtgccataaattacagtatgcaaatggtgcaagttaaggatgaggaaataaaaaagataaatgagaaggttttggaaagcaatgcaaagtggaaaggatatgtaaaattgttagtagatcagatttctaagaaaaataaatcaatagataatatgaaggaggaaatggacaaattctttgaaaagacaaagaagcaagaaattgtaaatagagagaataatagtaagctaacttcatatgaagaattaattcagatagatcagcagctcttgaagcagtcaaagaaaatagaggttgaattaaacaatagaatacggaaattagaagaagataacaaaaagtacataacagcattgaaaacaatttccgaaaatacccaaaagaagatatcaaactacactagtaaaatagataatcagcaatcactaattcgccacttagctttaattgtggataactttagaggaaggtttttgtacaacaatattggaagacaaaacggaatattgaaccaaattaataaaaaaagcagcttgagtgacgattcgaataaggaaattatgaatcctttggaatatgaatttggtatcatttggagtaactgccaagaaaaatcactccaaagaaaatgtgagcttttggagctatcttttaacttaaaaggacaagaaagtgaaataaatagtaactttttaaatgatttgctactaaacaagaatgtttcagcttcagatgcatgctctgcttactctgactatattaacagaattttaggcttatacgacttgttctgcaagttcaatatacttttacagtatttccaatataaagctctaaggtatttacagattcatgacatacctaatatgacaaatggaggagaaattacgggaattatacaatgggtttgtaatctcacaattgaaataggcttcctaatcttagatttaggttcattcataatgagcataagagatttttccaagtacaagtcatctacagaatcattaaataaagatgaatccggcctacaaaactttcaaattgctcaactcccatctcttcctgaaataaaagcaattttaaaatgggctgataatatatcccaagataccttgaatgataatttaaatcaaaatattacttatgaagaaattaaagaatttaaaaatctcctacatgcaaaaatcgtgaatgcatgtccacatgaaaatattgacaataaaaacgccggtattgaattattgccagtgtgctgtgtggacgcaataatgaatattaatatttcactatcaattctgctaagattaaatataaaatcagtacaagaaaaaaatttggatgaaatatataaaaagtcgctagaaatatcagaaaaattttactcgaaatgtggaaacttgagtttgaatgggatccattatccaattgatgataggctatatttatggaatggattatattggattagaatacttgaccaaagtaaaagtgaaacacttaagacatcttttgaagaaatgataattaaacaaaatgaaatttatgaaacaatacataatccaggggaaaatcatggagtcaatataacagaatctctggataagttatttaaatcgattcaagaaattgatgcaaatttagatgaatttttgaatcctattcacatggaattggaaatagaaaattctaaaactactgttagtatggactcccttcctgaaatcattatttcaaacaaattacaaaaattgatattgagcatggatgaccaaattgaattggatggagatgcgaatgataagaatagaactaactcaataataggccaaaacaaagaagggagaggagttacagaggattcagttgaagctcgagggctagatttagtcgatatggattcagggccagttggaatggtagagattgttgattcaaaattgattaatacagttaattcggatagtccaaagaaggcaagatatgaaaattcaatcaaattgttgaatgagaagattcagtctttaaaaaaagagttaaccgaaaaagaggtagcatattcttcatttgaagcaatgcaggatgaatataagaaacttcatgatcataagcagctacttatgcatagaatagaagagcaggagcttgagatgagaatgagtcgagaacgtgtaaagaaatatgaagatactgttaggcaaatgaaaattgattctgataatttgagacgtgatttggagaatttgcacaatattccaaagataaaggcatatagtgagttggatgtgttggaaccagtatatttaagacggttaatcagattaatgagcaataagttatatgagttagaaatgaataggtggaacgagaaaatagcaaaggaagatccaaatagaatattgaaatcaaattattcacaaaagattatgttgggccaaattcgctcaaagaattcattagatcaaatcgcattcaggattctggaaagggaaaggaagagagaagagaaacaaaaggaaaaagaaagggatgaagcaaaggaagagaataaagaagaaaaggataaaggcgagaatatggattatgatttaaatccacanaacgaaactcattgccaagaaaatgggaatttgaaaagcaattattttgacgagctgaaggatgatgagaacgactatacagatatattgactttattcgaagagtttaaagagctaaagagacaaattatgcttcacaggtgttcaatgccaattatgaataacaaaggatcagaagggacctcgtcattcgaaaaggagtgggaagaatacacaaaaaaagagtcaaagctcaagtacaaattgcatataatgaaaacttctttgcaaggattagtatctaaaacagggaaattaacggaagaaaatatatctaataactcaggagatacttatataaacaaaaagattggaaagatgttacttaaagttccatctgctgggcaggactctgtgttaaggatggttaagagtcagaataata

SEQ ID NO: 3460 - DNA, 780 bp, Cryptosporidium hominis
atggtagcatcaaacaaatcaggacaaaacaagaaaaacacaagtactcagaaggttcgtcatcctttgatcgaaaagacctcaagaaactttagacttggaggtgatatccgtcctaagactgatttaactcgttatgtacgttatccacgttacattttattacaacgtcaaaagagtactttgatgagacgcttaaaggttccaccaactttgaaccaattcacttgcactttggataagaaccaatcctcccagttactccgtctaatgggtaaatacaagccggagactcgtgctgaaaagaaggccagactccaggaagaagctaagaaggcagcagctggtgaaacaactgagagcaagaagccattattcctcaagtatggtgtaaaccatgtaacagacctcgttgaaatgaagaaggctaagcttgtagtaattgcttctgatgttgatccaattgaaattgtatgtttcctcccagctttatgcagaagaaaggatgttgccttctgtattattggtggaaaggccagacttggaaaattaattggtaagaagactgctgctgttgtagcaattgagggtgttagaaaggaagatcaagccgaattcgacttactctgcaacaactttagagctcagtataacgataatgttgaattgagaagaaaatggggaggtggaatcatgggtgttaaggcacaacatgttatcaagagaagagagaaaatccttgctatggaacaggcaaagaaggttggtcttgttgcctaa

SEQ ID NO: 3461 - DNA, 936 bp, Cryptosporidium hominis
atggcttttgttaaggttttgaagaataaggcatactttagccgttaccaggttaaaccacgtagacgacgtgaaggtaagactgattatcaagctcgtcgtgctatgatttctcaggacaagacaaagtacaactcaccaaagtaccgttttgttgtaagattgaccaatacaaaagtaatatgccaaattatctatgccacaattgagggagacagagtgatttgctcagcagattctacagaattaccaagatatggcgtcccagtcggtttagcaaacttttcagcagcatactgcactggtcttttatgtgccagacgtgtattgaaacaactcaatatggataaaatcttcactggagttggtgagattactggagatgactaccacgtagaggaagaggctgaagatagaagaccattcaaatgcattttagatgttggtctcactagaacaacaagtggaaaccgtgtctttgctgccatgaagggtgctactgatggtggaatctatataccacattccccaaacagattcccaggattcaccaaaggtgagaatggtgctgaagactcgttcgatgctgaagtactcaaggatcgtattcttggaaagcacatttccaactatatgtctgagatgcaggaagatgatccagagaagtacaaggctcacttctctcagtacattaaggctggtatcactgctgacaaactcgccgatatgtacaagaacgccgtcaaggcaattcatgctgacccatctcgtcagaagaagccagcaagaaaggtaaccaagactcgtgttggaaacactattaagaccgagaagtcccaatacgttagacatgttaagctaactaaccaacagagaaaggaaagagtccagaagaagatcgaacttgttgctcagttggctgctcaggaagagtaa

SEQ ID NO: 3462 - DNA, 879 bp, Cryptosporidium hominis
atggaggggagtgaaggtagtgagaatgaaactgtcgagtttgatccaaaaagttacgaagaaaaatcaagagatcaaaagacaaagaatactcagagcgaagatgacctttttgatttgtttatgaaggaggttaatgaaacaaatagtaaaagcacaaaccaaggaaaaaacattggcagaaataatcattcaaaaagggtcaaaatatcaaagttattaattgaaggaaaaataaaggaagccatcagtagctcatatggcaatgatgaattaactataggaacctcagaagaagaaatcctacgtctaacttcacgcgtgtttgccaatgcatatgaagttatagggataccagtcgattctgatgactctgtgattggtaaaaagtatagaaagctctcattattgatccaccctgataagacaagtcatgaaaaggctagagaagcgtttgaaatacttaataaggcatatgaagagcttcaaaaggctgaaaatcgtgtcaaatacaaggaggtctggaaacgtgctgaggaattagttaagaaagaaaacaagaaaaataagctcttcaaaaaggatcaacaagatcaggaaacctataaaaaggagtttaacaaacaggttatagaaatgtgcgagaagcttttaaatgatttacaggagcgaaaggagtatagcgaaaagtgtctcttagcaaatcatagatttgaacaagaattatatagacaaaaattgcaggaagaaaaagaaaggtgtgttcaaagacaaaaatggaatgaaaagtttgaggaaagagctcaaggttggagatcatataaacaaaataactctaaattattcaacaataaatctagctttgataatgatgattag

SEQ ID NO: 3463 - DNA, 1455 bp, Cryptosporidium hominis
atgtcaattaaatgtatgagagtctttgagacgtatatcaaccagtgtggagagtctgttagaagacaagcagatttaggcattaatccttttcaattcaattatattaaaacagtcaattcacttaatgaaattaaagatattatctataatccaggtccttgtgtagtaatggcagctccaggtatgcttcaaaatggtacatcccgtgatatttttgaaatttgggccccggataagagaaatggaatcatattaacgggatatgcagttagaggcacaccagcttatgaacttcgtaaggagcctgaaatgattcaacttggagaaaaagttatcccaatgagagctaaatttgaccaaatatcgttttcagcacactctgattttactcagacccaagagtttataaatagtttaaaagtcccaaatgttattcttgttcatggagaaagaggagaatgcaagaagcttaaagataagctaaaagaattatctccatctttggctgtttttgctcctgaaatccttcaaaaagtaggactaactttccctacacaacaagcaatacatgcaattggaagcattaccaatgaaatcaagaatttgatagaaaaagaagaaaatgagaagcaattgtttgttaaaggagagaaagataatcaaattgatatgaatagtaataatggtattaaaaaaataagaagagaaagttctaaaattgatattgaggaaactttattgattatgcgtccttttgaaccaacattattaatgaaaccacaagatgtatcagaaatcattgatgtgaaaaagtcttgtattaaacaaacaatgagaataccattaccaaagaattttgtaatggatctaaacaaattggagaaagaaattgagaaatcttttgatgatgttatattaaataatgaaatgatttatctatatgaaaatagtattgtaatatttataataaaagaaattggacaggatggacatgatcttggtgatcatgagctaataattcaatggaattcttcacaattatgtgatttggtagtagatactctttcattcatgattctggattatattgcttttctatcagaaaataaacaggatgaaaataacttagcagacattgaaatatataatactttaagatcatctatagaaaataactatggattatgtacagatggtatttatcctcaaatagaagctcaaattaaggataagaatcttgaaattgatgaatatagtaaaaaagacaactttccaaacttttatttttcagtaaaagataccagagataataaaagaagtgttatagttaatatactttataaagaaagaataattttaacagaacctaatgataataaagaaattagagaaaagatctgcaacttaatacagaatattgaagattctatcttaccaatccagttgctataa

SEQ ID NO: 3464 - DNA, 990 bp, Cryptosporidium hominis
atgaaaaatgtggagaaattagtccaggagctgcactcccataatgttaaggatgaagtaaaatttaagtataaaatcggtgatttagtttattcattatggaaaggtcaactatggaaagcaattattttagatacttcattaaaaatacatccaaatgggtggcaccccatttactatgtgggatatgtaacaaagcacaaaaccgggagtaagaattattatttcaataaagattataatgagtggaaatctgaagctctcatatttgaaatagatggatatacgagaaaaaaaagtgctgaaactcagaaaatgcttcgaaatgccttaaaagaccaagatcgagcaatcgttgagaatatgctcggtaagcttcattcccaacaagagatgaaaatttcaatattaaactttaataaaatagaagttgaatggtttgacttttctgagatgatatacagtgtcttgattcatgacaaaaaccaaataagtcacggaaaattggtgatattaccgaaaagcccaaacattgaggatatcttttcagaatatatcatatatgaaagcaatctaataaaaaaaaagaaagaaacttctcctgaaatagagattcagaaattgattttaaatatgttgacaaagattttcaataaatctctcaaaaagagacttatttacccatcagaaatgaatcaagttagctacttcgagaagaatattacaaaaagcaccaaattttctgaaatatttggcattgagcacttacttagactacttataatattaccgaaacttattggagatcatatttcattcggtgaatataacctaagtcttgatcctgatgaagagaataatcaaccagattacataattgtaaaaacaatcaaattggagctcatcaaaactgtaaattcatttatcgagtattttaacaacaacatctcaaaattttctattggaaattacaaatcattttcaatttga

SEQ ID NO: 3465 - DNA, 2925 bp, Cryptosporidium hominis
atggacccggacaaaagtctaaatgatcaccaattaaatattaaacaagatgaagtttctcttcaaagcttaccaatagataatgatttaaatctggaccactcacagaataactcccaaaatattgatattttcacaattaatgctgatacaattgatgatagtaaagatcaaaatagtactaatgagttaaatatggaggttatttctgaccaaaaatcaacaaatcaaagtgaagattttggctctaggtcaaatttagatcaattgattaagtatccattattggatagcttcaatcccaaacctggattctttcagaagctgattcattctcgtgactcaaaaactctgaaggagtacattttcagcccaatgagatgtattatcaacgatagggactcatcagggtgtactgctctacatattgcgcttttgaatgcctatccagagatgctggagatcctcttaagttgccaatcagaagatttaagaccaaataatggtactgaaaatacttatattgctggtgattctttatcaaatactgtgtaccaaaataatattattccaattgatttgtctattccatatgctggtataccaatttctcatctagtactttgtaaggcaatttttccggaaagatatgaggattgtatgaattgtttatatcttcttttaccttttacattaactcatggtacttctcaaaatgtatcatggctggatattaacgctacagatcagcttggaattaccgcgttacatttagcatgtagctttggtgattcaaaaattgtatctttattactagaatatggtgcattagcaaatatttcagatttgaataatgatgaaccaattcatcatgccatatcaagcagagatcctgatacgctttctgtaatactttcaagcggaggtgctgacccattgaaagaaacaacttccacagcgaacttaataaaatgttgtatagataaatcagcgtggagatgccttcatacattattgacagattcagaatatcagcaacatcctatttctgagagtgaatatgatttgctttcttttcatgcacaaaaactgggattaggatctgaatttgaaagagtgttttctatagctgttgaaattgccactaatgatgaatccgagcaaagaagggtaggagtaggagtaaatgaaagtctaattgcggatggcccttcaatgggactagcttcaactagaatattcacacatggttgttgcatagaccatatttctcttccagaaccaatggatatgccaattagacgttcaaaattagtgaataagattccagagaatccgacacgtatggaggtattagtcaaaccaaatgttggaattttaaggagtaatgagttttcattacttcaatggactgaatcgtgtaagcctgcaatattatcagatattcttagagttcatgattgggcatatgttcgtttattgcaacataaggttgaagaaagccgattaatttgggatcaaagaccatttcttaccggatctatagatgatgatacccagttaactccaggttcttggaaagcagctttacatgctagtggctcagttattaatgctgttgattgtgtctgcagaggcgagaatcgaaatgccttttgtgctataaggcctcctggacatcatcttggaacatggggagctgcgcaaacagttggtactaatgaaggaattccatcaggatcacaaggattttgtctattaaataacgttgcaataggtgcggcttattgtaggtatacatactccaatttaggtatttcaaagattgctattatagattttgatgtgcatcatggtaatggtactgaacaaattgtccgaaatgcatctccaggaaataggaaaatcaaaacattgtttaatccagttcctggtattaacttggatttggagcaggatatctcttattataagatttggagggatgaacttgatgcggaaaatatatttttttcaagtgttcatgcgtatgatggcacattttatccaggtacagggccagatcaatgtatttctaagcctaatattattaatattggactctcagaaaagaccacttcaaaaatcttcaggaacaaaattaagagatttttgttaccaaagcttcttcaatttaggcctaatattattttcatttcagcaggattcgatggccatgttatagatattgtgggaaaaggattcacttcgtgcactgagggcgattatacatggctaacccaacagctaataagtattgcaaatctttgttgtaatggtagaattgtatcagttttagaaggaggatataatacaaaagctttaagtctttcacctctggcaaagtctgtcgcagctcatgtaagaactttacagtggacttctccaaacttaatgccaaatccacaagaatgggatgatgagttattaaccgaagataacgaagatcttgagaatgaagataatgatatagctgatcacagagattctggcgtttttgatggctatcccaataatgatctaatcgcttttggtaattcaaatgttattagctataatgctgataatctgaacaattcaagcaattctaaccattatgttgttgatactggaggagcagcatcttattcaccaagcttgaaaagatataaatctcaagaaaagagtgaaacagatgaaaacccgccatctaacaatgattcatcttcagcagtattttctaactctcaaatggggagttatgaagttcatagcaatgctagtaatgttattaggccaaaacgagcagcagcgattaaagctgaagaaagtatccaaaagaagattcaatctgaattggattcttcaaaacaaattaatggcaataacttgagcgaaaatatttga

SEQ ID NO: 3466 - DNA, 2775 bp, Cryptosporidium hominis
atgcttaattcaatgaatttccatgaagaaatggaattgcgaaacaacgagagtttaaggatagaaagcgactttgagacatttcaaggacgtaagagtagaacagggtataacaggttttttaatgatgatgaggttgaaaacgtcgtacacataaaagatgtaccaatttatataaaatataattcaatttcttcaacatgtactagcacagccccatccaccccaaattctcgtgaatttgaccgtctagaaaataatgcaagacttaataacaacattgtaaataatgaaagtttgccgctccgttcacaagtttctcaccttggaaaggtgggagaagaaggattttgtaataatacaggtaatagttttggtagttgttcattatataatagaggaggaattttggagagctcgaatatgactatgcagttttttaacttcagaatagttaaaagaagacattattcaagttccagtaacttattaaaaagttttaacagagtacatatagaaatgaccaagccgaacgatttttctttcttattgaatagcgatattaatgatggaaatgactttcttcacttgaaatcagaacaacgacttttggttgattttcaggaatttccggtgatgctggttgatttattgaataggtctaagggaaatgggtgttctgacaactattttgatgcaagagtgagtaataaaggtataaatatagaaaaggagacagtatttcctggtataaataggtacgatcctggtaatttacggcccagcttttctccatcagcaagcgataatttgaattcactcaagattgttttgaatttgaatatttcagaaggagggatagagcaatcatatttaggggggctatcttcaggagcaactttcaattctgcactattaagtcgggttgattcatctacattgcattttgtggaattaaaccattacaaggaaattgttcacttatcacttccatttgaaatggctaatgaggctttctttagggactatattttaagacatttgaataattattttgatttgtctaatagacaacagaagataattactggttatgaggcggatctagagtcattaaggaaagaaataggactacttaatgagaaactttcaaagactaattatctctcagctcagaatgaacgtgatatgtctgaaaggttccaagctgagattaagagaatttttgaaaggtatgaaaacgattacaatcagataaaaatgatttatgaggatacacataatagagagttggagcactggaaccaagaaagattatcaaatgaaaagaaaattaaagatttgcaacaacaacttgacgaacttggaaatgcatttaatgagcttagcaagtcaaaatctagcttggaaaggtatatcaaggatgacaaagaaactaataatgggcttaaagctaagctggaggcaattcaaagctcatatgacgtattatccaagataaaggatgagcaggaacaagagttgaacaacttaaagctagagtataacagttctattgaggccaataagactttgagggacgaaatagataagaagaaaaaagaaattagtgagttagataccgcattagacgatgcatgcaaagagattgagaaaggaaatcaaattatctcaagccttcagacatctttgggaaatgtagattctaagtataagcagcaaatgacaagttttagtaatctaaaaaggagttttcagcaaattgaaagcaagaataggaattttgaggaacggattaaggactatgaacaatcattggatgattcaaataatcgtcaggaacagcttatagaggaaaatgagagattgaggaagattttaatcgaagctgagagacaaatcgaggtaaatcaaagcgtcatctcatcattgaagagacaaatatctatcaatgaatcaaatttttatggctttgaccacaattttaatgctggaatgtccaggagttactctaaatcttaccagggtttatataatactataggcggaggacaaaacaatttagcttctctgagtgggacccactattcacttggaaacttgcagccagctattgcttccgtttcggcatctcgaagttcgtatcttggtacacaatcgattaactccgtcaaacatagaaagagatcagaagccacatttgatgctaattccgttaataggaaatattctatgtctgttcagccaagaagatctcagacttggacaatggaaagcgtaaatcatgaaccgagatacactagtgaagcttttgaagtaaaaaatcaaaagagaagtgcggagacatcgagctcaagggatcgccagaggatttcaagctctttatattatcgtgatttaaatgatggaaccggacatggtggaggcagcagtaataaaaaggcattagagactatagatgaaagagcttcttctattttcactccaccaaataacaggaaaaaattagaagaagctggaaagaacagaaatattaattcaaagaatactactaaagcttataaggaaggagagattcttaatatggaaggaactgcatcgtttgatattactgataaagcagaagttgaaaggagggattaccacgaaattgacgatatattatttcaactggaagaaactggagatagttttgaaagatcagccaaagatttgaccactccaagacttaaaactccaattaagccggtaatatctgacaacaatgggagctag

SEQ ID NO: 3467 - DNA, 444 bp, Cryptosporidium hominis
atggacagtactgaagttagagaattgagagatgtttttgatttacttgatggtaaatcagggttagatgttgggttcttaagagctgcagctacatgtatggacattccattagataacacagtcattggaagactaaactcactaactcaggagtgtggaggtaaactagattttgcaggatttgtaagtcttgtaaacagtggaaatgagataaagaaattcactgttgaagatgctgtaaatatctttagttgccttgatatcaagaagactggaacaatagatcttgaggatctttcagcatgtgcttccagacttggtctttcaatgagtgaggaagaattaaaaactatgttaactaacttagatggcgatggagataatgccatttcccctgatgatcttctatcagcactccatcgttactctgaaaaatgttaa

SEQ ID NO: 3468 - DNA, 246 bp, Cryptosporidium hominis
atgttaggcagaggagaggacaatgtgaatgatggggacagtagtagtatggaagatagtgtgaacggtttagtggaggatgaattggcagagatgatattactgcaggaagtgtatgatttagggttggagaaaaagaaaattagagttgctggaattgtaaaattcgtggacttgattgagcaggagattgcgatattttacgagtccagaagcttaagagtgagtttgaggtatggattttaa

SEQ ID NO: 3469 - DNA, 1506 bp, Cryptosporidium hominis
atgaaggaggtaattcctatgagaacatactgcatgtcctttggatatgatggatcagattatcatgggatgcagattcaaatgagaaataataaaaaggtagaagaattgagaactattgaaggagaaatggaagattgtttagagaagcttggtatgttttttgtaagtaatgaacaaaatgatgatcaaggaggattattaaagaagattaagtggtctagagttgggcgaactgataaaggggtacattcagtttgtcaagtagtatcttttagagctaaaattaaaataaatggcgagttagaatttattttaaaaaataaggatgttgatgaaaaaataatagaaatctgtaaaagacttaaagaagagagagatattttaaataagaatggagtagataaaagtcatagtataaatcctctattaggaggagcttcattagtttttaaaaataatttggatgaatttttggatgaattattgattcttgattatatagtagctaaactcaataaacttttagaatcaacaaaaattaaggtttttaagatttttagagtaacaaagaattttgatgccagaatagattgttctagaagacaatacgaatacttaatgcctgaatttcttcttaaacatgtaaatattaacaatgatgatttcaaagaagagcttaacagagcaagcttatctagatttgaggaaggattaaatgaattaaagaatgcaagtaaaaaaagaaaaagagaaactatcaatacaagtttaaaccataaccctgaagtcaatgaaatcgaagaagaggttgagagagaagaagatgatgaaaatgatgaaaaaggagagaggatgaaacagtttgaatttcatcaaactaatagactcaacaactatggttttggaaatgattacaggttggtaaattataaaattgaggattatttagacccaaaaaggagattcagtttatcagatgaagatttaaagagatttcaatcaattttgaatgaatatattggtacacatagttttcataattttacatcaaaatcaagttatgaagattccacttcttggaggcatattgaagaaattaaagtagtaaaagttaatcaaaacgaaattaaaggggatattaaccttattaagattataattaaaggtcagtcatttctattgcaccaaataagaaaaatggtagcattagctatagaaatttttagaggaacagctccaagcaatggaattcaactttgttttttacccgataaattttccattcatttagctccaagccaaggacttcttctagatagagttttttataactcatataatacaaaaagaagtatttccactgatcaaactgactttgcaattcaatttctctcatttcatattaaggattgccattttgtcaaagaaatggaatcttttaaagttaacttaatctactccaaaatctattcaactatttctgaagaaaacgataacaagtaa

SEQ ID NO: 3470 - DNA, 1125 bp, Cryptosporidium hominis
atgagtaagatgaaaaaactccttttctatggttactcactattaagtttgagtgctattattttatttagtggaaaagaaagccaccatttaagaaaaagctgttcattcttagtagatgaattctttcaatcagaattgtttgaaagaaaacctgggtttttcttctttttagaagaaaaacaaactggtattgtctttgaaaatgtttcatttgttcaattttttaaaaagaaaaaatctaatagtacagatagtagtaaagaagaaaaaaaaaaaagaaagaaggaagagaaggaaaggaagaaacaagaaaaagaaatgaagaaacaagaaaaagcctcagagaaagctcaagctaaggaaatgaagaaaaaagataaagaagatgaaaaggaaattaaaaatttgggaaagaaaaataatatatcttcaaaagaagttagtaagaagctaaaagagctaaagaaacaacttaaggctgaaagaaagagtaatcctcaattaacactaatgcaattatttaataattctggaggttttagtggtagtggggccgctaatgctaactctgatacagactcaaattcaggaattcaagacgcatcttactctatggctgatgtaaccggtggagctgtatctacaggagaactaacgaaagaggagaaaaagaaacaaaagaaacaagacaaagaagatgaaaaagaagtaattaaaatgatgacttcatctggaatgaacaagaaagaagcaaagaaaaaagtaaaagagcttaaaaaacaacttaaaaaagcaaggaagaatggaaatccaaaaatgaccttaattaacttatataacaacaccggtggtgctggtggtgctggtggtgctggtggtgctggtggcgtagatatcggagatttaactgaagaaggcggaaatgttgaagccagattatctgctctggaagctaaagttagaaaactaacttcaagcaacaaaaaaagaaagaaagaaatcaagaaactcaacagtaatatgtctaaattagcattcatcataaggagaatgactagaggcggaggagctggcaacagtggtcaaggctcagattcggatactgatgatgacgatgaatag

SEQ ID NO: 3471 - DNA, 699 bp, Cryptosporidium hominis
atgttaccaccaagaatttggtcaaaaattatttccagaaccaatggaagatctttggatatctttaaatactgttgttgttgtacttctagtactactaaagcattatatagatttattagcttttggagtgggttcttacttatattcaatattttaatactattactttgtttaagaacatccaataaatatccattgtttttaaaatatttattccccaaattatcagaagctttatctgttgaaattggtattatttatatactactttatattatttcagcttccaatattattacaggatttgttggtgctataacaacgtattcttataatattatagctctcaagatatatatggtatgcaattatttaaacatcattaaagatattatattctttattgttattaatatattgttaaataaatggcatatagctttcattcatgttgttacttttttctttatgttgttccttatatttatacttattgggcttttaagttcttttgtagcagaaaatctcttatatattcttgaagaagaaagagatgaaagttctactgctcaaaatactgaaactgcatcagattcaacaaatagtagaattgccaagaatgacgaaaatggtaataaagatcttgaagtagccaaagatgatgaaactaataataattcatccatacaaaattaa

SEQ ID NO: 3472 - DNA, 2457 bp, Cryptosporidium hominis
atgggaattaaatttgtatttatactaattatatattatgtggggggactgtttggtgaatctactgattattctcctcctgtaagtatacaaaatatggatgaaagtatacttagatcaaggggaagtaatgagcaacaaacagataacgaagtaactggaatatcaaaattggagtcaataaatgactcttatagaacacaaaatgatgaaattgattcacttcaatcaaataaagtaattgaaactgatattgatcaaatttttgctaacaatttggaattaaatcatttacttgttggtatgaataaggattcaattctagaaacttcaactcaaacaaaaggaagaaaatctcaaaatgaaatagattttcagaaaacaataatttttcaaattgaagaaaataatcgttttgttgattcagatatagatatatttgcaactcttaccttacctttttcaacttttgaaggtcataccattgattactttattatttctactccaccatcatatacattgccaaaaagtgaaaaattatgtacatgtgttaaacatttgcaagaaattagtccagaagtaatgaaatctattccaatatcaatcaaatgtacaacagtatctgcaaatgggtcaatctactttgtaattcaaaatcaagatgaatctgtattccctgcgccgggatattatcgatttcaattaaaggtaagaactcctgttgaaacaagaaaagttcaaaatgaccccaagaatttctggtggttatcaaaaattcgcttttcatctggtcattatataactaaagtgcatgaaaatacgcgtttattgcttaaagctgaatgccaatggagtccatggagaagagaaactggatgcagttcaacttgtgattctggtgttgaaatatggagaagaactctactttctggtaaagatgaagaattatgtggtggagcttatcagaaaagagaatgtggtgatacaccatgtaatgtaagttgccaattaggtccatgggaagaattaataccatgtactgttacttgtaatgcttcaaagaataaaggaaaaagaattgagtatagaaaaacattattaactaattctggtaatggcccagattgtgaaactttatatccatggaatgaagaaaaacaaatgggatggagtaagtctttaggtatggttattaaatattctgattgtccatttgaaatgaaacaggattgtaacaaagaatttggatgtagagttgagagagaaaatttaagaactatagcttcagaatatccatggggattttgtccatttccatgtggtggatttggtaatattacaagtattgtacaagtagctaatggaataccaagatggattggtgagaagttatatccggattcatttgaatatccatgtgttagtaataagaagcctattgttgaatataaaccatgtaatacaaatccatgtggtgattgtatggtatatcttgaagattcgcagttaaataagactactaatatttgggtatttttccatttatttcaagaagctgatgaaattagatttgtattaccagatggattcacttttttaaagagtaatgataatgaattaatacataatatagcaaaagataaaaattcaaagtttgaaaacaataataaaattattacaagtattaaaaaggctataaaagttaaccaaagtaattatattgatattattaaaaagttatttaatcgtataatatttggtgatgttagtgaaaattcaggcatacccgaatcaaaaaatgataataataataataataataataataataataacaaacaaaacaataatattgacagtaatttcacaagatgtcaggtaactgcagcatcttttggatctatcaagacttgtcaattaaaaagtcatcatttaaaagatcatgaaatagaaaattacaaagaagcattaattattttagatagtactgttcaaactacgagatctatatttagtgaacaatctagaaatgaaaaaccaaattggttatttatgcctatgaaaattggtaatgctgaaggtttagtattaccagacggaaaattaaataatgagcaattcagattatttgcacgcggttcaaattccctgaaagagccagaggaattggtatgtaatcttcaaacaaaagtactgctaccacaaccttgtcatgttgatttgttaccaaaaaatgcaaaagattgtataaaatgttccaagactaatatttttactatagaagcttaccgtcaatttacatctccaaaaaatggaggtgcatgtactgttccaactgaattcagagttgatgaatctattactaatgttgattgtattaatgtatgtccaaatggtagaagatatgtaatgggaactgataagtatttaaagaaaattggaattcattcttaa

SEQ ID NO: 3473 - DNA, 5169 bp, Cryptosporidium hominis
atgattcctaattctattcagtttactgacttcaaacaccaacatattcatcattatcagcaccaacatcagcagcatcttatggacgtgccatattttaacattcaactaggcagtgaaagtatccatattttccaaaaatatcgtcgagaagtacattatttgatgtgttgtttatccttaatcactttaagaggatcatctgagtttatattactctcgatttctgcttggggaagtttatgtaattcattaagaatttcatcttcatgtagttcatatcttgaagatcttttaatgatcaccaatcatactatatttaagcctttagaagaatgctttcaaaaaattagaaaccaaagagaaaacgtttctgataaatttgcagatattgatgaaattggtcgtgttggaatacaaaggtactttgtttggtcaatcgtccaattaggagaatttcctgatgagctttataactttgaagatcattcagattcatattttccaaaattctcacataagaagtcgaatcatttgaaaattagagaatctgtcagagatgctgttagaaatgcaatattcttcccagaatctcccaatattgcaaatcctggctttgatgataatgataataataatattaacaatataaattatcatctttcaacaaattcaagtggtattattaaatatatattgcctttctattctttccaaatgttccttaaagatatatatcttcatttaaatggatttaatcttgttagttatattggaactggacaaatcaaaattaaaagatctatactaaatactaataatatacagattaaaagctttattgtacgtttagaatccattttacatgcatttagtgcaattattaagaagggattaacatctttccctttaagacctaatgcaaccagaataactgaaaagatgggtagtgatgatcttaataggagaatgtataacaatgaagatgaaattaggagtttattagaaatggtcaatgcttccttaaaaattgatgatgaagatgtaattaatagagaacttaataatcgtgaattagttcttggaaatgaaaatgactattttgaacaaactcgaattctttttgatgctgttatgcttaaaatcttcaaagtaactggcgaatttgaaggtcttatggatatttaccttagaaattgtcatcagagattagcagaccaaagaattatgattgatgatggagttagagtttatgagagattattcagacaattattatgtactttaattactctacttggagttagctcagtttggtttaatgataaatccattttagttactttaaaaggtcttaaatatatttttagatcactacaacttattcaagaagatcatttcttcccattggctttagaacaagatcatgttggagccttagccttgttaaagctttctcaaaacaagacatgttttgaaaatgaaatcttggattatatggttgtcaaatgcatggattcattctctagactattctctgattctaaacaacaagttgaaattccctcaatgacttttgaaagctatctaattctattaacttcacttggaatttgtatttcacatatcatttctgacgttgataaagatcatctatcattctattcttgtactaattcaccaaaatccatttcagcaacaacttcttcatcagtttcagcttcaaatgttggtaataacaaagaacatcttcatctatttaaaaaacttcaaaaatggaagaagtatactggaatggtcttggagaaatacttgtatctattagatagattaattgagatctataatgtcaagattatggatcaagattctttcaagaatatggatggtaataatggtaactgtaatcataacaaaaataagataccagtaactgatgatgaaatttgtcaaatttataatttattattagtgacttacatgttattttgtggacttgaagcattcttttcttcaatatttccatgtaagtataggccgtatagttatgtaatacttacaataggagcagagaaattttctcatttgaatattttggaatatagcaagagattattcgagtcggagagtaatttaaaatcttctattgctgctaagattttaaagggtgcttctaattacattttggggttattttcaaaggaattttattcaaggataagaattattttacgtttatcatgtgctatttcaccaagttggttacaagtactttatcatccatatacttgtataatatcttgcatactccaattaccatttttgagtatgaataatataaatggtgaggggggaggctcagatcttcttcttgggttgtatagatatattggttatgatgagttccaatttctttcaatggacactccttttggcaatctacgtggttgcgttggtgtaatgggtggtcatattattactaatagtagtggtaatagtaataacagcaacttgaatatgagtattagcagcagtagtggtggtagtaccagcataaatattattaataataataataatattagtaacagtggtaatagtcataataacagtaataataataatattaacattaaaaataacaataataatattaataacaatactattaataataacaataatagcggaattgggataggaggaataatagcaggaattactgctaataatggcgttatgattcctaatatccagagaggtagagatttggggagtaaatgtaattgttgttttaatggggaaaatgagggttttggttccaatgggataataaagaaagggttacatcctataataactttgatctacaaattattactatttaatagggggttaaatgttgatgcaatttcgattacgaaactgctacaatctaactttcggggtttgggaaactttagtgttggtggaagtgtgataactggagggacaggagcgggagtaggagtgggaacgggaatagaggtcggtctaagtggatggtcaccatcatcatcatccactttgggttttgttagtaatggtggaaataaccagaaatatcttaaggacgtgtttaatatgttaaaaggggacttaatgttttacaggggtgatggggggaattgtcataatggtgacaatcataatgatgataataataataatgctttttcaaaagtatgtatttgcaattatgttccaaatatttttttaccattgtcagtaatgatgttaagggtaccatattttacactaaaagggaagcagaaatttttggacccaatattgtcatttattaactcctttaaaacatttaatgtgcatccaatcatccagtttttgagttattactctgttagtgtttctactttaactagcataaatagagatgattataaactacaagattcaacgggttattttagatattttaagaaagattctgggttacaagatgtaaataaactagacaccttttgtatgtatgtgaatcagatgagtaatttagatggtaatctccgaatgaataatagcagaattgatgatcattgttcttgcttggagtaccatgatggcgtttgtttaactttactattattgttacagaatttgacaaatttatcagtaactaatgataactgttatcctggacaagggggaggtaatactgggatgggaattttaggtggatgtaatggagcttataacgtgaatacaagcttcattaagatcgttggtactccgatacgagcgaatttggaagtatttatagaatatgtaatatcaagatgtatagttacattattaatatgtataggagcacaaaattgtaatataaagagaagagtagaaaaggagaggattatgaattactataataataataataataatcctatagagatgaatttaaatgattataatacttacaatgagggttcaaatggggcattatcatcaattaaatcaatattcaatgaaaataacaacagcagtagaaggatatttaatcaaggaggaccagtagtagatagaggaatgataattactactccaggatccgaaacaatacaaaatattggaataaatggaggaggtataagcatgaatggaacaggatcatattctatgttatgcggtaataatggtaataatagtaataataataatatgaatatgaacaatgtgaataacaatagtatgagcttttcaggggaaagtatttatgatatggaacccgatcagattaaagatgagttgaaacaaaatgagattaatgaaaggtttataccacaaaaactactttcaaatcaaaggtgggtagtaattacaataaaatatttactaggaacagaatttacaagtaggattaataaacaacaaattgagagattatttacaagctcagtttggggtgtagagttgacaacaaccattttattggcaattttggaatcatattgtgattctgaatccttttcaatactttccgatattttgattttaattagacaattacttaacaagaaacgtttcaggaatcttttagaagcttcattctgtagacttccaataagaatgttaattcattcagcaaatatttcaactcattatccgatgttacatttcccattaacaaatggtataaaaatgaacgattatttcttaagaagggattttgagaagaatttaacaaaaaatcatggaagtaattatcaccagaaatcaaagagttctttgattgcttgtacagttcgacagttcgtctatagactattagaggagaatttctttttaaattcgaacatgatggatatgggtttttctcataatgggaataatggaaatggtaatatgaatatttttgatttcaatagtggtaattttggtaagtatattgtgaataatgaagagttttcccacatgcacgaggatatgtcatttggcgggaatgtgaattataaacttccatatatattaaagtcttcatttacatcagatgtaataaaagattttattcaacagattgtgagcgtttcagtgtctcaaacgaacaagacaaagttcaggcagattttgaaagaattttgcgtaaaatcagtgtgcaagagaatggatgaataa

SEQ ID NO: 3474 - DNA, 465 bp, Cryptosporidium hominis
atgattacagatagatgcagcacagtaataataataatattagcaatcacattaaataagagctacacatttttgatgataatatttttgataggagatatttctggtcattggctatacatgatttcaagtatttcatcaggaggaagttcacataaaagtattaaagaagaaatgtggccgattttaaaattatattattcaaaaaaaccattattgtttacattacatgcatgtaatgaagctttatggttaattttatatggccagggatgtatttacgataaagctgcaaacctaaaacaattaaatcaaattgataaaaaattcattctagtaacatcatattctctctacataattctgccacttgccttgatcaaaaatataataaattttgttcatttattttatggttgtaatatcattttggaaactgatgttaaagaaagaatgaaaaattaa

SEQ ID NO: 3475 - DNA, 3117 bp, Cryptosporidium hominis
atgacgtcaaacaaagaaaatttgtccaaaaatgaggattctggtaagaaggagggattaaaagaggtagaatcaattccaaatgtagatatgatggatttaacagaggaagataaagttttgaaagaggaaatagatgaattagttgagaaagttgtatcagaaaagtccgagtttgaggtttctaagtccagcttagaatccctttcgagcttaataaagacatctactagtggaatgatatctgttccaaaggctttaaagttcttaggtatacattatgaaactctgaaagaattttgtgattcccaggtttccaataaaggtcaactttctgaacttacttgtgagattatttcggttttatcaactactttgggggatatgaaagagaaaagggctttaaagtatagattactttctggaaacaagaaaggaatattagactggggtcaagagtatgtcagaaatattgtaggagaaattacattagaatattcagaaagacaaacaaaccaagacttatcaggagtctcagatcaagaagcagatgtttctgatctacttgaactggttaagattatggtaccttatcagattgagaagcactgtgaactggaagctattgatctgctctgtgaagtcgagcaaatggagacattattggaatatctagctaaaatcgatattgaacaaatggaaaggatcgtattatacttacaacaactttctcaatatgctatatcagcagaagaacatgatttatatctgaaactttgctttgaactacttttaagctttgaaaagcactcttgggctgtttctatagctcttaaattggatggtcaaaattgtaaagagaaagtattttctgtaatagatgatataatgtcatatgaatcaaagaaggacaaagttaagaatgaggccaatgattctaatatctcaagctcatcaaacactttcagagtctcaggattgagtattttgaagcaaatcttcttccaacttgctaaattctcaagtaatatagacttagaggagcttaaagctcatttagttagcagggatttctgtaagatctatggagaatctgagttatccataattgaaggtatcttttccaatgaatatctcagcaaattttatttattcttagcaaaagaattggaggttcttgagccaaaaactcctgaggaaatttacaagacccacctggaaaataatggtaggtattctagtcgatcaatgatggttttggatacagcaaaacagaatttagcatccacatatgtgaatgccttagtaaatgttggattttgtaaggataaactaattggagaggatgattcatcctggctctataagaataaggattctggaaagatggcagtaagtgcctccttgggagtgattaatttttggaatattgatgaaggtttggctaacattgacaagtttcaatggagtgatgatccatttattaaagctggtgctctaatagcttttggattaatttctatcagaatcaagaacgactgtgatccttcttttgctcttttatctgaatatatcaattctggagatgaaccaatccaagagatagctactagcggtagtaaagatggaggggatgatgtaaagatggaaatagttggtgaatcaacaaatggctcaaatgataataagatttcaataatcaaaacggctgttccaaactatactattagaatgggtgctattttaggccttggttattcatatattggcacctgccgagaagatatcttggaattactaattccaatcctgatggatcctttctcaagcttagaatgttcagctatttctgctttatcattaggactaatattctcaggatcaggaaatcagagtattattgaagctgttttggaccttcttctgacaattgggctcactagtgcaagtatggaagatggagactcatctaatagtggcgaagataaaaagaaatctacgggagattcacaacttgaaagtaattccttcttagatgatcctttaagtatcctttatggattatgtctaggattactctttttgggaaaacgagaggcttgtgaaacaactttggaagctctttctgcgataactcatccgataggagctcactgcagacaaactgtggttgggtgtgcatacacaggatcaggagatgtacttaagatccaagaaatgcagagagttcttgttgaggaaacccttgctaaaggaggaaagaagctacctgaggatgaagatcaaatggatgatgatgaatcagatatttcagtattagtatgcgtattaaatatggcattaataagtcttggagaagaaattggaactgaaatggcatttagagcacttgacaatgtccttcaatactcatcaatttttattagaagagctgttccaataagtttggctgccctttcaattggaaatcctaaaccagtgttgatagacacaatttccaaactaacccacgattccgatccagatgttgctcttaatgcaatttttgctcttggattaatttcagcagggacaaataactctagaactgccaacttactgagacagttggcctcgtattatggaaaagataagcatgctctttatgcagtcagaattgctcaaggttttctatatatgggtaaaggtctcgtaacagtgaatccttgccacgcaaacaaacttcttttaaatccaataagtctggtttccatcatcacaactctccatcttgctctaagatccagaaccattctttttggtaattatcattatctcttactctcaattgttcctgctattactcccagacatgttgtcacagtcgacacgtcattggtgccaatccaaactctggtacgtgtggggcagatggtagacactgtagggcaagcagggaatccaagaaagattacaggattccagacacacaacactccagttcttcttgggtttaatgagagagcagagttagcaactgatgaatttgttccagcttgtagtgctattgaggatattgtaattctggagcgaaatccagaggctgacaatagcggggcaaacgctagtgataagtaa

SEQ ID NO: 3476 - DNA, 978 bp, Cryptosporidium hominis
atggaatctaaatatagatttgaagaggggaaattcacagaaggcccaaatggaagaataaactatgcattatcgttcccaaatattgagaaggcagcatataaaggtcctttggtaatatgctttcatggtttactaagctcaatttcttctttcaagcagttagagactgaatgtttaaagtcgggcttggcagtactgagaatagatatgcctggacatggactttcttcttggaactattttggaaaattgacaactgatgattttattaaacaagtagatacagtgttaataaatttgggtttggaaaagttattattatatttagttgggatttccatgggaggtttaatgactttatgttatgcaggggcccatccagagaaagtacttaaggtagcttctttatgtccagcttgtttttgcaggccactctcaggaatacaaaaattggttttaaaaaattttccaggagttttcagattttttgaaaattcacttccattatatttattaaagagtagagataatatattagaagattactatgatcctgaaaaaattgatcccgaaattgtaaatttgaggtatttaaggcacagatattatggtagacaattacgatcaacttttggtagagtggtaacaggttttgatttttgggaaaatgaacaagctcttaaagtatttatggataaatatatttcattaagaggaattactggagtatgcttttttttgggtctgtatgatgatatggttcctgctgatttattaattccaaagcttaaaaagatgatgccaaaaacaagggcgatcatctatcagaactgtaaacatcagcttttagaggagggtcgtaatattgttggtgatatagttaaatatttccattctaactctgaatccgaatactctaaaataggtttagccgtagaatctattataattcaggatgagattcaacaaaaatag

SEQ ID NO: 3477 - DNA, 1257 bp, Cryptosporidium hominis
atgtggttatttaaatatatatttgcaatcttaagttttgcttatgtaggtatcttcaaagtttatggagaagagcaaaaggtcattcctgaccacttttactttgaagaaggttctaaaatccaattatcacgtggaatagttaattatcaattacataaagaaaatgatgatggacctatttctgtatgtcttcattgttttatgggtacaatttcagattgttcaagtatttcaaagaatttagctaagaatggttatagaactttaagatttgatttttatgggcatggtttgtctcaatataaaaattttgggcaatattctgtggatgattatgttgaccaaacaatggaattacttgagaaattgggtctttacaatataactgctatttctgaagaagagttacattcaagcagtttcacaccaaagttgcatgtaataggtacatctttgggtggatttgtagcaatgagaattgctcagagatttccaaaacatattggcaaattggttttagatgctcctcctggtttattaaagaagaaagttgcgccttatttacaatattcaatcattaactatccattacaactttttgccaatatatactcaccagtttggggttgttatcaatttatggatcctccatccgagaatctttcttctccaaagcttgattttagagcaaagcactattgtaaacaaatacttttaacatctctacaactatttttgggaattaatttatggaataatcaacaaatttatcaagaatttagtaaagtcgatgtaccaactctttttttctggggagctgaagatagattatgtccactttcttcagcaattactattctaaatgaatatttaccaaacacaaagattattgtttatgagaattgtaagcatagatgctctaaatattgtaaagaacaatttgttgaagatgttattaaatactttaagaatgaattagatcaagaacttgtctcaatgtcacaatattacaattcagtacatgatatggttcattcttcagaaaagagatcacttccatcaattagaggtaccaaaacggatactttattagagcctaactcaatatctgaagatacatgttcaacaagtacatctggtagtcaagagattgcagttcagttagcatcctcaactgaagataataccgagactgggagttctatgagtggttcgggaaattttaatgatgatttttgtaaaactaagaattag

SEQ ID NO: 3478 - DNA, 2565 bp, Cryptosporidium hominis
atggagttaacattggaggattacttttcaagctgtaagaaaaagaagttgcaagataataaaaaagtggattcaaatattcaaataaacaaagatgagaaaaataaagtaaatgtaaatagtgatattgacactaaagataatgaaataaaattgaaaaaaacttcaaagagatctagattacacaaagtaatgagcagtgatgaggatgaagaagaagatttgaaaagccctgtaagtagaagaaaaaaggatgtaaaagtcaaagctgaaaaagaaagttcacctaaaagaagtaaatcgtcatcatcaaaatcaaacttaaatacaaaaacagataaaattagctctaattctcaaaatgacgaagaattgataggtccttttaacgggatgagtatagtcgttaccggtacttttaatagtaattctagacaagaaatagaagattttgtaaagatattaggaggaaagttgacctcagctgtaagtggtagaacctcatacttaatagcaggcaactctttggaagatggaagatcaattgaggaaggcagcaaatatcgtaatgccaaatcaaaaggtgtcaaaattctaagtgaggatgagtttattgagatttatacaaattataaacaaaaagaagcaaaatatgatagtcaatctccaaaccggaaatctcatggagtgtttgaaagcggaattaaaataaatgaaggaaatatgaataatagtaattttgatggaaatagttctttatggacagatagacacaaaccagaatcacttgaccaagtattgggtaatggagaagtgattaagaaattacaaacttggctttctgattggaaatcagtagtaatcgagggtaagaaaaaagcccctcctaaagcctcattttcaccaggtagtagatttcctcaagttgaaaatatcaatgctagagcggctttattaagtggccctcctggcataggaaagtctacagtagctactttaattgcgaagaagtgtggatatatcccaatagaaatgaatgcaagtgatgatagaacaaaagaagtaattgaaaatctatcggaaagtgctgttggtgggttttctctatcaacttttgctagaaaatcttcatctagtagccaatttggcgaagaaggtggcctaaatactaatatgttattgataatggatgagatggatggcttaggtggaagtgatcgaggaggagcagcagctcttggaaggctaattcagaggactaggtggccaataatatgtatatgtaatgatagaatgagtgagaaagtacgtaatttggctccaaaatgttatgatttaagatttagtcgtccatcgaaagttcaaatcataaaaagaatgcaagaaattgcaaataaagaaggaatgaaaattgaaccaaatgcaattgagctactttgtgaatcagttggtaatgatttaagacaaatactcaacgaattacagctattatctttatcaaatataaatgttcgcttttctgatgttaaaacagaaatctcaggtcacttaaaagatgttcaggttactttagatgtattctcagcaacaaaaaaactcttaacaactagtgaatcgtcacatctttcaataaatgataagctggaaatattttttatagactttgatttaatgcctcttttacttgaagagaattacatttcagcattatctgtaaaaagtggaggcggatttggatcaggatcctctaaccagcaaatgactgtaactcctcaaatgattgaaagcgttctcgaatctgcaaacttatttgttgaagctgatgtatttaatgccaaactcagaactgacaatgaatggagcttactttctgaaattgcagtgaattgtgcagttgctccaggactttgctctacaaattcatttttagctagacctgaattcccaaaatggcttggaaagaactctacaactaataaaaataagagacttttaagtgaacttatggctattattactgttggaagaaaaggaaactgtccttcatcaaaaggactaagactttctggatatcttgatttaatttattttaaggccacaactcctttacttgatagtaagatggatacaaaagatgctattcaaatgagtatttcattcatggatgaatattgtctcaatagaaatcatctaattgaacatatctcatctttaatgcttaaaaaccaagtcagaacctacgacaaagttgatagcaaaactaaaactactatgactagaatgatcaattctactactcatgcagtcaaattttctattcagtccaaaaaaaataacaaatctgaagactttgatgaactctcaagaaaaggaggtgaagatcgagatgatggaggcgaggatgaatttgatgaaaatgacgatgataatgaccaagatgaagactcttctaaatcttcaaaaagcaaatctaaagcgtccaatgaccttggctcactaattaaagtcaaaaaaagcaaagctttaggtagacaaactaaagaaactaagaaaagaaataaatag

SEQ ID NO: 3479 - DNA, 1518 bp, Cryptosporidium hominis
atgggcagtaatttggataatgacttgaaaaagaaattacaggtttttttagcctctcccctatgtaaagagtcttataatgaactttctaatgcaatatcaataattggtttactagaactattacttaattcaaatactatggatgacattacattgattactgaagttttaaaacgtttgactatattaggagtattggacgatgctatttttgatattccaaatgctatagagatgttggagaaaggatcaaaatcacaaacggaatgtattagattactagtagcttttattttaaattcactttctatgaatgagttaaaatgtaaaaaagcttgtgaaaaaggatttttttcagtattgggattattgttaagagatatagatatatcaataggtgaatcagcatcaaaaacactaaaatctatttcaaaaagtaacccagaatttgtatatgatcaaaatttaataaataagttattggaaaattttaaatcattaaaagatgaaactagattgagaattattgatacttatatatcaataggttcagtttctgaagatttatttaataaatgtcaagaaaaaggtgaattctactcgctagctttaaaagaatattttactgaagatatattgttaaaactagtttcaatgaaattattagaagatttaggtgaatataattggggagtaaagtttataataaacaattcaactccagaattattaattgatgatcttaataatccaatgtttgatgatgaaataaaaatttcaatagtatatttattgtcaaagatggtaaataataatccagaattgtcacaaaaaatacttacaatgtcaaataattcatttattcagactttcaaggagtttatgggatcttataacagcataagttgtagtgaagattatttaaaatcggtctgtgcaataaattgttggggattatttgcttctaatttaataagttttcaaaatttaatgaatgtttgggaagattcttttcacctaatgctcaaacttgtctctaattcaaaatcagagatttctctttctagtttgaattcttgggtaactttctttgagagtaaggatataaatcaaatactaaatcaaacaaaaacaacttttggattgaaacaaagtattgaaacccaacttttacctataattatttcagatttaatttcaaagccttttcctgaaaatagaacattaatttacagaattttaacattaatgataccttatttctcaaacataacatcgaatttaatttcaaatagtaaaattagagatattttgttgaacccaaatagtgactcaaataaagatattctatatatcaaatatgatcttgttaagcagatggtaaaatacgatcaaaacactataagtaatattcctgatcctaatttcagttcatctttgcaagaatacgttaaagtcggaccattttataaatctagctcagcagaaatgcaaatacaggacataactatgtag

SEQ ID NO: 3480 - DNA, 1890 bp, Cryptosporidium hominis
atgaattatagtgaaggtagaaacattaaacgtagatctgggcttaggaggcttgaagatgaggaagaactgagtgaagatgacatatttaaagatacggatgattttgaatattctgttgatggtgaagataatatttcaagtggagacagaaaacaaaaagaaattgaacattttagtgaggaaatggaagatgatggtttggattttgaagaagaagaagagtatgaatatgagagttgggataagaaagaatttgggaggcatattgagcatctaaagggaagaatagaaaaattaaaatctattattaataatgataatgagagtcaaccaccagtacatcctggatatactggtgataatgaaatattggactcactgaatgaagaaaatagagagtttttgtattgttggaatcaatcaggatatgtatcttattctatagatgaagaaggaagaccttctatagatatggaatgttacaattcaatggatggaccaaagaaattacgagtatatgatactaaaggatataatatggcatgtattggtatggatggatatttattaggtagaaaatctaaagtattggataatggatcagttgtttcgtctataatagattacaatatttggcgaacatggggaagaagtgataaatcaggttggtcaaagactttactgaatggtgaagatttgatatgtatgacatgcaaccgtgattttgtagcagtaataacatcattaaggtatttaagaatatggagaaacagtggtataagtgtttcagtgactaaattagttggctctccaatttgttgtgtatcaaatggtagttatttattagtagtaacacaaagagagccattttatactccaagaaataagttaagattaggaggaaatatacatgaaggaataatatctggaagatgtaatacatatgaaatattatttttagatgttactcaagaaacattaatatatagtgatataatgtcaataactcctgaaactattataaactggtgcggtatatcaaataaaggagtaccaataataaaagatacttcaggtcaaacatttatgttatcaagacaatggaagaatcaaaaagagaattggattccaataacaaattttggtttattagaatcaagtacaagtagtaaatattttattttgggagtaaatgaggatcattttaatgtattaaaattaccagatggtcttgaacacccaattccaataatggcaaaaaataattcaactcagaattattcaacaataaagataccatttaatataccaattttaggattaccttcaataacacaatggatgaatataatagagaatgatccaactttgaatgaatgtattactaataacaatatatcttgggagattattgatgaattaagaatgaaattagatttgatacaaggtaatatttcaatggtggatgagttttcatgtcataaagattcaaatcaatatagacaatataaattacaacgtgagaagttattaatgagattgtatatgaaattggtaataaaacaattagtagagccagcttttgatgtagtaagaatgtttaactttccaaaaagttttcagatagctttagaacaagcagagaagagtggagagcgtattttggctaataaaattagtcaagagattcagatgaggtctaaatatgagcaagagaaatcaaataaagattttaaagctgataataagaaagaatatgttcattctatagaggatgatactttaaagcaaagtaataaaaataagttcaatatggagaatattaatttgaatgataaaagaaatcgtatattgcctagtaatgatgtgaatagccctccatctact

SEQ ID NO: 3481 - DNA, 213 bp, Cryptosporidium hominis
atgaagatggttgaaactttgaatactattgtatttttagttaatgaaagagctaataagactcagattaagtatgctgttaacaaactttatgatgttaaggttgctaatgttaatactgttaatacatttggggatggaaaaaaggcatttgtaaagctttcccctgatgttgaggctgttgatgtagcaagcagaattggaattatttaa

SEQ ID NO: 3482 - DNA, 2235 bp, Cryptosporidium hominis
atggaagtgactagagatgaaattgttcagtttaataataaaatgaaacaatttttcaagcatagtttagatgaaaattatcaacatgatgagcctgtatcagcaggcggaatagaaggaggtgtagcgggagcaggagaaggaacaaatgaagatgatgaagatgatgaagaagtaatgaatttatatggagtttatttaagtttaactaaggatgagtcggctttaagtttggaagagattaagggtttagctaaggaagaaaaatatgacatagctgaatatttaaaaatgtttatcgaaaacttaaaaaatggaactcaatcaacagttggtccttctgaacaaaagaaacgagaagataatgctgaacaagttcttgatttagctgaagttcttttagcagataaagaaattatagaaatttataatttatattcttcttctgtcgaaaatccttcagatttgaaacatttgattgaaatttcaaattatgataaggattacttattaaatttaatgcgtgagcttatccaaaatttatttagcacaactagtggaggtggtgaaggagcagaaggtggaatagatttacttagcacgcttaaaagtgatgaagaagttttattggcttatgctgcatacatgtctattgtacaaggaaattctttaagtttggaagagttgattaaggcttcaggctataacaaagctactttattaagtatgctgggtgaatatagccaaagtttagcaggtggtggaggagctgagggaggtgcaactggaggagctgagggaggtgcaactggaggagctgagggaggtgcaactgggggagctgagggaggtgcaactgggggagctgagggaggtgcaactggaggagctgaggaaggtgcagtcggaggagctgaggaaggtgcagtcggaggagctgaggaaggtgcagtcggaggagctgaggaaggtgcagtcggaggagctgagggaggtgcagtcggaggagctgagggaggtgcagtcggaggagctgagggaggctggggcgttggttccggatacgactacatgcaagttgatgaggaagttacagaaaagtatttagaatatgtagagtcagtctcaccttctaattcacctttaaatttggctgacttcatacaaatgcctggaaatgatagtaaggaagctcttttggaagctttggaagaagccattgcaaagaatcatcgagaatcaagggaaaagaagagaaaaacaccagcttctattaaaaacatactatcttcatttggcacattaacaaaaaaaaacggaatgccagatcctgctgttagaccaaaagtacctattttgtcgggaaccaaaatcaaaagaaaaaaaagatcagctgttgaagacttgacaaatgataaagaggtttatgaaaaatacttagaatatgtttctttgagcggtgatactaaaagtttacaagaattatttgattctgtaaatcgtagtaggtcagaactaatcagattgctggaagatggtatcggaaaatcaaatctaggattaatgccttcggatgatccattagcacaaaaaccaccgtcatacccaccatcaaagccagaaatgccaccaccatatcgaaaaccaccgtcatacccacaaccaaagccagaaatgccaccaccatatcaaaaaccaccgtcatacccacaaccgaagccacaaataccaccaccataccaaaaaccaccgtcatacccacaaccgaagccacaaataccaccaccataccaaaaaccaccgtcatacccacaaccaaagccacaaatatctacttcgtcaggtggccaacaagtccaattaaggtttgattcaaatggaacattagatacaaaaaatatggatatatcaaaaatctctataaaaaccatcgaaaaatactcactctcagtcaaagatgattgcaaaaaagaagttttagaacttatgaaactcttacttaaagcttcagaagcagatttaaccaatttaaaatcattagataaatttgtaagaggatctggaaaatgtttagttacaaatcaaaaagtgagtagcattagtggaggaatgtgtaataattgttttatatgcaattcctctcaagttaatcagaaaaatatcaataacatggagaaagtagtagctgccttagcagctttggttaattattgtacacaaaacttaagatcataa

SEQ ID NO: 3483 - DNA, 375 bp, Cryptosporidium hominis
atgatactagaaagaattttgcaacttttaaaaacttttgaatatatattaaacaaattgaaacaaattcaaaatcctgaatcgagagagcaatataatttacaatttttttcattaaaatttcaattaagtttgttaacagctcttttaacaatgcatatggtaaaaataaaagagattaaaccacccatgaagtttaatataaaagttaaatcaattgataagaatacacttactcagttagtgaataatgacacaaagttggtggaaggtagtcaaaagtgtcacaatttggtattggcattattatattatagatatttgcaattaggagtgatattggaaaatggagaaaaaagtcctttatatacatga

SEQ ID NO: 3484 - DNA, 2325 bp, Cryptosporidium hominis
atgattttaagtaattttttgaataaatattcgaatggaatagattcaagtttagaatataattattatgaagaatttttaattcttattggttattctttagctttagaatatttttgtgaagcaatatatgcttgtatattaagagtagaaggtgagaatggattaggtataataaaaaaatatgatccatttaaaaaagaaggggtgaatttaatagtaaataaaagtattaatgatattttaaagcaagaaagatggggttatggattatttcaagaaaatttaacaatagatggaagtcatttattacatagatttattggtaatgataagattaagccagaaagttgtaaaataagttttattaaggaattagttcaaaagattaaagagatagagaatttaaagaaaggattaaaaaatgaagaattaatagaagcaaaaaatttatcatcaattttgagtctttatttaagtataataaagttttgttttaaatttggtattttttatatattaaaatctcaattaaataaaaagcaagaaataataacaactggagttgtaggttgggaatttcatccaactttgatggaatttgactttccaagttatccattagaagatggatttctttcaaatttagagttgtttggttttgataatcttgttagttcaggagattattcacaattatttgatttagagagtggagatttgatttcaaggacagaaatgagtgttgggatgtacattgatgacttagttgatgagaatgaaaggtttggttttgaaggatttggggtaggaataggggtaggaatagggataggaacagaaacaggaacaaaaggagcggaaacaggaacagaaacaggaacagaaacagaaacaggaacaaaaacaggagcagaaacagaaacaggaacaaaaacaaaagaagcggaaacaggaacaggagctgaaataaaagcagaggtaaaattagaagctggcgatgaagctaaaaaggctgaatttccaattttgacagtaatgccagaattaggacctgagcaacatgtattggacaaattggatttgaaaacattaatgaattataatttgatgaattatttagaaatgtttatcaaagaattatcaaatttattgttaccagaaatattagaaaaagctttcaagtttttaacaggatgtgatttaaatcttttatatttaataaataccagaatttcaacaattgagtatttactaattcaaattttgaaattcaataataataaaagtgactataattctgttaattatgaattactatttgaaacattgagaaatttggtttctaaattaaaatcatatttggttaaatgccaagaattaaacaaatttaagtatccttggttacatattccaaatcttaaaaactttaaagaaaatatacaaagcttattattcagttttttccaacaagataaaaatataccaaaagattgttttttaattaatatagaagaagtcaaaaaatttatttcttttcagaaattaaagattgaaagacttgaaaatatggtagaaaagactaaattattcattcaaaatagagatggaaaaaatgctaattttaaaagttcaagtacaatatttcacttagaattagaaaaagaaataatcggttcagcaataattagaaatgaacaattaacagccatttgtgaagaatttttaaattattttcaactaaattcaaagattacaattgatatatttgatgttttagaaaatttatttagttccttattcattagtgatcttcaaatcagccagttcaattcaagaatttctcaagtattttctcttggagcttctggtgctggtattggcactagtcctggcggtaatatcggccctagccctagccttactcccagtcctggaactcctaccactggtgctggagctgtctatacccctgcccctgcccctacccctacctctgcccccacccctccacctgcatatggtgaggccagtggctttaatagtccatctattctattattgtctgatatttatacagaaggaactgaaggacctaattcaccaacaattcagtcaaagccaataaatgatattagttctcaaacaaatcaagaaaatagcgaatactcgttctttttaaatgatccagaagttcaaaatttgtattcattatatttgtcattaaatgaagaaccactcactttaatacaattgatcgaatcttcaggatttgataaggaatttttgattcaaatgttacttagttttctagaagaaaattaa

SEQ ID NO: 3485 - DNA, 792 bp, Cryptosporidium hominis
atggttaatgagaaattgaagcttttggatgttaaaatggaggagataaaaaaattagcaatgggacaaagagaaacagttcaattttttttcgaaaaactattgaaagtttttgcagcaagtgaattaattaaattgaaatgtgaattagggatggtgaataagttatttgttataaaattaaaaattatcaaaattttgcaaagtgctcaaaatagaaataatgaaagttatcgaattgatgaaagtactttcttaacaactcaaacagaaaaaggcaaacaagcaataaaagaatatgaaattatattattattattaaaagatttaatcagttattttagtaaattacttgaactttgtgaagaaatatttcatgtatctccaaaaattaaaggaaaattagaaaaattattaattaatttaaatgaatgcaaagttgagaaatttaatccattattggatttaactcgatttctagtgcaaaatttcagtaaattcccaatcaattcaagatatggttctaaaatatttctttatttattaactcgtttacaaggatttactcaaattaaagagtgtttatctattaaaaagttacaaaaatgggtatctttaaagaatgaatataataataaaattttaaagtataaattaaaattgaaatctttgaaatgtaatggtcataatcatttaaataaaccatgtacacgtaatacatgtattatagaatcaaagaaatactttttaatggaaaaaattaaaacttataatctaattattaattattga

SEQ ID NO: 3486 - DNA, 2967 bp, Cryptosporidium hominis
atgtcgttcatgagaaatgaccttgtttgggttccttgtgaaaaagagggttataagctactcaaagttgaccatgtggatttagtcagtggaaaactattactcaaagatggcaaagatgacgatagtagtggcccatccagaacagaaaaagtttctattggattatgtcataagtatgtaagtgatacagataaggatgataatacgtctttaacatctttggatcctgcaaatattcttgaaaatattagagttagatttggtcaaggaaagatatacacaagtacagctcatgttttgttagctatgaatccttatagaaatataccaaacttatattcagaggaaacgaaaagaagttactttggaaagcatatgagccagatgcctccccatccatattctattgcagattattcgtatagaaatatggtcttagatagaagaaatcatgctattgttatttctggggaaagcggagcaggaaagacagaaactgcaaagattgtaatgtcttatttagctgaggtagggattctcccaagttcatccgatactacaaatgccgatgaaagtaatatgacggagaaacagagaaagagaatgatgcagattcgattatcttacgcgtcacatactatttttggagaacaagaagctagagatattcaaaagagaattttgtcagcaaacccaattctggaagcttttggaaatgctagaactgttcgtaattataattcgtccagatttggaaggttaaacaagctctattataatgaacatggatttttaaaaggtggtggaataaccacatatttactagaaagtagtaggtgcgtaaagcatagccacaatgaaagaacatatcattgtttttaccaattagttcatggagccactgaagaagaactcaaaaatctatacttagagagagatgcttccaaatactcattattgaatcaggggaatttggcatatacatcagaggtagaaaccgatcgtgaacagtttaatatattaaaacagtctttaaacattaatggagtgactaatgaaagacaaaccatgttattccagattttatctggtataatattacttggaaatattgtctttaaaaattctgaagagaaagaaggagtattgaaagataaagaaatcttaaattttgaagatccagaattggttacaagtatagctactctgtttgggataagtactgatatattggttgacatactattggttaaacaattaaaggtgggtaataaccaaactcctgtatctatatctagaactagtcatcaatcattacagttaattcattcaattatccgttcaatttatattcgtatattcaattgggtggtttctcatattaatagatttacatcatgtaaagatgaggaacttggagagactgtatctccaagaaaacaaaacattacaaattctgcaaattctttatatattggaatattagatatctatggttttgagaagctcgaaattaattcttttgaacaactttgtattaatttggctaatgagaaattacaagagttttttgtggagaaagttcttcaaagtgaacaaaaactttaccaacaagaaggtcttgtttggactaatattgagattccaaaaacccagcctgtattggatttgatatttgatttattttcactattagatgatgatagtagacttaaatctcagggtcaagatatctctgatttcacttactggcaaaaaattaataataagtatggtaaatctgtacatggaggtaatagtacttatggttctacatattctccaaatagaatgctgaattcaaatggaggagagtgtccaagtaagttaattaagtttccattgaatggcttaaagaagctaaatcattctgatacgccaacagtcttttccattaaacactatgctggttctgttgaatatactttgaatggttggctagaaaagaatcacgacaagattattccagagcttgaggtgatattagaaaattcaagtaatgaaatattgaatagtataatcgattctgaatacaaaagtagaaagagtgcaagttttagaagtgttagtaaaaagtttacaaaagatcttagggatatgattcaggatttaggagaagtttcattacagtttattaggtgttttattccaaatagtcatatgagatcagatgtttggaatggtcatatagtattaaaccaaatgattcaatctggaacaatacagatggtcaagttaatgcattatggttatccaaatagagcaagttattcaacattaattgaacagattcgttgtttattaccagaaaagtatatatatggactatctgatagaatgattgttgaattctttttatctgcttattcaattccttctaatacttatcaatttgggatttctaaattgtttttaaaatctggtcaatatggattactgttggatcaagttaatgaatattcaaaaggaaattattatagtggattggttattccaagtgaggagattcttattgaattaaggaaaagatttgcaagaaaatgtttaagaaggtgtatattagtaacagatttagtttcttggatgaagaatagattcattgttttgattagaaagagaagacagttaatgaatttaatatcaacaaggatttatagatggtatttgttctataaacatataattcttccacttagaagacaggtagagtatagaatgccttatataatgggaataaaggttgtagatagtataataattgaatcaagaaaaagaatgaagagatatttcttaaatattttgagatcaaacaatgcaaagtttaagattgttaataagtttgataagaacaagcagaaagatgaacaaaataaaatagaaggaagtatggaactcttagaaacgaaaataacggagagttcatga

SEQ ID NO: 3487 - DNA, 345 bp, Cryptosporidium hominis
atgagttttaatgaacatgaattcaaaggtataaaaaatgaatggaattctgaacaagtaattccatatataaaaattcagctcgctgaaatacgtagtaatgcattgaaagttgtagaagaagcattttctggtattcatgattcaaaaataactaatgacataaatataattgaagctgagaaaagaaaaagcgacgatacatcaaaaaatgcagccaaagaagatgcatctattttaaaatgtagtcaacttgatttgttaaaatttctaaaatattctaatgataaactttcaaaatataatattggagttgaaaatattagtatgatcaattccaaatga

SEQ ID NO: 3488 - DNA, 417 bp, Cryptosporidium hominis
atggcaggatataatatcggtgttgctattcttccatctaatttgggagatggaggcgaaattgcaaaccaattattggaaagctggaatttaagagatgtagattgtaataatgatattatttttgtatatttagccagcgaaaacagagcaataatcagatggggtatatcagtagagcctgctattaatattgtaatgtatcccgaattaattagtgaaatagattccgtttttttggataaacctattggaccagctatttataatggtatttcaactataagaagacaattaaaagaaaatattgggcctccaagaagacttccacagttacttgtcttatctattattggcggattaacagttttaggatttggtgcattagttgtatcagcaatttcagattctaagtaa

SEQ ID NO: 3489 - DNA, 747 bp, Cryptosporidium hominis
atggtaatcactgactcatctgtaatatataaaaacaaagagatacttgaaaatgagatttctgaattgaattcaatgatttctgaatttcaacaagtttctcaagtacttaataggctcccaaataaggttcaacatgaaattatggttcctttgggcccattggcattttctccaggatatattataaatacaaacaaagttcttatgcttttaggttctgatttatatgcagaaagaacaacttttgaatcacaaaaaaccattaaaagaaggctgtctcaggctgaggattgccttgaaacaatgaaaaagaatctttctaagatagaggaagctcttaagctcaaagatgaattctcaatagatatcaaagagagtcaaacaaaagaggctgaaattaaggaagaaaataatcaagataatatttttcataaaaatattacttttacagatgaaacagcagaaattagagaggaaattgacgaagatattgatatctctaagagctttattcctccacctttgttttcttgtacggatcaaaaaccttatattccggattttcacgtagagcaccaagattcaaggttggaacaagattttattgaagagaaagaagacactcgtgttgagattttggagacggaaatatctaatttgaatattttacaagataaaaaaacttcaactaataaaacgagaccaatttctatttttaagcaaagaatggaagagaaaaggtaa

SEQ ID NO: 3490 - DNA, 2679 bp, Cryptosporidium hominis
atggaggatgattatgaacagaatatggtaatatctcacttaaaagatagagaaaagacagaagaggacataaaaactatttccaaggcattggcagggaacgtagtgggagcttcactgaatgaatctgaaattgctactttggtcagttctatgcattattacgaatatgaagtgggggaagtggtaattgaacaaggagcatctggattctacttttttgtcatttcaacaggaagttttggggttgagattaatggtaacagagtcaacacaatgttagaaggaacagcttttggagaattagcgcttattcacaatactccaagaagtgctaccattcttgttattgaaaagggaggactttggggacttggaagatccacttttagagatacactgagacttatttcatctcgaaattatgaggaaaatagagcattcattgaaagcttatcaatattttcaggtcttactgacaaacaaaagagtctcttatctgaagctttagttagagagatttttgttaaagatcagatcattattagagagaaagaaattggtaatgtgttatacatgattaagagtggtattgttggagtttttgttgaagataaatatattcgttctttaaatgagggagatgcctttggagagagatcgttaatgtttgacgaaccaaggtctgcaacagtaatagcaaatgcaacaactgaatgtttaactttgaatagaggaattcttacccagattttaggtaacttaggacaagttctgagcaaaaacttaattcaacaatctctacagaattctccaatatttaagcaatttacgaaaaatcaaatgcaaatattacttgataagatttctattaagacttttcaaaaagacattattttgtctgctgcagagactaaagcacttaatatgagagcctttgtcatcttagaaggagaagtgcaggtctctcttccatcaaattggctttctagaagggccagtagtttaacttctatggttatcgataaatctattggttctgtcaataattactcactctctgattacattaatgttaacttaggaagaggagattattttggggatgactttgtttttcatccaaaaattccatttgtatgcaagattgaaatgaaaagtgaaactaaaattggagtaatcacatcttcaatgctttctgaatgctttggggatgagaatgttgatgttggacttgaaattaacagaaaaagagatgcaattaagtcgtgttttgtcttccaatacgtttctgagcaacaactaagtcttttggtaaagtctttaaggcttgtaaaatttactagtggtgaaaaaattgttgtacaaggtgacaaaggaactgcttttttcattttacagtctggagaagtagctgtttatagaaataacaagtttattcgttatcttggaaaaaatgactactttggcgaaagagctctgctttatgatgaattaagatctgctactattgaggctgcaacccctgaagtgcatctatggactgtagacaaagaagcctttcttaaaattgttgaacctccaatgcgacgatatcttgatgaaagaataaagctacaggaaaccagagtgcaaatgagtgatttaaagattcttcaaacaattggtaaaggaacatttggagttgtttatatggttgaaaatattaaatcaggaaataaatatgcacttaagaaaatttccaagtcacgaattttggcgctcaatatgcaggcacatgtaaaattggaaaggtccattttggcgctcaatgaccatccatttattattaaacttgttagaacatttaaggattcagaaaatatatatttgttgacagagttgattcctggtggagagctatatgatgcattacaaagaattggtttattaacacggtatcaagctcaattttatattggctcaattattctagctctcgagtatttacatgagagatctattgtatatagagatttgaagcctgaaaatatattactggattctcagggatatattaaattgattgattttggttgtgcaaaaaagattgctggtagaagttatactttggcaggtaccccacattacatggctccagaggttattcttggaaagggatataacttaagctgcgatgcatgggccattggaatttgcttatatgagtttttatgtggttgtcttccatttggaaacgatgctgttgactatttggagattttcaaggatattttaacttcaaagttggtatttccaagacatttgaatgatgttgatactgttaatataataaagagattattatgtagggttccagaggttaggatgggatgttcagctactggctataaggaaatcaaggacaatgtattttttaaggattttaattttgataggttgttaggcaggagttatgttgctccactagttaggaagtatcgagtttttgcaaaaaatacagaaaatgagaatatagttgagaatattgctgaagttagtcagaatgaggaggctttgagtcctaatacctataatattaagtccaagcagaaaataagtttcaatgcttccaaaaatcactctgtaagtacaagaggaaacaagatggacgagtatgattgggatgtagaattttaa

SEQ ID NO: 3491 - DNA, 1278 bp, Cryptosporidium hominis
atgattctttcttttcttacctctattaaggagttgttagttccaaaagggtcgtttgggaatggtccgaattccaaattgactgaaatagtggcattaatcatcatttcctccttattactacttggtctctactgggcgtttatcttcttttttatttttctaaaaactggccagcttacaaatatttccaccacaattgctgtatattcaagattagaagttccttcaatgactatatgctcccttccccatgtttctcaaaaagatagtattttagatgcttatcttaatgaccggcttaaagttatcttaatatataaacatgcgaataaaaattactttagttttcatccaaaaattagaaaatgctattgggagaaacagattatgagcaatcatgaacagtgtttgtgtattgatatgtggaatcagaaattttttagcagaagaagtcatgctattttgaatcctcctttttttctttttcaaagaccaactcttgatggatttgatgtagatagtatatctattggaatcaaatatttgaaaccaataaattccactaatcctcataaagattcatcttttgagcatggtttcatgattaagaatcatacccaaattactaacaatactagggaaagttattctattagtgaaatattaaagattggaatatatgatcagcctatgattattgcaaatcagcatgcagaatctgtagaaccttcttggttctattctaacattggtaattacgctcaggtttcattaaagttgctcaaaaattatgtttttgatgtagaaaaattctatttttatataattaaaggttatgtttcgagacaagaaaatgaatatgaaatagtagtttcacagaagaattttaattctagaatgtccaaaataagacctgaacgctgtaaaatgccctattggatcagaattatgaacaacaaattctaccataattcaagtattagaagatgtattgaaaagagtagttcttcagctcaagaatacgaagttgctagctttactaaatttcaaataagctttcgagatttttcagttactgaagtttttagacttagtggagcatctgtaattgcttcatttcttacacttacagttgtttgcttgtctgcatttaacaaacaactcatctatgagctacttttcccttactacgaagatataaatgccaaatatacagtaactacaattgctacattcttttcttttggatatttaaaaaaatatagcgaagattag

SEQ ID NO: 3492 - DNA, 1587 bp, Cryptosporidium hominis
atgaaatttataggccagccacaaaatttaacggaagcctttgaaagtttaattaataatggatatgatactatgaatgcggatttttatagaggagaacatcttctagaaattgttgtatctattctttcaaagatattcaatatgtacctagaaaaggcaaatcaaattgaggaatttatacggaaagataaagattggaggagttattcaagtaggatagaatcagaattcaataaatattctctagaaaagtccgaactcataggtgagataaactaccttagaaagatgttgaatgaaaacacagaaaaagagaaaaaagtgactaatgataaagttgaaaggggtataaatgttccaaactacaatggagacgatgatgttatgagttgttacacttttggtgaatcctctagtgtcaatttggaaaatgaaacagaatggaacattgatgactttaatcttacaaagttggtaaactcaagaaataatattgatgtgtcgaatattgagccattaaatacagaactagagattgttgaggagtcgaaaagcataactaaggtgaagaatgaaagtgatagctttaataagattgtaaagcttcagggtaggattcgatcgttcaaacaaaaccgaattaagctgcagtctattgaaaaagatggtgatagcttaagtaatcaaatagggaagtctttaatcccatataaaaagaatagttttcataacaatgaagttttgagtgttcaggaaaatatcgagtttgaagatattaattctcttttatttcgtcattcacctcctcaaatgaatggagatgaattagcaaatttaggagaattagaaggaatgacaggtacagcaatgatgctgagattatatcgttattataaacaaacaaaactattagaaaaacaggtaatacaactatccaaagaaaaacaaaaattagaattagaatatgaaaaggatgttcaatctagtcagatgaatcttttatcctccaaacttattattgaggccagagatatggaaattaaaactcttaaagaaaagtgtgaatttctcaataataaactggaagatgatattaaaaatattaaatctgcagctagagaggaaatagaaaaagtctggaaacctaaagtggaggaaattaattctaaatgtgaagattatttatttaaaattggctctttggaaagcgaactgcttattattcgtcaacaactagcattccaaaagcagctaaattctaaggaaactaagaaaaatgaatatagcagtattattaaaggtaaatattttactggcacaaattcagataaatataaacgattttctagggagctaattgaaaagatatcatatggagttgataagtttgaattaaaaagtaatgaaattaatgatgatgttgatggcgagtctgattcttcgatagaaaatagtgcttcagttaatattaaatcagctgttgaagctagaggtgatgattctgatgatcaaaacatttctagcttaaaatctgcattgtcaaaattaaaaacagtttctaatgaatataaatcattcaattag

SEQ ID NO: 3493 - DNA, 999 bp, Cryptosporidium hominis
atgagaaaagatcgcaattcattgaactataatagaagtattattgttaaagagaatgagataaatcaaacggaatcattgaatcaaggtgttgaaaaaaatgccttaattagcaatattcatggagcggaagactcaaataagaaacattatttattaacaatatacgaattatatgtatttagaactgtggtatgcagttctcatttgcaggggaaatgtaagaattctgacagctgcccattcagtcattgcttgacatggcaaagaaggaatccaaatgatcattactattcacctaaattatgcccagaaatatgttttgtaaagagcaatgaaaagatgaatttaataagaaggtgcagaaaagggaagttatgtacatttgctcattcaaaggaggagcagttatatcatccacttatgtataagactaaagagtgctcgctatatccaaattgtaatagatattattgccctttttctcatggtattgaacaaattagagctccagaaaaggtaagagaatctattgaagaagtaatcaagaataattcacaaggtattttgaaaaatccgtacatgttattatctagcattgtggggactgggaacaagtcaaacaatgatattagaattaataaacataaaaaatcgtatttagatgttacgcaaaacaaaaaagatactcttttaatgtcaaaacagcaaaaccctagattaaacgacaataaaattaatacaattcaagaattagaacaaaaagatataaattctatgtgggattccgttgataactggaatttgaatgcaccaaatattaattttcatccagcctttatggaaattatgtcatttaatgaacaggaccagcgtcttgtacatccagattttgatccatgttcttttagaaatatagcacctgaacacaaatttgagacagaatatgatcaaatttggaaggaaatatcaactgaatacaacaaaaaaaaattatga

SEQ ID NO: 3494 - DNA, 1668 bp, Cryptosporidium hominis
atgtccacaaataataaggccaaatcggataataaatcaaaaacaggacaatacgaaggaaagcttccaaatgcaattcaaggacaagttgtgactagatttcctccagaaccttcaggttacttacatattggtcatgcaaaagctgctctgctaaattactattatgcaaataaatatgaaggtaaattactattgagatttgatgataccaatcccgtattagaaaatgaggaatttcaagaaagtattgaagcagacttgaaaatactcgggataactccatttaatgtttcattcacatcagatcactttgatactataatgaattactgtgaagaaatgtttaaattaggtaaagcatatgttgatgatacatgtgttgaagttatgagagaagaaagaggcaaaggtatcgaaagtaagaatcgcaataattctgttgacgagaatctcagactttggaaggaaatgatagacggaacagaacatggacttaaatgttgtgttagagcaaaaattgatatgcaatgtaagaataagtgcatgagagacccagttctttatagatgtgtactcactccacaccatagaacaggtacaaaatacaaggtttatccaacatacgactttgcttgcccaattgtagatagtatagaaggtgtaactcatgcattaagaactaatgaatattctgatcgaattgaacaatataactgggttattaatgctctaggattaagaccagtcgaaatttatgaattttccagacttaattttgtgaatacagttctttcaaaaagaaaactgacttggattgtcaataatgggttggtagaaggatggtatgatccgagattccccactgttagaggaattgtaagaagagggctttccccaagtgctttattacaattcgttacagaacaaggaccatctaaaaattccaatcttatggagtgggataaactctggactattaacaaacaacttatggatcctgtagttccgagattctttgctgttgggcaagatgctgtagctttaaatctcagtgaagcaccggaagaaccattgattaatcagcgtgacctacaccaaaaaaatcctgatctcggtaaaggccaaatagttatgtacaagtcaattttgattgatagagatgatgcaactcaaattgtatctggggaagaaattacacttatgaagtggggaaatgctataatacaagatatctctcaaatagataaacaaccaactggtatctttgaaggtaagctcaatcttgaaggtgattttagatcaacaaaaaagaagatccactggcttgcaaatcttccttcagtattgactaaatgtattctaagagaatacgatcatttaattaacaaaagaaagccagaagatggtgatgaaattcaggaccttgtcaataccgaatctcttttcgaaacacctgcattttgtgatccactaattaaagatcttaaatctggagatagacttcaacttgaaagaagaggttactttattgtagataaaccattctgttctgataaaccagaagaacctattatacttattaagattccagatggaaagtcaaaagcttcttcgacaatttcatccaaagttgatgctcaaaagttagcaaaggggaagaattag

SEQ ID NO: 3495 - DNA, 2385 bp, Cryptosporidium hominis
atgaatccaagtttaagtaaaattgaagaacttctctccttggataaaaagaagagaataccagaaattaaccacgaagtaatcaattacccaccaattattaaaaattattacaaagaagttaatgaaattaaaaaacttaaacagcatgaagttgaccatattcgaattactaataatggtatccacattaaaaaaattaagaatatcaataaaacttcaaatgacttaaatcaaccatattcttcaataaagccaatattaaacttttcacaatgtggactaccacttccaattcatcattatcttaagaaaaaaaacattattaaaccatttccaattcaaatgcaatcgataccaatattaatgtctggatatgatatgattggtaatgcagagacgggtagtggtaaaaccttagcttatattcttcctcttataagacatgtattggtgcaatcaaataacaactacccattcaatgcagacgtggacatacaaattaacaaaaataccaaccttgttagggcaatgattattattccaactagagagcttgccctccaagtttataaacaaaccactcaacttgcaaatcttgtagatcttaccaccaatattatatgtggtgggctcagtattagtcatcaactcaataaaattagatcaggatcggatataatcattggaactcctggaagaattattgatattatgactctattacataagaaaattgttattttccaatttatttcatttctagttattgatgaaggggatcgattatttgatatgggtttcgctccccagcttctcagtattataagtattataaggccagatagacaaattgccatattttctgcaactttcccaaatattattgaacagtttacaaataaaatactccataatccaatacaagtaattgttggaaaaaaaggccaaatgaaccaaaatgttaaacagtatattgaattgcttaataatgaaaatgaccaatttctaagactactccaacttcttggtgaatgggcagaatttggtcttattgtaattttctgtaatagacaaactgatgtggatgaactctttgctaaacttatcccttttggctataattgtttaactttacatagtggtcaagaccactatgatagacattcaaatttaactactttctcaaaaactaatatgaactcaaatccacctcctccatcaggccagaatattctaatagcaacatcaatattttcaagaggtcttcatgttgacaatattttgcttgttattaactttggagctcctcaccatattgaggattacattcacagaatcggaagaactgggagagctgggaatttcggtacctcatttactcttttattacccaatgaaataccccaatcttttgatttaattgaacttgcaatgaaatattccaataataatgcttcaaataggcatatctctcggaatattcatagaaatgatgatgataataatagcaatgccaattctaataactttgttgatgatgatagcaccattattattcagccagagattattcagctttataatgagttaatacaaaagaataagagtgcatcatcaatttccaataattcatcaaataaaagaatccgaaactttggtttcgggggtaagggatttaaattctccaaagacgaaaaaagctcccttcaacttcttaaagatgatactaaaaaagctcttgggcttattcctgatacaaccaatattactgaagaacaaatctttattaactcaaattatgatgatgacactactaataataataataataataacacaacttcagatgccaatacgctatctcattctgaaattgctcatatgccagaggctgaaaaagctttgcaacttgctaccattaatgctgcaaaactaaacaatgtatgtaatattcaaaatccaaatataattagtattactgattatagtaatccgaactcaatcacaattcctaataatcttcatcaagttgttaatggtagagtcattggaatctttgaaattaatgattatcctactcttataagacaaaaaatagtccataaagatattataaaaactattaatgaaaactgtggtgttatctgccaagttaaaggtatttatattccaccagattcatccaacccttcaacaagttctgttcatattagtgagaagaagaagttgtatattgaaattaacggaccaaaccatccaaaagtacaaaaagccattcacgaaattaatcttatcatttcttcagttaaacaacaatcaaatgtgattaagccttcatttactactggaaaatacactctttcaaatcttattaaaaaataa

SEQ ID NO: 3496 - DNA, 4023 bp, Cryptosporidium hominis
atggcaagctctatccaaaaaggacatttacccatatcaacatcttcatcatcttcttcatcattaacaacttcttcatcaattcctacttcaaacacaggaggaacagtcaatgtggggcggggtgaaacagaggaatttgtacattttttatttagggaaggtttccttgtaaagggttcgcgcatggaaagctatgattttcattcaattaccccttctctctcgtatctcatccaaaaaaactttgaaaatcccacgaatggatgccacacaataatttctactcattcatcattggctctcaaaagacaaaatcattcaactcaaagtaaaaactttaatttaattccgaaacctgataataaggatgaaaacattgatggaaagccacaaaagatttccactttaccagcatctaaggctttaaatgctgaagctccaaaacaatttaaagattggcgcgcacatgatatcggtattggatttttactatatggagagtcagcatgtttcgccttggcgcgcatgatagaattgacatatgggagagttgcaaataatggagttgtaacatgctgtgtgttgagcccaaattcgaattgctcggaagatgagtctcaaaacttttcagaaggaaatttgacaaagtcatcgttgaatactgatactgaattgaaggatggtgagacttgtattaatagaagaataacaaaatacggaatagtggcaggctctcctattggaattcctggaaacatgtttattctgaatccatatttggaggttggagaaatcaagactataatagaagtagaaattatgaatgctagcagtataaaacaagtttttgcttgcagaccagatcttgttgagcttggaatgaccaattttgagttgtcaaccaaaactccatgctttttattggcagtaaaatgcagcattgatctaacactaccgatttatgtttataaaagaaatcttgagtcaaattattgctcattgagagtagcaaaggagggtagtatagttgttggaaaggactttcaaacttcaatagagactttgatgagtctttatacatggttgaaaagtcacttgcttaatcccaaatctccgttttttgacttagattatgggaagttttactatactagagcattagaactgctttctaatattgaatatattgtaagagtttcaggaggaactgaaaaaacaatttctactcttggagggaatatcaatttaaacgatgtgggattaggtatttgtggtggaggaagtggaatctcaagacacttagggatttcgaagcttggaactcctaattcaagatgctcaatttcaactgttgcttctacaaatactcctgtaagcattggagaagttcagggtgatttgattactacgaataataacttatgtttaggaggagggcttttaccagtaggaggaactggaggaggtactcctgttcaaggaggaattactggaaatcctgggccccaagaaccttctatgactgagaaagtctttaatagtagtagtaacaacgataataatcctccctctgtttcaggtagaggtaaaagaagtaatgttaaatttaccaatacaataactccaggacaaaattcctcttctactattagtacactagttcctggtacaattgttagatttagatcccaaattccagttgatgctaagcttattcaaggcgttcctgagactgattactttacccatgtacaacaagtctattaccatttccaaaaaggagaatggagagctgtatatggcccctcaaaaaacagacaacagaaatcattttctgttaacaagtatggattttacgaagctaaacgacttgctgaggaatggagacttcgctatctttattcaaatccaaatggaccgaatggtcaacagaatggcgcctttggcaaatgcatgcgatgcggaaatggcgcggcgggaaattctagttcatgcggacgttccgcatgcgtaaagtcaagtgtggagtgtgtttgtaaatataattctaatggtatatatgaggataaccgtgtttctggagggggtgcaagatgtagaactgggaggaagcgaaggtcatctagggtagatatggagagggaggcaagtggggcagcaactgcaggaggacttgttgtaacttctatgtcgggttgcattcctacgaaagtattaaataaaggcaatggcgtatgtaatttgaaagatgcaaataactacacatcgaaagttggagaggtattgaacgagatttcgacaattgccacaggaaattgccatagcactagtggtacaggggggggaaaaggagggggagtttccgagacaatgatcacaatagaatcgaggtctccaagggttgtatctcagaatggagaaggggaaggaagagcaggattagtggaaaattctgtatattccacaatggatgggatgatagcatttggtaatgcagaattttcagcttctgttacagatcagaagccatgccctggaaaaattcccataatttcaagtcaatccccaaaaaacaagtctattttgcatccttccatttctggagttggttttgtgggtcctgagccaagatttaaagatcatcctatacaacagaagattttggatatatcagcttcttctactgcctctactactccatcaagtaccccaggaggattagctggaacgtgtatttcactaggtggtttggggtatgatcaagttcaaaagtcttttgaaagtgatgagttactaaataattcatcatatgggggagttggagtatctgtagctactactgcatgcggaggagttagaactacgggtaattcaaagttggcttcgtctccatcaattggacaaataatttcttcagcaggttcgactgcaacatcatcttctacttctatgatgattccagaaatttcttctccctcaatttcaactcctgtttctattggagttggttcttgttcaaccattatttctccagaaaaacaatcattaattggggttggaacagtagtttctggcatgatgcattcaattcccgagactccctattccgctgctccaggttcttcaagagaaggaattacttactcagttaaatcaggtttggttgcgttgggaaaatcaggaaagactcaatcttcgtcttcatcatcatcatcttctgcgtcttcatcttcacagggaaatggaatatcatcaaaagggtcaataatgtttacacaatcaactcaaggaatttccatgggatttccagcatctggaaatacttattccggacaattttccaatgctataggaatttcagaatcttcttacgggtgtatttctccagttattgaagagaattgttggagttcttctacaaacaatgaagcaatgacttcttcatctatgaatactaattccaatttagttagttccgttggcaagtcaaacagtaatactaatattggtggaactatctctacaccccctacatctacttctaataacaatgttgttatcggtactagaagtgttaataacggctctactgttaataataatgcagttcaaatactgaaaactaatgaaaatgtaattagtactaacacttctcaaagcaatgagagtttaagtattggaggaggttgcctcacaacgggaacttctggagaaagtagtaatacaagttgtttgagtacatccggaacagaaaatatttcgacttcagttgttggatctagaagacctattgaagaatgctcgagtaatcataacgaagataactctaataggaacaaaagtagaaataacagtgaaaataatgagagatcagttaatggtggaggaataagtgtaaataatgagaactcagatcggagaaatgttagttctgatgtgaaccgtaacaatggaaacccatggttcaaaagaaatgcatgggatgaagaccttataatagattcattctttgttgggtaa

SEQ ID NO: 3497 - DNA, 1113 bp, Cryptosporidium hominis
atgccgataatgaaaaacagagatgctgcttttaattacggatgcttgatggcagaattaaaggagaagatggttttatttaggaatagattaaataagggagaggaagaaaatcaggaaagtttcctaaaaaataactctcaagatgagtcaaaaataggtaaggactccttaatttcagaaaacgagctagatttttctcttaatattgaatctagttcaaagaatatgttagtttcagataggattattcaagagaataatacagaaattatagttgaatcaggtattgagaatgtggatgaatgcagaataggactatcaaatgattccaaagtatttccatatccgatatgtttcgtttctaaatcacttccaactcctccaaaagactacaacttaagaaaaacaggaattgatttgaataagaatagatactttcagggggaagatattgaatgtaacagagtatctaaaaagttaatgtttttagtagagaaggagaagaacggaggtaaggaggaatggtggaaatttagaaaggaaaatgatagtaatgataactataatttgatgcaaagccaaaatttaggtgaggctattgatacagaaaagagttttcctaataataatattactaacaaattagagcaagatgacagcagaaataggaaagttaatcaaggagagctgagtttacctcaaaatattatctcttctcaatcaaatataaacattactgctcaaaaaggagaagcaattgacaaaaatagattacttaaaaatagtcaatctatagagaatattagaagttttgaagaaaatataccttcaaaaatggagaatctcaagcatattcaagccttatctgtaccagatctaaaaaaagataatattgcaagtgataatactaccataaaaaatagtagcgaatataaaatcaacacaaatactcaaattatctgtgatgttaataaaaatggaagtattagcagaaaagaaactcaaataaatcctatatttaagaagaaaagccaaatatttcaacatagaggtaatattattactactagatactataaaatggcatcccaacttagagtaataagttaa

SEQ ID NO: 3498 - DNA, 801 bp, Cryptosporidium hominis
atgagcaaaggaaaattttcttttagtttaggaaaatccaaagagaaggggccaaacagtctgggaaatgtttttttgggggaaaaagtgtttgaaagcgagaaagatgaaaagaataatgcagaagacttaggctcaaaaaactcggataattttcagagtatcagtacaaactatgagtacaaaaaatctattaagttttatgatgaacatccagagttactggaggactttgacaggtcaaatacggtaaaaagaatagaagctgaggataaagaagagaaaaaggatgagccaaagaaagcttctttaggtaaatcaaagtatttaagcagaatacaagagtatgtagagttgagaaatattgaaaaacaagaaattcaagaagaaaagattcaaaaggaaataaaagaagaaggaaacactcaagtatttattactgatgcatataaagatgttttggaagaaagaaaaaagctcaaaaatttattaacaaataggaagttatcagaaggtgaggatcctagaattggtggaccctcaagtatttttgaaatgagactttccccgtcaatgaatgaattaaaaaatgaagaaatcgataaacaaattgcttctggtagcccaaaagaagaattgaaaatatataatgttaattcagctaataattctacaaccaaagactattatgttgtaaataatgacgaagttccaaaaactagcaaggatttgaaacttattaaaatacagcaagcaagagaacgatatttgcttcgaaaacaaaataaaaattcagcataa

SEQ ID NO: 3499 - DNA, 1176 bp, Cryptosporidium hominis
atgagtggggaagatgaacataagaatactttagcaacttacgctcaaaaagttaaagagcatagggaactggaagttagcttgaaaaagaagagaatggagattagggagctaagcaaggtatatgataagacagaggatgatttgaaggcattgcagagtgtgggtcagataataggggaagtattgagacatctggatgatgaaaagtgtatagtaaaggcttcaacaggacctagatatgttgtaggatgtagatcaaagcttgataaaagcaaattaacatctggaactagagttgctttagatgcaactaccttgactataatgagaaggcttccaagagaagttgatccaatggtttacaatatgcttcacgaagatcctggaagcgtaagctattctcaagtgggaggattgaatgagcagatcagggagataagagaagttattgaacttcctttgactaatcctgagctatttaaaagagtcggaattaagactcctaagggagtacttttgtatgggcccccaggaactggcaaaactcttttggctagagccatggcttcatccatgaattgtaactttatgaaggttgttgcatcagcaatagtagacaaatacattggagaaagtgcgagagttataagagaaatgtttggttatgctaaggatcaccaaccatgcgttatatttatggatgagattgacgctataggcggaaagagattctcccaaggtacttcggctgatcgtgagattcagagaaccttgatggaattattaaaccaactggatggttttgatgaacttggggctgttaagataattatggctacaaatagacctgatgtgttagatccagctctattaagacctggaagacttgacagaaaggttgaaattcctcttccgaatgaaacctcaagagttgaaatcctcaagattcattcctctaagttagctaaacaaggagaaatagactttgatgctatttgcaagctttgtgatggctttaacggagcagatatgagaaatgtttgttcagaagcaggaatgtttgcaattagagctgaaagagactacattattgaagaagattttctcaaagcagtgaggaaattggctgaaaataagaagatggaagggaatttagactacgaaaaggtttaa

SEQ ID NO: 3500 - DNA, 1341 bp, Cryptosporidium hominis
atgaattctttggaaaatcaaaaaccaattaaggaaaatgagattgagttggaaaatgtgttagttaaacaacctatattaaaagaggttgatgaaaaaattgaaaactttacaaaaaatgactcagaaccaactgtccaagtaaatttgaaagaagattgccaccttgttgcattaaatattggaagctcgaattctgcaaaaagcagtgtttctagtttggagtttatccgacagtatactgataaaaaagaggctatttttctaattgcagagtatttactattaatttcttcaataattcttggaatatatattgcttaccaggaatatgaattagaaaagttcttaaaaaataaaaatggttttgaaaaaactgctaattatgtaaaacaagcaaatattatgaccattataacaactacagtaatggcaactcagctaattattaattgtatttttgggatactttttatattatttaaacaaggaatcatagtaagatggattaatatattcaaatccaagttatttattgatcaagtttttatttggcaatctccatttatttctttaccaatcataattacagccatggtaaagcttatggtaaattttagatccaatttagaggagattatggtacttcaagaatctacccttattattgaaacttcaaattttgctctaaataaactttatttcattataatttactactcagtttatctctcaactaactttattgtggaactctttgtagttagaagacaatatcttgggaacttcattcaatctcaaagacttggaattcttgattactctattgcatatataggaaacgctgctcttgttgcttcattaattctttattttttcaaattcagatattctagttcagcagaaagcaacatagacctaaaatcacaagtagactattactatagaaccgtacttgccgctgctacccattccggcttaattgccatatcagttggtattcttggctacattgcctccttatcttgcagtaaaatgcttattttaatctccttaatagtaaagttctactcaacatttgtattttcatggtcctgctcgcttgtttggtttggaaatcatcttctaaagttattttgcaatattgattcaattgctccaaatttatatagtttacccacacaagactatttggcttttaaaaatgcatgttttacccgcccaaatttttatatgattacagttttagtaattatccaacttactctttccatatttactttagttttaaactttcaattcttaattagcaagaagatttggaagtctgagcctaactag

SEQ ID NO: 3501 - DNA, 2631 bp, Cryptosporidium hominis
atgggaagtaaccaacagcaaatcataatacagtcagatgattttctttatatatatgacatctcacagagagaagtagtagcagagcttgtcatttctaatcttcaaaaccaccaggttgctgtcattaataataagattgggcaaaacttccaacaatgtctgacatttaatacaatttgtaatgaaacaggaggttcttccactggagtcagaacaattcaatggagccaagataagtctgtgattgcaatcgtatgcaaatacaatatcattttcactaatagtgagcttcaagtaattgcaacttatactgaaaatcttacagtaaagtctggaatttggcatgaaactcttccaatctttatatatactacccaaggtcatattaaatatgcaattccaaatattaatgaatcaggaataatccaaacaatccctgatactctttatattaaacactatgaggactcaaggaaggaattaattactttaaataggtttggtagcgtccaaataattgaaaaactgaatttgaatgaggcattatttaaactttccattattaaccaagaaagcggaaaagtattaagatataccaaggatgggaatttgaaaggactttcaacattgaattaccttacacaacatggatatccagaagtagcaatccaattggtggagaatccaattttgaagttttattatgctgttcaatttggtgaaattatgcaagcttacaatatagtaaaagatttgcagaatttggaagctgaaaaggaaaattcaagttcaaattcctattttaaaggaaatagtaaccataagactattcttcctattctgaactcaacaacattggaaacaatgtgggactgccttggaagaagtgctcttttacatggatttattaacgttgctgaaaaatgtctccaggttactaaagagtttgagaaactgattttactttattatgtaattgggcagagagaatatatggagaagttaggtaaaatatccgagaagcaaaagaattggacaagaaaataccatattgcccttcttatgaacgatattccagagagaattaacattttaaaaagtttcggtcagattcctcttgcaattgccttagctcatacatatggatacaatcaggtaaaagaagaactcctttcacagtatactgaagcttatagtgtggatggtgctgatgcttttgagttcctgaatattcttaaagctagtaaaccttcagatcaagtctgcaatgaatcatccaagtcttgcatgacagctccttgtattccaattctagcagcaaagaaactcaccattgaaggacttaactggccaagaattaatatctcagagatatcatcagaaaatattagaccatccgaccagaatgattttaaaagcgttggaggtaagagcttaagtcagatagatgcatcttcgataaatggaggtactggatttggcacatcatcccagccagaatgggatgatattgataatattgatgtcccaaatgatataaaactgaacgaagaccacattttcgagggaattggaggccaaaacttgtataaaaatgaggctcctgactcaaatgggttatcaaagatgggcccaggtccttcattccaagacagaatattatgtgctccagaaaatgctccagcaacgtcttccagatactctatcattaatttgatagtggcaggaaaatacgaagacgcgctcacaattcttttaaggaagatgggagttaaagattgtcagcctttcaaacaaattttcaagatgattgctcttagttctacctatagcttgccaagcttctctgaaggacctagcattaatctacccttaatttcagaagggtacaaactctttaatgagaactctccaaatggacatatttccccaataatcttattcaacgaatccaatttgatagagttagtgaaaactggacagaagctggtaacgtcaggaaagttccaatcagcattggaagttttccaacaagcaataattattgctcccttggttgtggaacattactctctctattcgcaaaacattgaccaactcaaacaactttcagaattaatatgtcagtattgcattggaatgaggcttgaacttgctagaattgatcttttaaataactgtcaagaccaaaatcaggccgaaattgtaattcggaatttagaactgatttcatacttttcatcttgtaaacttcagccattacacacctctttagtccttagaagagcaatgggtattgcatggaaacataagaactatataacaacagcaagctttgctaaaaggctcttgggtattccaaatattgaagacgtcgaaaagacacagaaaattctcgcagcatgtgaccaaaaagccacagacgaacataatattaactttgacccacacagagatattggccacatcattatttgttcgtcatcgcttacaaaaattaatccaaaatctcaagattttgtcaaatgcccggtttgctctagtaatcacctttcacaatttactggagaaatttgtcctaattgcaaaactggcgaaattggtcttagggttattggaatcctctaa

SEQ ID NO: 3502 - DNA, 1866 bp, Cryptosporidium hominis
atgagctctactgaaagtggagagcaaataattgaaagaatccaaactttacttggggaagaatatgataactataaggaaagctttgaagtaattcataaaataaatccattaagtaatccccataagtttatcagtcatgtagagaaatatttaggacacccaatttcagtaatgaatgataaatcggattttggatatcataaaactgaattaaataaatcttcatcaagaaatataaatagaaaaagtattagtgggataaaaggatattctccatccaggaaaggattatctggaaattcttacaaattcacaaatatcaaaagcttttccaatattatgaaagattttggtaatgaatgtattgaatcagaaggttcttcaaattcaaaaataaccacatttaaaagtaatattacacccatatataatgaaaatcttttgcgtagaaaaggatgtttgactgataaaagttttacaaagtattatgcagaaagaattgtagaaaattcagaagattcactttggttggattctgatttagaatcatatagtaaagaaattgatagaagaattcaaagtttgattgatgaaattgtatcaaactgctcagatctttggattgatgaacaaggaaataaatacccaattattccaattggagagacaagaaaacaagctgttgttactttaggagcaataggatgtgataatgaaggaaatctgaacgaacaaagcgttatattacttggtaccacagcttctagttcaggaaatatttcccaacttaagcttggaaatgtgaatggagattttgctctatatccagggcaagttgtagcaatattgggtaatactgagaccgatgaatttggacaaaattgtatacttgctaaagaaattattggtggattacctccgaaacctgcagagaccagtcttaaagaattgaaaaatattccagaattttacgctggaaaaggagaacatcctgtacaatgtatgatcttttctggaccattcacaactgataaagaaaatctcaattatgattatcttaatgaaatactcaattatgcaaatattgaaaaaccacacgtacttatcctattaggtcctttcattgatgtaagaaatgaatcaattaaaaagggtgatttatttgattttggctcgaatacatttattacttttgaagatctctttcgaagaaatatttataattcaattgaaagttttgcaagaaagaatgaaaaagttaagatatatatcattccatcagaatatgatgcagcacataaaaaaacaattccacaaccaggacttaaagaatcattctttccaaacacaagtaatgaatcattgacattttgtcgaaatattcattttctatcaaatccatgtgaactttatattaatgatataaaaatttcaataacttcttctgatattgtgacaccaattattaattcttgtattactagaagtggaaatcttcctttagaagttgtacttagccaatttttatatcaaagaactttatatccttgtttcccagtacaacatccaataaatcccaaacttcttcaaaagcttgctttatctggtgaactacctcatattataataactccatatggaagttcttgcccttttgttaaatctgtacttgggaggatttttgttaatccaactggaaataaaccattttcaggagtttcattatacattaattctccaacagaatctcaaattcaacaagcaaatgaactttgtcagaatttggatgaacaaacatgtaaagttccattatttattcaagaacgtatatgtgctgatgaaattagcttttcaaaaaattaa

SEQ ID NO: 3503 - DNA, 810 bp, Cryptosporidium hominis
atgaattcagacctttcttcttcaggtgttaattcacttgtggatactcagaatatgagttcttctcaagcaaatggaattagtagtgtaggaaatagaatggataatctcactattaataatactcctactgcttcaaatactataaacttgcaaagaaatcagcttggaaacttaacagatggattaactggtggaccaattagatcttcagataagttattatctgataaacaaaatgatttgggaaggagcaatccatattcagagaggaaaatacaacaaactattggagaaagtgaaccaactcaacaagttcctgcaataccagcaactattcaagctggaatagtttccaataaagattttgacaagccaggagcacttccacatctatttagaagctttagagctaccaaattttgcaaaagatgtggagctggaaattctattgttgtctacgattcaaaatctgggtctgaaatatgcaccagatgcggagttgttgttgaagatagagtcataaatgaggaacaagaatggagatctttctctaacgatgggaatgatggtaattctaagtctcgtattggttctgtaaatgatgtttggctagatgatggtaccgattctcagttacttgttggtgataaaaaattaatgaaaactatgttaaagcacaacactcaagcatcaagtgatcgcatgattaaagaagttttcaatcaattaaggcaaatagcaaatagtttttcacttcatgataacattattgagagatgtaaggagattgttaaagaagcaaagtaa

SEQ ID NO: 3504 - DNA, 1233 bp, Cryptosporidium hominis
atgtcaaaagttccaatttacattgttactggatttttgggatcaggaaaaactacccttttgcgtcatataataagtagtcatgatcaagatgcaaagatagctataatacaaaatgatttttctgatgaaatggggattgaggcccctaccatgcaggataaagatggtaatttatttaaagaattttttgagcttccaaatggttgtgtttgctgtactgttaaagacgaactattaaaggcagttgaacatttattatcaatgaaaagattcgagaagatacttttggaaactacaggtattgctgatccagaaccaataattgagaagttttggcttgattgtgagcttgaaactagtgttgaattatcaggagtaattactgtaattgatacttataattttaagaattacttagatttggagcttattaataagaaagtaaaatgtgaaaccaataaaaatttacttaaaaatgatagataccatttaagccaggaatcaagtcaaaatagctcatcattgaaacttttatcaccagaaataattaagcaaataacgcttgcaaacaaaattgttctcaataagactgatcttttaattgaaaatggattggaaaaaacttcaaataatctccaaaaggttgcagaagtcgaagcaattattaaagcaattaacccaactgctaatgttgtcacttcaattaaatcccaagtaaaaatggactggctttttgatcttgatgcttttaatattcataaaataacccatgaaatagacagagctttcaataattccttaatttcttcacattcaaataattctttactcccaaatatctcttctcacaccatttccttcaactcgaatgccgtatttgattttaagtcggttgagagagcggttgcaaagcttgcttgggaagaagatgatagcttagaaaatgaggacttggaagaacagaatcaagatttaaaatacgactctgtgaactctaaatatggaaaattcattagatttaagggtatattcaaggctaaaaactcaattgaatctgatcattcaaacaactccattgctatatatgctttgcaaggagtcggacagatttttgaaattctacccattaatattaacgaacaaattgaaaactcaaaattcttcttcttgggaattaaagttgacaaagataagcttgatacacttttaaaatcttgtatcatacaatag

SEQ ID NO: 3505 - DNA, 2910 bp, Cryptosporidium hominis
atggcagacaaggtacaaagagtgatggaggacatggttccagagctcttggaccttggaaaacgtaaagttttttcaaaagaggaaatcagagaaattatcaagcatagaaggaactttgaatataagatagcttcaagaactccaattttgagagattttttagaatatttaagccatgaatatgaacttgagagaattagaaatactagaacaaaggcattaaagttaaaaaaacgtactattggtgattactcaattattcgtttaatccacttcattttcaaaagagctctcagaaagttcccatctgatgaaaagctatggcttcaaaatattgacttttgtttaaaatcaggatcttcaaaggctcttcaaagaagtttaatttctgctctcaaacataacccaaataatagtgttttctggcttataatgtctgatagagagctacaaaatggtaattcaaaagaagctaggtctgcaattcttttgggattgagagtaaacaagagttctctaatactatggagaggtttttctcaacttgaaactaacattgcatatagaaagtatttagactctttttccagctctaaacttgcacttaataaaggattccaaattaaaaactccagtgttatgcctctaattccaatcttaaaccatggcctgagaagaatcaagcttgaatataagaaagaagctcatattatatttatgttcaggcaatattacaagctttataatacacttttgaaggatggtgatttatctaggattgaaggtatggacgagctggaaaatcaaatatttgactcatttaatcaaaacaagaaattacaaccattatttccagtatttggaattattttaggcattgccaaaaatgaccaatcggatatattcagtcattttaaatatgaaattgaccaactatttagtaattcagatagtgaatttgttttggtttctttgatctttatttgcagactcatttataactgcattaatggccaatttcctgtatctagtctaggaaatcagtcaaatatcgatacctcatttgaaaccatgaataattctattatagattttgggtttcaaatttctgagtccattcaagattttgataataatcaagaactttctaatcaaaatgattctacaatggagaatgatttaaatttagatatgattacttggtactctcagacttgtttgaaaaatttgatattcaaagaaaatttacaaatcaagaaaactattcatttattgaaacttgatcctaacttttggaattgttgttttttagaagattctaatgttgaagatcttattcaaatgctttcattatactcgatacctagtattgtagatagagaagtatggaaggaaaaattattttcaaaagagcaaattgaatctattagagaaaaaattatattatacttatctcaggatttaaataaggacagattcgtacaattagtcactgatataaagggtaccattgaaaaattggctattgaacctgaatttcaagatttaaaacttactctatttgaggctcttgattcgttatttgattccaaccatgtagacaattttaataactatactaatggtgacaaatatacaagagactctccaaatcagaatttacctcaaatcccggataatattccccaattgatacaagcatataaacaattcattatatattatggtacaaaaccactttcacctaatcaggttacattcatgatacaatccattaacaagctgttagatctaatccaaaaccaagttgaaaacgatgaaaaacagtctgaaagtttggattttattggattttcaaaatcaatcttctggactttatatatcataagcaccaattcacaagaattaaatgaagaatattcacaaagtcttctcaaacttagacaaagaatcatcttttcctcacttaatattttaccaagatggatttctactaggaaaattccagggctcatattcaatacattaattatttactctgtacttaaatctacagagaatatggataattcattatcaagtctaataatcaaatacttaaaataccaagagactggtatggaaattaattttgtttcatcatctattattggtattcttaaagaatctataaatgaagattatcttactcatgctactgaaattcttcttgaattaccatctgaatatagctggttactttccaataatattactatgatgtctaaaaccaacaaagatattacatcaattacattcatgctttcttgtataactttactatacttactacttgaaagatatctggaaaaatgtatttcacgaaaaaacagtcacaataaactcagtgatccgaatctacaagatccaaataattatctaatacctaaactattttggatgttgaaccatctaattacttatattaatggtcttgatgactttaagtctgaagaattcaaaataaatttgtacgtaagatatttacttctcattaaacttatagaacatttcaaggtaaaaagaattctttctccgaaatttggagaatttaataacggtacccagatacctactttttcaatgctaattagtcagtttaataaatgctcttcacaaatgccttctggcaaaatgccttctgggcttagcattgtaactatctctactttacccgtagatgatcctcagttcgagctattcctaaaaagaatatccagcatacaagaaaatggtcaagaagtctttgaaacccttgaatctcaaaacaatccccatcaaatcttaaataaagtcatgcaaaatattttaaatccatgccaacttttggcgccaacatctatatatgtaaatactaattatttataa

SEQ ID NO: 3506 - DNA, 3750 bp, Cryptosporidium hominis
atgagagaggaagagggatatcataagaaggaggagtcaattacaattcaacctcgtttatatagttttgataattcatgggataatgttgtattaaagctaaaacaaacagattctctcaagtttccaataataattgatcaagttgtaagaagcggaaacttattttatatatctttaattacaggtcagctattaagatgggatccagatgaagttacaacaaatttgatagttcttgaacctcctgtaggtttttctggaggaggtggtggcaatggtggcaacggtgttatgggaggagtagggaagaattatgaaaatatcgataagggaagatctcctcaggcaccacaaatctttgtagatcagacaggagatcacgcattgattgttcataacaccggagagacatggtatttacattcaacacaagtaaaagcaagacatatccaaaagttgagtaactattctatcttgagtgtagcttggaataactgggagacttcaagaaatagtgcagtttctgtgattattgggtgtaaaaagggaaccattttgaccacaattctgggccccgatatatcatccagttccacagtaatcagagttttacatgaaatctcgggtaccccaattttaggagtcatgctagattcaatttggatgaaagactctgatgatgctcatgataatcaaaacaatgaatcatcattgaataaactacaatatgtagtatctgtttcaacaccaacgaaattacttttatggtatggtcaaaatagaatcattgatttgttcgttaaaaatgatgatcttggagaatcatctcggtactgtttggaaattggatctactgaaacagcttcattaacaagtaaaatacgattattggaggtaactaattatcattttttaatttggattagcagtagagaaatatccatttactatgttaatagaagtaaacattctattttagaagcctgtgattatattggtcagcttaagaaatatgattttttctccaattccaacaagattcccaatagtgttgaatgctctagatatcatattattgctttatttgaggattatttggatgtaatttctccaattactgcaaaaagcatatataaagtctcaattgtgagtattcctgggcaattagtagtaggaggagaagtcatacaagacttgcaactggcaggagatggagtggtttcaaccattaaggctttggccattgaaatatcgtccagttttaataatctaagtacgttaagaggtagtaactccaataataatgaggaattggaaatcttggacagaataagctttatttggggatataataatgataatatgtacaagattaatattattaatgaaggaggagcattatggaaggaatggctttatgttgggatgtatgaagaagctcttattagtactgagaagatatcaagtacaactttgaaatcaaaaaagaagtcaatgattagaagactccaattcattgatttctttaggagaggaaaagtaaagcaagcagctcaacttttatcaaaaatagatgatgaattatcatttaatgaaatttgtaatatgttcatttacaatggatgttgggagggcctaatagtatatttgacttgtaagcttcagcaattaagatcaaatcacaaagatccaattactaccagttctgtttaccaggatgagacaattattttaaagtttgttgtattaagcatctggctggtagagttgaattcatttgtctcattttctcaaggagagaagaatattgatgataactattactctggcttaattggagttttgaagttgatatatcaaattgatgaagtagagacaaaagtatatcaaatactcactcaatataatcgtagaattgcaattcaatattattcagatcttagaaaggattggcatgtcttggttcaagaatatatttgttttggaataatggattcaagtctaattagaaaatgttttgaagtctttgtttccattgggggtagcgtttcaaaaagggataaacttttgattcaatattccccaatacttgcatttttagatccaaagagatttctttcattactaaagagaccatcctttgcttcaattgatttgaatttaattctcccatatttgcttgatttaaatggaatagacattcaatataaggatccttcagaagtaaaggatgaaagagaagagcttgacaagcttgcaatcttgttgatagagaattttcttaatttgaacggtaagcagagaaaccaatctgaaatggaaagagtatccactcgagtaaaattaatgttacatacagatacttggaaaggtaataaaacaatctggaatgtattagctatcttgtgttcaaaacttgatgaaggagaagaactgcttttatcttatataactcctttacttagcaaagctaagatggaaggttctctttatgactcaaacccacaagaatcaaagcttgaaatagaatttgatcttccttttcttcttaatatatgcaataccaaacaatataaaaggttgaaagcttatgtttactgtttattaggattttacgattctgcaatgtcagtttgtcttaaagagttaaatagtactaaactgacaagagatattatatataactttattgagagctatgaccaaagaagaaaatggatcttgaatttgattaagcctttaggatacaatagagatattcaagggctaacaaaactccttgcagcttcgccaaagtatattttgactttaagtgatgtattaatggtgattccagatgatatccaactttcatttctaagcaatttaatctcgaataatattaatcaatttgacgaattgctgcttaagagaacgaatatatatgataattataaacaatccagagagaaacttttgatggacctattttcttgtcatacttcttataatgtagtagatcctcagaatgatatctgttttgtttgttatagaggattattcaattatcaaggctttacttttgaagatattcgtgaatttgctcattctctaagaattagccacttagatcaaatccattttagcagcttaataaattatttcctggtaaaatcaaggagccaaaacgaggggaaacttaaggatactggaacagtaattaaccagaaagctgaaatagatgaaaataatccatctggatttgatgaaactcaatattataaattcttgaatgatgacttgaattctaatgttttattatttccctgctcccatagcttccactttggatgtatgcttttgaaatatacatcactaatgaaccatgatgaaattaataaaacaacaagaattatagagggtatctgtaagcattcagccatatattcaaagaactataacaagaatatgcgatcccaattcaaatctgataccagtaataagccttcaaaaataatttctagaaatatattggattatcagaattcgaagaggagtataaatatgaccaaatccaaaaagaaaatggacttaatattaattagtgagaactcttccaactctattttacattctttatataaacaattaataaatttagtaaacaatgattgcttgatttgtggggaattgatgattagaaacatcgataaaccatttattactgaagattgccaaaatactaacctcaataacttctatatttag

SEQ ID NO: 3507 - DNA, 1629 bp, Cryptosporidium hominis
atgaaaaatattaaaactgaaaaaatatgttgtattggtgcaggatatgtaggtggcccaacaatggcaatgattgcgtataagtgtccaaatcttaaagtatatgtttgcgataaaaacataaagaaaatacaagaatggaattctggtactactccaatatatgaaccaggactaaatgaaatattaaagaaaacattaaatgtaaatttgttttttagtcatgaaattgagaaagttattaaagaatgtgatataatttttatttcagtaaatacaccaacaaaaacttatggtagaaataaaggtgaagcccctgatctatctatgatggaggattgttgtagaacaatttccaaattttcagaaactagtaaagttgttattgaaaaatcaacagtgccagtaaaaacttcagagtctttattagaggtattatattcatgtagaaaaagaaaggatatagatttcacagttatttcaaatcctgaattcttagctgaaggaactgctatatccgatttggaatttccagatagagttttaattggagggagaacagattcagaaataggtaaaattggaatggagattctaaagatgatttatttgaattgggttcctgaagaaaaaattttaatgatgaatgtttggagttctgaattagcaaagcttgcttcaaatgcatttcttgcacagagaatctcttcaattaattcattttctagactttgcgaagctacaggtgctgatatttctcaaatttcaaaagctgttggaagcgataaaagaattggaaatgaatttttgacatcatcagttggatttggagggagctgtttcaagaaagacgttttatgccttgcttacctattcgatcattttaatttgaaggatgaagctgagtattggagacaagtaattcacttgaatgaagttcaaaagacttcattttctgccaaaattgttaaatcaatgtttaattcacttaataacaagaaaatcactgtacttggattttcatttaaaaagaatactagtgatgtcagggaaaccccttctggcactatttgttttgaactattaagagaaggggctaatattactattttcgatccaaaatcaaagaaagcagaaattatttctgaattaagtaagtatggtatccataatatgtcatatcaaattgggcaacaaggagaagctgatatccaaactgaacaaactgagaaaaaaatcgttcctgactctacatgtcctaataatattcaaatatcagctgaattggaaacagcaattagaggttctcatgctctagttttttgtactgactggaatacatttaaagacataaactttcaacaagcatttagcaatatggaaaaacctgcttttatttttgatggaagaaatttcctccaacattatcagctttttgagattggatttaatgtctatcctatcggaatgccacctctaatacattctaattcccaagtttattccaaattccagtcaaattctcctcaaagtgaagcggttcactctaaaatgcatgtaaataacgatagtgcaaaatatggcgccaaacttgaaaattacatgtatgaaaatagagcattgaattaa

SEQ ID NO: 3508 - DNA, 375 bp, Cryptosporidium hominis
atggatacaagaagctgtgagcaagttaatgaagagatgattgatcaaaaaattgaggaaaacaatactgctaacaattcagtaaacccagaacctggtcagaaaagatttgaaataaagaaatggaatgcagttgcactttggtcatgggatattgtagtagataactgcgcaatatgtaggaatcatattatggacttatgcatagaatgccaagccaatacaggatctgctcaaagaagcgaagaatgcacagtaacttggggacagtgtaatcatgcatttcacctgcactgtatatctagatggttgaaaacaagaaatgtatgccctctagataatacagaatgggtattccaaaagcaaggaagataa

SEQ ID NO: 3509 - DNA, 528 bp, Cryptosporidium hominis
atggcgaagggtttgagaagtaaggtaaaaagaaggtttcgtacagccaaaaggctactgattaagaatactttagaattaagtagaaataccgaaaagtctaatgctctaagggaaattggagaaggtacctatgtacaaaaagaaatcccattgaatgccttcttgtatccagaaagtaaaaatgctatttttccacaaaaaaacagaaatgcatctattgactttagatcagaatctataagtagtattgcaggatatatgggcccagggaatagacgtaaatactatccaggagaggagataccaatcctaagtattatgggagacggaaatatgacaaatagtagagatgttgaaattataaacacaactaatatgaatatgaatattgatagtacaaatcaggttaaagatgtagttgagtttgaaactgaaaagaggcaggtatctattcctgtgatcaaggattcaattaaaggagcatatgaggcaagttttaagaagaaaaacaaaagaaataagtaa

SEQ ID NO: 3510 - DNA, 924 bp, Cryptosporidium hominis
atgactacagtttccaataattcagcagaaaataaggtaatgacttttcttggaaatacaggtccatgtgttgagagaaataatgaggtttttgtggatatatttgagagaattagcttggttttaaatcatttgggtgaaatttctcgctttaatattgaaggaggaatacttatgaaaagttatttaataggtcaacctgaacttactttaggattttctaatagtatcattttaaaagaggatgacgaactcggtccttcagaatctaataatcttttcaactatgccccaagtactgtaattgatgattgtaatttccatgaaagtgttaatgtgaatgagtttttaaatgataaagtactcacattaaagcctccagaaggtgaaatcattgtaatgaattatagaatctcaaaaggcacccttaatataccttttaagttcacaactttgattgaggcttcgggtaattcaaagaagaattcatccaaatttgactttgttattaaacttaaggttgatattcctgaatcatcctttgctacaaatctaactatgctatgcccactaccagaaaaaaccaatacagtttccttagaaactattcatcctcttattccagttcaacaaacttctcaatatgatgataagaaccagaggattatctggaaaatcaagaagattcatggtggtacagagattattttaaaatcaaagatttgcctttcttttgaaactgatttaaattctattagaaaaaaaattggtcctctcttcctcaacttcgaaatcccaatgtttaatctttctaacatacaagttaagtatctaaagatttcagagaaatatggacagcaaaataactatagatgggtaagatatgttactcagtctaattcatatatctataggctattttaa

SEQ ID NO: 3511 - DNA, 2040 bp, Cryptosporidium hominis
atgagtaaatttaacagacaaattcatttaactgttaaaagtattttacatgtactattcgttttacaagtgggaattacgtgtgtaaaatgtattgtggaaaaaattgattcaagaactcccagtggaacaaatgcttatatttggctaattaaatcaccaaatattttatctcagagtattaatgagccaacaagatattcatatggattaatgaaaggatcaataataagtttaggtctagaatttgatttttgggagtatccagaggataaaaatttagtagattccaaaaatgaaactgaaaaaaaatcattaaaaaataataataaagagctaattagcaaaagaaataaaatatataaaataaataaaaatcagttattaacatcaggagttcctctaataagatttgaagatcttccaatgagttgtgtgttttctctaaagtcagaggaagttaataggcttgttggagatttaaatattgcaaattcaaatgatgtttttattggtattaagtggagaaatcatagactaatattagtttttaaaagattaattaggcaattaatattgtattggaaaagtataataaattatttcatgccaaaaagtatttcaaaatcaatagaaaaaaagtgcctggattatttttcaacaattttaggaaatatcacaaattcgacagaattaataaatagtaatatgatttcattagattcagaaaaaaagaattcgaagaatcatttaaatagagagatatcttatcaggtaacttccattaataatttgggcactaataaagtgttaataaatgaaagtaatcaagcaagtaaagaattgaaaaatatatttcttttattattaaatagtgaacaattagcatcattaaaccactctccaatccaagatttggctctcctttcattttcagcaatttatccaagatttaatataagttcttatattagaagcgtattgaggattccaattaaagaccgtacattaagacttgaatataaagtttcgaatatggatagatatacattattgatagtaaatggagatcgaattccacttcatattaaaggaaaagtagtcttaaagaatccatttccattcaatcatctctcatttgaaaggagaatggataattttgtggttgatttcatgttgactttatatatatctactattttaggatatttaatttattcaatatatagtaaccaagctctagtacagacttatggaagtgtgatatatattaaatttaatagtcttcaaataattggtttaatattattactgattaaaccaatttgtttatattatgataaattaaatataattgcatttacacaatatggaaatgtaaaattttcatcttggtttattccaagaatattaatgagaagttacgagactttatttataatgtatatgttattaatatcacttggctggagggtgttaagagatagcttactttctatggaagcaaaattattaataggtttctttacactacttttttatttgggagtttttgaagtaattttaggaattttccaaatttcaaggtatatattccaagctattgcttcgttatgtataattatagcaacaaatattaatacgactcttcttcaaaacacaatttctgatcagtcaatttcatcaaggcttggaattctttacaataaattggaagcttattcaaattttaaatgggtgttcgctatttttgttcttaaaccttcaattttatttctatgtagagttttcacactccagccaaatggatttgatgattggatttatactttttttgattatatgatagactacagtattttattatttacaatgtttttgttcaggccatttaaatctttaaaactttttagtaatgttctagcaaaacataacaatgaatcgaataacggtaataaccgtaataatagctttaatataaatagtaataacttcaataatagcaatttggatgtatcaatgtggccagttataatgtaa

SEQ ID NO: 3512 - DNA, 6318 bp, Cryptosporidium hominis
atgtctttaagagagctggtagtgggatcgactcagatgcttgtggagagtgtattaaggaggataaatgaaaatttgctgaattactttatcaatttgccagaaagtatttggttgagtgggtttttagaccaagtaaatttgaaagatgtaatgttaaatacgagagcgttttccaatgaatggtattctttagatatacctttcagacttaaatatggacatataagaagagcaagtatccaagttttgctagctcactcaaaattggtgatggaagttgaaggggttgtattaattgtaggcccaaatttggcttataaatcatacgaggatgtgataaggaattcaatggacaatgtatttgggctggttgaactatttaagcatatccaaacaattagatacaacaatgatagttttgaggaaggtttaggatcccaaaaaggggaagtttctgagaatctactcaatattaactcgtcaagtaaagaaggattaaacgcacttcttagatggctttttaggtatgttcctgatttgtcccttagtattagaaatctttacattcgctatgaagatgatgtgttggatacttctcatccaatgtcagcaggaattcatattaattctgtgactattaatcccgctagaaactgttgggaatttcaatggccaactgaagagaaagaacaagttggatttacttcaaagggtagttcagactctgagactgatccaaccaatttaggtaaagcgcagcatcctctttcaattaataattctaatgcagatccaaggggtattttcagtattaaagttaaaggtttaagcgctttttgggatgatgaatctgctccatttattcctatttcattgctagaacaaactgaagcttcaaatgataaatttggagtattttcagcagtaactattgatgatatccagaatctagtcaactctaatctacattaccacacaagaattatttcaaatcttaatatttctgctcagtttgggtttgtaaatcctttcatccacaagctttctaacgaaaaaagtcgtcaaagcaatgatatcagtgctaatggtaatggtaatagtagtagcaatagtatgattaatggtagtaactttggacaaagctcttcctctgaaccaatatcttctcaagaatcctcctcttcatcatcatcttctacttccaaaaattcaaccgaaaataatggttatatagcaaaagattatttgaacgattactatactggttctaatattgctacattactcaatattaatatacagagtggatttgaaattaatgtttatccacaaatgattcacggacttgttagattcgtaactctctataatcagtttcaattttggacacaagtaaggaggtttagaccaattgaaaggccaggaagtggtaaaactcctgctgaagttagagcaatttgtagagattggtggatctttagtcttaaatattacagaaatatcaaatacaaagacaacaaacataatagtcttaaagatgaaattaactacagggttgaaagaaaaaagtatatcaagattatcaaaaaatggaaatggatcgaatttatgattactggccaaaaacctattttgaactctgggaccattatacacaggaccggtactgagtataatgtatgcaaatttggcggtatgggtgggcccgccgaatttggcaagatgaatgaatatgctaaaagtattggaacttctatttcatttctggattcgaatttgaatggtaatccaagtttatcatcaattctcggtctaagttctcttattattaatcatttgggtgtatcttttaatttaagtagatattggcaatacgatgttgaagtcttacaaaaggtatcagagaaaagtgatgatgtgagatgtatattaactgtattacaacaccattcttattgggtagtatctcaatggcatattttagcagaacgtgagtttgaaattgagtttgctttatttcaaaatagttcaactatccaaaaaaagcaaaaaggagctatggatacattttctaatgtaaaccataatatggatatcaaaactaagaatatcttaactttactagcttatggtcttcatattcagactgattcatcagtttgggagttgattagtaagttaagagatagttatattgatcttattaggagaataacacaagatgactctttgagtaaccgtattaaagagagtcttcaatctaaatcatcacttttgagtggaggatcagtttttgaatttaaactaacttcaggaattccatcagcggtaccgacacaaatatctaattttatacaagaaaatattgaaagacatccatatgttatttttggaacaggaatctttaagaagagttcaattgaaactgatattttatctgacttctttggcgtggggttgaattctaagttactaatgaagagacgggattggcatgcaatcaggcttaggttacatttatgggggaggttttatgatgaatattttgaagcctttccattagctatttcagagactttagagattaatcaattaatgaacttgagctaccacttagatttccagcaaatgaacaaattatttagtatttcaatgcaaagcgattctttatgtttctcaactttagtttcttctcaggctacatcgtcaaatcctatggaagatattgatatgtccatgggagttacaaatgtgactatggcaagaccaaagagtcaacaaatatcgatcattgaaagagatccagagttttcattatctttgccatcttcttcaactaaacttgagaaatctgaggagaataggaatgaattggatcatattggaaaggataatcatacagataaatctgaaatctataatttgtctaaatcaggtatctctatgaaccaattaaataaagaatatgcaagtatggagtctaatgagatggtagaggaggaaagtattataaatagtacatctgttaaaaagaaatcattcaagtttgagaaaaagttaccatatgtctttaaagattcatcaaatgttccagaatggctgagtgatttggcaggacctggaattagccttcctaagatcatttcaaataaaattattgggatttgtattcctaaatttgagattaatatttgtcatttggtcagtgacagtaaaaagtctacaggaaatggtaaagctggaccaaataatagtgaatccaatatagaaactacaggatttagtccgaaaaattcaaatagaattgatggaatcaaaagaagttaccattccttagcaagatattttagtagaaatgttcaggatactagtaataatagtatggtaacgagtgtatttactccaagaaagctttttgggattgtgattactggcttaggatttaatatgagtacatgcacaagtcttagagtaagttcttgctttaagaggatggagttgatagtttggaactataatgacagtaacttgatgagagatttcatttccagtatcaagtcagataggtcagtaaacaagaaaatgatcagagatgatcaaattgtcatattttcaatgtctgatgaaagacaaaatactagtaatgaatcatcatcatcaaatgtacaaaataaaggaaatactttgggtagtagtattacaactgtatcaggatctatttctgtgtctggatcaggatcaggatcaagttcaagattagaagttttgggaataggaatgggtcaaatgaataactttcccgaaaacccttcaattgaaggaggagttgatggaaataaagtccaaactccaaatagaagaggttcttcaagcttaaatgaatatgatagttctccatctttaactcattatgtagacgaaacacatggaggtacattttcgtcatatattgttggaaatggacgacagggtggcttgacatcttcaaaaagcgtgagatttgaagattcaaaaggaataagtactagttcaagttcattgggaaagaattcttcactcatctcagtttcttctgaattaactaatgaatcaagtttttgtagtattagaaatgatagtaataatacaacatcagtatcggtacctagtactatgaataataatcaaacaaatagtattataagatatatgagaagatggaattacttgagtttggtgatgctaccaccaaataattcgactaataaagaaagtaaaggagaagtgagaggaaatggagaatccaattttttaagctttgtatttaagttacctttttatttaaagatggatattaatttgacgcctgtaactattgtacttaacgaacagcttcttgataatattcgtggtgagattttgaaattaattcaggtatgtctattgactatttggagtcagtataaaggacttggagcatttccagttactgatggatttagagaattattagtacaagaaggtagtactagtggtagtggtaatggattagtagaagagagttctcgagaagagaataactttgaattacttctttgccatccttttaacttatcattaaacaaatataatgctattaataagttaaataaaatagaatggaataagattaattcattattaaataaagtacatgtaaggatttcaattaggttgccttcagtggagttatttatgttaaatgaatcaatcgaatatttccgtcaaatggatgatgatttattcattgaaagaaattctgataaaagatttgaaaatgtatcatttgatttatcaacatcttttaaactttctgttgaatctcaaactattttgattgggacaattattgataaattacgtgggaatattaatagattatactttagaggctttcaaatgaaattcgatactcaacaaaatataactagtataataaggttatatttgagattcaagaatttaatttcggatagatatggtaatattattgctattatgaacttattcaaggattacaaatttgataatatctctagacactctttaacaagttttactgacgagatcttgaggcttcaatgcgaaaaattacctgatactaacaatatcttgcttaaagaatttactttaagcttggatgaaaagtcaggtactaaagttgaaatagatgagaagaagtcagtggaagtggaaaaagtgggagtggaagcagaaagggaggtggaaacagagagagagttggaaacggaaagggaggtggaaacagaaagggaggtggagacagaaaagacaatgaaaacagaaaaagaaatggatgtggaaaaggaaatggatatgaaaaaaggaatagatgtgagaaagaaggtggaactggatagagtagtggaggcagaggaaaagagaatggaaacggaggaaaaaggaatggaatcgaagaaaaaagggtctatagattctttatccaaacttccaagacaagaatattctcaacatactgtcctaattcaacctacagagcctgtttctgctccagttataacatcgtatccatctccaacagtatctccttgtatttcttcaacaatttctccaactcctattccatctacatttgtatctccagcattttctgtatattccgctcaaaatcattctcaatatccccttccaacacatattcatgcttctgatgttactaattccgttttgtccgaagccataactagagcaatcccagtaacaacaccacaagaacaggtaattaatactgtggataacacacaaacatattctgctagagaggttagaacagaagacaatgaaattcgccattcttctcagtataatagtgctaatatgaagccaataaacttacatgaaaaccaaataggaacagaaattaacaatacaaatggaaattttgaaactagaagaaagtctagcaaccttatattaatcagagacattgagactcagagccttaaagataagaatgataaccacaatctcactatagagagacaaggaataaaagaagaaaaaagaaactcaaatgactatcatcacctccgtctccatcatcatattccaactaaaaaccaagcaagtctagttcctcatattggtaaagtatgcgaagaaaaagaatctgaaatttctaacaaggaacttatacaaagaaataacaaacatgaatatattgaaacacaatcttcacctcatcaaaacattaagaaaatacaaaaaaagaagcctccaatatctcttaggtctggcttcaattttaataattaa

SEQ ID NO: 3513 - DNA, 141 bp, Cryptosporidium hominis
atgttaaaggctgataaggaagagttaagaactgcctttaataaaatggatagatatggaaatggtaaagttttggttagtgatttaaaacatattttgtgtaatattggagagaaattgacggtaagttacataaattaa

SEQ ID NO: 3514 - DNA, 228 bp, Cryptosporidium hominis
atggataaaagaaaatattatagtgaaaatagttacttatgttttcataattttttttctttcccatatacaatttctttatccaattccttccattataaacttacattttcaaaaattcctcttctgttaaaaatgttaacctatttgcatcaggaatatctgaaatactcaagagttcttggaaaccatcctcctaaaataaagaattcaattcaaaatatttaa

SEQ ID NO: 3515 - DNA, 2142 bp, Cryptosporidium hominis
atggaatttattttatacggtttttcgaatgaagaatctgtattaaaaagtaagccaccagttcctttgtatggttcatcaagtatggatttagtaatgaaagctgctaatatggatcaaccattggagcatgcattattaagtatttctacaaaatttagtgaggaaaataatcaaaataatgaagaagtgaatcatattcagaaaggattaattaatcagattgatagtataaatcaggttcaagtagaagttgttaacaaattaatctctctaacagaaaggatgtgtaaatgtttgtataacaagggtaaaagaaactctaaattagaaggtggacattttaacggaagcttttatcaagtggatattaaaaagttatggaaactaaatggtacagtttacagtagggatctgctactagaatatttttcaaatatcctccaaattacagaaaagttattcggttttaaaggtgttaaagttattcaattcttagattctactgataagttatttgaattttataccagagaattaaaaaataaggaacggaatatagtttgtttgtcccaactatacttaattcagcatatttttgatacaaacttaacaagtgaatacgaggtaaaagattctttaactaaaaataaagatcctcaagcaaatttagtatttaatattttttctatagtacttcaaattgataagagaattcaagataatcttgaagatttggatgaagtaaatgaccaaattctgcaaaaagcagatagcaaaattaagctattaattaacaataaggtcggagctcagctaatattccaatggattaaaaatcctaatattggcgatcaagaaatttatggaattaagactaacattttaataagatggataattcacatttctaaacaattattacatccaattatgaatgaaaatgagattagcagcagattaaagtatttaaccaaagaaaggattaaagcttccttgctactagatgattctgcttcaaacgatacaatttctattgtaatttctctcttaacattttgttatggttattttccagatcaagttattctattcattttaaaaaatattaatcgagaagaaattcagaatcttgaatatccaggaatatgtaatgtttctgaagatattgctcaaaagattaataattatggaaaatcatctgcttttggaaatctttccaatacaagaaatatcccaactagagtacttctttattattcatccatacttttggataataccagtagaaatggtaaaaagaatatcgatttatttcaagattattcctttcaaaaagacaaaattgttgctaagattatttccatattagttagttcaaatttaagacgtagagaatggctactttggcattcaaaaaatcttgacaaaattgaacttttttcaaattcattacataatcttattcaagcaagaggagaaataggaagctatcaagaacaaaaaaaaattgaagagcaaatctttaaatggatctatgatcgaaatatcgattattcaagatatcaggtcagttctagacctttttcaatatcttctttttactctggattttttgatttctcaatttcccctattttagagaaatctatattgcaaaatgtatcatttattaagtttcagatcaaacaattactaaatcttagctctataaaactcagcacttgtaccgaatatgaacttgaggatttcattcaaaagctaagtatgaatttgaatttgttcatcttttcaattcaaagttatatcgatagaaacgatcaacttgattttgctgatatacttactattgaagaagttactttacctttaaaactatttttaaatattaatagtgatgaatttgatttcagatttaaggcaattattggccatttaactttaaaattcatttcagttttctttaagccaggctggagagagtcaaactttcaagaattaaataaatcgaattcgtcctcacaagtatttggaattaaaacttttacaagtcttgatagctttggaaaaagttcaaacagaaaaacttcaagtttattatttattctagtaaatctaatggatgaattaacaaagtggtaa

SEQ ID NO: 3516 - DNA, 1170 bp, Cryptosporidium hominis
atgaatgaaattttcaatatgaacaactttgacaagttttatgtatctgcttatttagaaacgttttcaagtttggttttggaattaggaattagagataacatcctttctcaaagtgtggatatcggatcaggaggtgaaaagggagaaatatttaaactcaagataaggcaatcactaatcaatttagttcaaagtgactctactgtttctttaatagagaagatattaaactatatcattatttgcagaagaaaaggtaacaatttggatgcagacaaatcaagttgtttaatgggtatcttcatattactactttccatgttattaagtaaaatcaatttattcagaactaatggaaggttggagagtcttattgattctattttagctcatccaacattgttatttcatgccgaaaaaagttcgaaatgtggattaaatgctcgcttttcgtctgatgaatatgataattcgtttatagataacaatacaacgagtatcaatctatgtaactattgtcttaattttggcttcaatcataaaatagaagatattaaattaataacaaatgtttccattattgtggcattgctacgcctaaatcatgtaaatagtagagcaatatcaaaaagtaacttaattaaagatatttttctacaaagcatttcagggattttaaatacaaataataaagcatcatcagtaagtcatggatatatgggaattatattatcgtcaatatatttatcatatgaccaaattcagtctttgagccttgtacataatttgtatattcaaaaattccttgtaaaagagtttgtttgtgatgttttaaactttgacaagaatccagttgaaaatttaaatctttctccatgtatgatatttcattattctgtattattttcatatttggtttttatattgaagactactccttggtggcttaatatttctgatttggtcaatctaacattcataaataaacttggaaagatttataaatcattacaagcttcggcaattatttataatgatgagaatgacaatatcggagaatatttaattaccttgacagagattcttttaaaaattgtacaagaaacaataatggctcgttctaactcatcttctagttatattcaaggtaagttaatttctgaataa

SEQ ID NO: 3517 - DNA, 363 bp, Cryptosporidium hominis
atgttagaaactgggtcagtattatcatacaatagttctccttttcagtttgaaaaaaacttaatgggtatccgaagagattcgtctaattctgaattacaaagaattgtgagatctggcagacttagtggatcaatagtaagtaatggctacgataaacaatacagaacaaattctattgcaaccagtattagtgatatattttgtatggaggaaattaaatcatctaattggagcaaaagcggaatcactacaagtagtggaacttataatttgaagacttatactgttcagaaatttattgcaactagaatgaaagaaattagagaaattagaaagattaatgaagaaatggctacttaa

SEQ ID NO: 3518 - DNA, 1782 bp, Cryptosporidium hominis
atgttagagattagcgcaacttgtttaactccatataaccctttaaaggcatcgggccatgttgatagatttactgattcaatgataacagatataaaaactaatgaatattatagagctgataaagttttagaagagtatgttgaaaatagattaaaggaaaaatcttcaaatcccccaaagtcagaggaagagaagaatgaattagaaactttgggaattaaggcaggttcaatgagtattgatgagataaaagaaagtttaaataagtaccaaattaagccaccaagtggtggagaatggtcagaaccatatccattcaatttaatgttcagaacaaaaattggccctaaagaggttgaaggaaagaatgatagtgttggttttatgagacctgaaaccgcacaaggaatttttgtgaattttaaaagattatatgaatataatggaaaaaaattaccattttcagtagctcaaattggtttgggatttagaaatgaaattgctcctagaaatgggcttttaagagttagagaattccagatggcagaaattgaacattttatacatcctgatagaaaggatcatcctaaatttgatgatgttgcctttaaatgtcttccattatattcaagtaagactcaacttaataatggtgaaattgagagaaatattacattaaaagaagcagtacatggtgaagaaaagattattaataatgaaactttagcttatttcttatccagaacttatgattttcttatttctattggtattaatccagatggaataagatttagacaacatttaagtactgaaatggcacattatgcaagtgattgctgggatgctgaggtattgacatcatatggttggattgaatgtgctggtcatgctgatagatcatgttacgacttattacaacattcaaaagcaacaaaaactgatttatttgcatcagaaaagtatgatgagcctcaattcaagacagttttagtattgacattaaataaaccattaataggaaaaacatttaaacaggaagcatcattagtaacagaagcattacaagagattgcaaataaaggagatattagtttccaggaaaagctcaatcaatctaataaggctcttttaaaatataaatcatgcgaaaatggaaaagaatatcaatgggagatattatcggagatggccaaatttgaattccagacaaagaaagtaacagaagagcaatttactcctggtgttattgaaccttcatttggaattggaagaataatatattgtttattagaacatagttttaaaattagagaggatttatctgaagttcaagatcagagtactggtaataaaaataccaataattcacctgataacgaaatgcagagaagttatttatctttaccagctttaattgctccagtaaaatgttcaatactacctataagttctaatgcaatttttaatgatttgataaatcttttacataaaagttttattaatcatggtatttcatgcaaagtggatacatcatctgcttcaattggaagaagatatgcaagaactgatgaaattggtattccttttggtattactatagatttccaaagtgtaaaagatgatactgtaacattaagagagagagattcaatgaaacaagttagaatatcatcatcagaagttccatctgtaatttcaaagattattaatcaacaaattacttgggaaaatgttttagagaattatccattattcactcaacaatcaaatgaatag

SEQ ID NO: 3519 - DNA, 2085 bp, Cryptosporidium hominis
atgaagtttaattcaaagaatgaacgaacaaaagagttaaaatgtgacgaagatgtgaaaatagttatgcattcaaatgaattaggagtggagcttccaacattagaaactactgattccattgatcgacaatccaatgattcaatcagttcagctcaaattattagcttaactcctaaaagatgttccaaaggaaaagaaatatcaaatattgaatatatggcctcttttggaaaagaaaatagagatttaaatcaaggagatgttacgaataatatgtttggatcacaatcttcttctttggttaatagtgttgaaagaacaacagctccctcgtctatgatgggtagtctatctagatatgatagttataactcaaatttaagtccaaacacaaattttcaaactcctggaagagatccaaagagaagaaatatctcaaatatatcatctttgggtgaaagttttcaaaataaggaaaatgaaaaatcaaataactcaaattttttggggtccaggaaagacttagtggaatctaatggtttgacaaatatttcgggagtatcgaatagtacgattcagtctaatcagattaataattcagttcttctttcggccgttcttcaagttatagcttctattcagaaactaaagaatggagaacaagcaaatgcagttagtagaggtagaatggcaacgaatacagcaaatataaataatactaataccgtcatgagcaatggagtaattattaacaataatgctacaacacaaatccttggttcaaagctgcctggagtacacccaactacagcagctttggctctggcctattctctttcagttgcggcttctgcaaagaggaatttaggcggaacaccagtaaactctgatgacgtcattcaaggtttaaatcagataatttcagaaaaaaattctaataataatcttgcaatgaatacagaaaatactgataatctgaaaatcagtggcgagctcatacaaagtattgtttcgtccttgagttctttgatttctaattctcaaggagaatctgcaaacactattcaaaaaaaagataaagattgtttagtttctccaaataggacaaatgaatttagtgacatttccaagatatcaaaactagggggaatagattccagagcttcaggaccctcatataacttgaagctgccaccaatggattttataataaacgagaaatcattatgcaacgattttagaagagctaataacttccaaaatgtggggaataataattttaatctgaataagtcagttcttttagacgtaactaataatattagcaatgctaataattacaagtttcaatcatatttagaagcagaatcgagtttggttatggagcctagaattgaggattcttttagtcagattgagtatgttaatcaaacttctcaaatgaacagattaaatcattctaaaagtacggctagtaatactgaaaatattcaaaatgagattagtaataattctcgattattacgtgagaataattataatcctttattatccgaaatttatagatgttcagaaaagaaaattattcttgaatctagcaataattgtatatggaatgatttgttatataaccaagtatttgatcatgttgattttgaaactccatttactcgtaaacacgcttatatgagaaatgagctggtattttgtaataagccaatattggaaattgatcatggaggagactcattctcaatgccaagttatatacgtatcccaagtaataattttccaaattctaataatagaaatgcatattcaaataataataatataaatcattccaatatatataacaactccaagcctaattttactcattcatctaaatatccgcctccaaataattttgatttttataatttgcataagtacaacccaagaattcagtcattctgtgacgatcttctcgtaaacacgaataaccgaagaaattcccagatatttaattccattaactacttaatgcaaatagttggcgatggaaacatgaataataataatagtaataatggtaaataa

SEQ ID NO: 3520 - DNA, 2055 bp, Cryptosporidium hominis
atggaagttcaaactgatgaattatgtggaggtgagataattattgatggagaaacggaaattgacgatttattacttgcatccaagttcgcagaactagaaaactacaagtctgcttctattctatctgcgatagattcttcaagaggtaggaaaacacaaaatgagaagacatcagataatgttgatattatcttaacagatgatgagttgaataattctgaagatgatggctatgaatccagtgaaaatgaggataacgagattaaggagttaattagaaaggagatgatttaccgccataaagtttctgaagttcatgaatctaaaaatgaaattttgggtgagaagctatctgatgattatttatctcaatttggtattattctggataataataaatgcactaagagtactttatctgatattagtgaatgcgaaaatgagatggcagaatcagaagaagaggtgattaagaaaggaaagcatagtaacataagaaaagatggtcaattagacaactttgaagaaaaattaagttggctaccaaatattgagattttggatatgccagaaaaggtcgatcttactcttccttgtgagtttgttggagaaatttactccattattgatgatggagcaatatttggcatggagggaatcttcatagtaaaaagtgacccatccactataatgttagatttgggatcagtcttatgtttggaggataagacaatagtaggagcaattatagacacatttggtccaatttcatctccattctacgtcttatctaaacaaagtaatgtaagcaatgacttacttaaaaaaggtaccaaaatatattgtgatcgtagacattctactatattaggtaaggcaggtaaaatacaatgcagttatttatcaagtacaaaccatggaaataggaaaagtacagtatttacttcaagtacatcaaaatctcctttctctaacaaggagtttaaaaaagaccctaaaactaaagtatcaaatgttactaactctaatatgaaagatggttcttctttcaaatctgaaattgaaaatggagaagttattcctgatggatacgatgaagatgatgatgaagatgatggacaagaggagagtggtgatgatattagtgttaatttgaacgaagtttcaatcaagaagtttgtagaaaagtatgataatttgggtaatattcaagaatttgctgttgaggattcgattacaaataataacttacttaaaaagcaaaaagaacatcaaaagaagcctaataacaataaccagggtcactacattaagaacaaaaacaatagaagatcatcaaaccaaaatcttacaaactcaagtggaaaatttcaatataataaagataagaactttaatcgatttaaacaatttggaaacggaaatatttatggacaaaattccttctctaattttgacctaagcttaagaaaagataatcaccaaaatcaaataacaagacgaacttcagaaactgaattcggttataatcaaggcaatttattattccaaaactttcaaagtaactattcacaattttcatatggtgccccaaataatccatatattgcacaagatattcaacaaaataggggaaaaattccattctttaaccataataatggacatgactttaccgcctctttccattctcagacgcaagcacagcaaatgtacccaaattcaagtcaaaattcacatattcattcacaatacttttcacattcagataaattacaactacatcatacacaattaccgtatcaaaatggaaatccaaatcaaatgacagcaaactttgaaggtaatcaatattcagtaaatcatcaatataataatggaaatggaggtttaaatagtccatacatttacaacaataataataataacggcgccaattccaattttgcatgcgaaagtggcaccggtaatggaaattttatgggcataggtgtgcaaccaggttcgattcctggaagtccaaattttccgtgttatgggaataaatattaa

SEQ ID NO: 3521 - DNA, 1170 bp, Cryptosporidium hominis
atggatgaaataggaacaaataaaaactatataataatattacttggaagacggcatgtaaaagcaggattttcaaaaaaaatggaaccatttgtaattttgcagacaagtgagctcttttctaaatgtgtggatgtattagaaatatcagaaaatgataatacaaatttttctaaagaatcagattatgtgacagtttttaaagatcccataaactggaaaagaagctggagttctttgatacgtatgttgtacactgattatttgatgtcaaatcctaaggattatccagtaatactattagaaagaccattttttccaatagaactttcaaattatattaaacagattctattagagaactatcaggttcctggtgttaagaaaattagtgagccaatagtaagtcttttcacaacaggattcaaaacaggaatagtggttgatataggaacaaatgagacaatagtttgtcctatttatgatggatatccaattgaatataatgttaaaataattaattgtggatatgatgactttaagaagaaatttatgaatgaattattttctcaatataaagagaaaccagaagaagacataattaaagaaataagtaacgatttaatggatgatattatttttcagagcggaatagtaaatcacgaatttaacaataatattgaaagtaatcccaatattacagattttacatatgagaatttaataattaaagataaatacattaatttagttgttgataaaaataccagaaccaaaccatttgagattttctttggagataaggcattccccaattcagaagtcattcatcatattgttttagatggaatcatccaagttttattaaattctaatattgaaacaagaaaagagctttctcaaaatatattaatttgtggagggcttgcatccgtaccaggttttgaaagaagagtctcttctgaacttggagaactaatttcaaatgaaaaaatactaaaacctttagcagatcatttcttcgttacttgtccccccatttctccttttatcagatcatactatggtacagctcttatgttgcaacatgaaaaaattaattataattttgaaaacactaatttacaaagaatttcctctaaaattaactcaaaattagaaattgcataa

SEQ ID NO: 3522 - DNA, 1992 bp, Cryptosporidium hominis
atgagtttacttaatcattgtaagaggaggatcatagaggagatcatttcaccggtgcgtgcaatctctgcttctggaagtgatggatatttaactatggtagttgatcaatttacacttaaagtaatttcctcatgttgttcattctatgatattattgaggcaggagttaccattgtcgagcagttacactcaaaaaggcagccattaagaaaaatggattgtatttactttgtaacaaatgagaagagaaatcttgaacgtattcagaaggattttgaaggtgaagggatgtataggtcagctcatttgttcgttactggttttaggggagaaagaatggcaggttttgatatactttctaatcacgaaggtcttttgaggaagttattagcttttaaagaagtcaatttagactttattccatatgatagcagagctttttacattgatattgacggtttatttacaactagtcttgatctttctgaaaagcttcaacaacaaattatgtctggaattaatacattatgtaagactcttggagttaataccaagccagtaataaggtatcaagcgtcaggaagagtagaagtgtcaacagaatgtaagaatttggctgaaaagctcaattacttgcagaatggaggagccgaaagcaatgaagaatgcacaatattattattagatagaagttttgatactgctccattatatatacatgattatcattatcaagcattagcttatgatttattgaaaattccagtatctattagtaatcctgatcattataacattttatcaaatactagacttgataacactgacttgaagaataaggacgaaaaccaaaagatggatgatgtatatgagtacgaagtctctagtacaggaggaaaaaaggaagtaaagaaggcagtgcttgatgaaagggattcaaaatgggtattatataggcacgaacatattggaaatgtaaaccaagcaattacggatgaaactttaaagtttactcataataatgttactgcaaagatccatagaggggaaaataaagggtcaaatttttcaacaagtgagacaatacaagcagttagaactcttcctcaatatcaacaaactctttcccgatactggacacatattagtttgatcggagaatgttttaatattttaaagaagaatgatattacatcaataggagaaattgagcaatgcattacaacaatgttagattctgatgggaaatccttaactgcaaataagcaaagaagtaatctgcttactgtgttggatcaatctgcattgggaaaatcggaaggagaatttccaataattaatgacaataatgacaaacttagattgatcttactatatatctcacattatataggaataaataatgatgatttgaatcaattaattgaacatggaaggctctcgaataacgatcaaattgtacttaaaaaacttcttggacttggtttgtgtaactcatttgatgatattgcagctggaaatggaaaacatattcacaaatacgagcttaataataaagaaagagttaaatactataaacaaagattgagaaatatagaaatcaatctttccagatttgaacctttaataaagacaataatctatcaccttctttgccaacttaatattggaaacaactcattaatttcttataatagttttaatcaaaatagttttaacgaagaatttccttgcgtcgataaatataatgctaatgaaggttcacattacttgcttggaaacttgaaccaaatacaatctcattcttctattcctaggtattctttaaaaaacaaacttgtgattgtatttgtgatagggtctattacatttcccgaaattagatgcgtttacgaacttatgaatgaatccaattcaaatatttatattggaggaattaatattactactcctactcaacttataaggcaagttctacactcaaagtaa

SEQ ID NO: 3523 - DNA, 192 bp, Cryptosporidium hominis
atggtcatggcgggcaatttgttgccgcccaaaatttataagcaaggtctagagatcttatttgacattcaatgtgtaaaattggatgaaataaggagaaaaaaaggaaatagtaggagagaaaaaaataaggaaatattaattgagcaaattctagtattatcaaataaaaaggttaagagagagatataa

SEQ ID NO: 3524 - DNA, 1098 bp, Cryptosporidium hominis
atggggagaaaaagtagtgatggatctggaatgggagcggatattctgcatgcattggggtttaataggacctcaaactcagatgattctgatactgcagataataaaagcaagggtcagacaaaattaggtagatttaaattttctaagaataaaaaaaaatcaaaaaaacataatattgagatggattctgctaaatttagcacagaaattgatttaaaggcaaataaggacaataatgagacagagcaaggaagtgaaaaacctataaattcaagtttaatggatgttcaattatctttcgaaggagtccttactgagctagaaaaatctttggaaaatattaaaaagaatgttgatcatgcagaatcttgtttggagaatatttatatatctgtagataagctggagaagttttctgaactttgtaaagtggaaaataaagatgttatattaggtttacataaactagtaaatgtacacaaaggagcagcattactttcaacattttctagtgaccctacatttaaaaagaattgcgattataacgtaagtgatgaatcaaaatctgctgaaaaaaggcttgaaagcaaaagatctggtgatactaatgtagtggaatctgagcatgaatcaaatgttgcaaaagtaatagaaactcataattcaaataactcagaaactaaaccagcttttgttaaatcaaattctaagacttataatgtaaagaatagtctatcaaataatgtttctaataacacagaaatgactatatctagtaaaagtaataataattttaattctgaatcgcctagtactaaaagcactatgaaaagtgaaccaattaataaagaattggaaataacaaaagatgttaatgcttcatattctgacaaaaataatagtgaaaagtcacccaaagaaggcaaaattagtaaaactgaaaaatttaaagagaagcttaacctcaaaattaggaaaaaaaaagacagtacacatgagtccaacgatccagattcagctgatgcagaaaatagttctggtattcaaaccagaatggaaaggtttaagaaaaagtttgaccgaaaaagtaaataa

SEQ ID NO: 3525 - DNA, 2229 bp, Cryptosporidium hominis
  misc_feature (1188)..(1188): n is a, c, g, or t
atgcttacgttattggaatttgattcttgtataatgatatcttatccaaattcttttcataatattcaacttagttatttaatttcaccagataacaatattccaaaagaaattagtttaggtgaagattcaaatccaaaaactatcaagagaaattttgattcaatttgggaaaattgtcagagttcaaatttggttgagatcacgagacgaatcttaattagaagctacactgatagagtcaaaaatataaatttgagagaaatagtctcaaaagaaaagtttggatgtatcattggtattcaattcgcttcaaaaattacaagatctattgataaaggtccttttgttgatacttttgaggcaaaattatttaaagaattttggggtaatgataaaattgagacaagaagatttagagacggtaccgtattggaaacattaatttggaataatgaaattgattcaaataatgaatttattacaaataaagggattaatgaagatattttgagatatacattaagtagacatctcccacaagttaaattaaattcagaatcaataactggtactaaagataataataataataatataacttattctatgacaccttttggatctattaatccttatttaagccgagaaaaaaatgtacatgaagaattttccaattttaaatctattattactggattaacttctcttcctttaagtattaaatcaattcaatcatccaattcaattttgagatttatgaaattttataccaacttaaattctgatctaaatgaaggagaagaaatacaatgtgtaatagaaatggaacaatccaataaatggccaaaaacaaaagaatctattgaaaagattaaaatcgcatttttattatcaatacaaaaagaattaggagaattacattctatttcttctgatattataccagaatataattatttagaaggtaccgataaccctgacttaaaaggttttgctccatttttagatgtatattggaaaggagatatcacttttagaattagtatatttcatccaacagaattagaacaaattgcaaaaattactattgaacctgaaaatatgtcagaaaaagttattgaagaaaatattaaatttccacaggaaaatctttcccaattacgtaatttgtggtggaaaacacanactggagcaaaattactcaatctaagtaattatttcccttctttaagacaaactattaagaaattaaaacaatttgcctcagttaataagatcccagattctcaagaattcttagaacatgttgctgcttatgtatatacaaataatgatctaatgaattctatatataaggtacccggtacttctactactggatttttaagatctttatggctaatttcaagatttgattgggaaaagaaaccattaatagtagattttgattttcaaattaatgaagattctgaaattaaaagaatttctactccagaatttcaaaagcttgatcagattcattcaattcagtataattacattaagaagcataaattaccaaagaattttttttatgtatcatcacaatatgatccacaatctttgttgattaaactaccaagtttctataattctactagattggttcatttttcaaaattatatattaatattattgtttatcagaattcattcaatctaccaattaaagagattaaatcatcattcttaactcagcctaaaaacgacattgttatttgtcttcaacaagattatatgagtcttattaatcctcaatcaaaaaagtttaaatcttcaaatgtactagcacttaaaaaacaatatgttaatttgaattctactcaagagttattaagtaactgtaatatcaaagcttcaccttataatgttgctagagagatttttgagagttttatattggaaattaaatcactttggaatcatcaagttgatataatttatgattcttatgtacttccttatccagaaaagatttatcttaaagtaagaacaagtcaattctttccttcaaaaattactgaaagccaaaataaaaaaagaaagaattatcttcctggttgtattatttcctattctaataattccactggaaattacaatattttcacaatacctaatttacctcttattttaagtacaatttggagtagatattccggttttatcactgacatacagatatag

SEQ ID NO: 3526 - DNA, 660 bp, Cryptosporidium hominis
atgaatgggtttagattgtgtggtgatatgctccaccttttgagcatttttctccttttaaaaaagttaagaaagagtaagagttgtttgggtatttcatgtaagatgcaggaaatctatttgatagtattttgtagtagatatattgatttattatggagttttgtatcagtatataatactttaatgaaagttgtatttattgcaagtactagttattgtatatatttaatgagatatcaaattccaatcagtagaacttacgattcaaatgcagatagttttccatatcataaatatttattattaccagccctatttttgggttttattacttctgaaaaatggatagtttctgagatattatggagtttttcaatctggcttgaatctgttgcaattttgccccaattagtacttttacaacaattaagagaagtagaaaatttaacatcaaattatgttgtaactatgggactttatagattattttatatttttaactggatttaccgtttctatgctcaacattatgtaaactgggttggctggattggaggacttattcaaacagcaatttatgtggatttcttttactattatgcaatgagtaaatggtatggccagaaattgatacttccttattctattgagatttag

SEQ ID NO: 3527 - DNA, 606 bp, Cryptosporidium hominis
atgattctagaaatcatctcagtatcttcatctgaatttaaagcatcattatatattgaatatggtcaacttaaagttggtcaatcttatcatgtactccctttcagtgaatctgttaaatgtaaagctatttctattcatgatcatacatacaatacatgtaatggacccatttatatctcttctgcaacatttaattgcactattcatcctagcattggtaatattattgtatcagctatttcttctaaaaataatacaagacgtaatagtaacacgcctattatatctctactttcaagtttatatccaatacaaatttccacaaaacttaaagtaaaatgtcttaaattcttgaatgaaattcttttaagttccaaaaatatattttggaatgttcctggtcaatcttttatgatttattaccattgtgaagcttctcccgccattctacttagtgtcagggataacaaaaaatattttgaaactgaaaaagaaattgtttcatataataaatgttcatgtaatgataatactaatctaagtaaagtctcagttcgattttttggaatcaccgttcttattggagaaatgatctttcattaa

SEQ ID NO: 3528 - DNA, 570 bp, Cryptosporidium hominis
atgaatgctatatttgaatcaaataatagtcaacataaatcaacattaaatatgatcaaggaaaatagaagaagaattctgatatataatcttagaaaagttctagggagtggtattggtcttaaacatgataaacaaccagtattttatattagaatagttgatctacatttgaaaacaactttatcatttggatcaatcagtgaacttagacaattgattgtttgggaattagaaaaagtaatatattcattttcagaaatatcaatgaaagaaaagaattttatatctcatatttcattagttttagattttagtgaaatggggatttatacttgtaaagtggaatttcaatcttttatgagattaatttcagaaattctagatttttattctcctttattaattaatacaataataattcacaaatcaaaatctttaaaggagaatttatggtattctattgaaaaaaatatttcattattatatgatagagaaattattacaatttttactgatacagaagaagaactttggaaacttttaaaacctatgaataatgctattctt

SEQ ID NO: 3529 - DNA, 777 bp, Cryptosporidium hominis
atgagacaactagaacaggctaaaaagatgtatccaaatactcatttaatagtaggtgtagcaagtgatgaagaaacacacagattaaaaggaagaacggtacaaaccttacaagaaagaacagaaacattaagacatgtaaaatgggtggatgagatcatatctccatgtccatgggtaattgatgagaaatttgttgaaaagcataagatagattttgttgcacatgacgatgttccatatgttgcaaagcagaaaaaaagagatgaagaagattcatcaaatacagattgtaatagcagtgaagaaaagccagtaatttcgtacgaccaagatgatatttacggatggcttaaacgctgtggtaaatttaaagctactcaaagaacaaaaggtgtttctacaacagatttagtcgtaagaattcttcagaattatgaggaatatattgatcgatctttacagagaggtgtgactccagatgaattgaatattggttatatgaaggcaaatcaaatccaaatgaagaaaggtattcaaagatggggtgagaaagttactaatgaattaacaaaagtgactctcactgacaggccactaggtattacattcgacgagagtgttgataatattagaaatcaaattcacaaatcttttgatgcttggagaggagtttccaaaaagtatcttgaaggctttgccagaacatttgacccaatgagatcgttattcagagaaaatcgtatttccgagggtgaatctccttccttcaagtaa

SEQ ID NO: 3530 - DNA, 1524 bp, Cryptosporidium hominis
atgaagagtttacttagtgcaataattttttttttggtatttgcaatttcagctttaaatgtaaattctcaagaattgattttaacaactgaatcagcagtttcaacagatcaatccacatttgggaattcttcctatgtaagcccaccaaaaaattcaacaaaagcatcgagaaatgacacttcttcatcagattcaagtgatacagatgatgaaaaaaacccacttaagaatttcctagaaaagatcaagaaaaaaagaaatcttgggcttacaaatgaggagatggacaagttcagcgaaagagaagagattgatattgcacagaaagagtcatccgaagcatcaaaggactctaatgccaccacaactactgttaaaggaaagaagggagaatacaataatggctacaaccatcatcatcatcatcatcatcatcatcatcatcatggatataagccacataaaactactaccactactactacttccacaacaactacaacaactactaccactaccactactactactaccactaccactaccactaccactaccacaacaactactactactaccaccacaacaacaactactaccaccacaactactactactaccaccacaacaacaacaacaactactactactactactactacagaagctccaagtttaaaaatcaattctttaagacgtttaagaggtctttctgaagataattcacaagatgttgaagaagtgaatccccaggaagaagcaagtagattaagcaaattaacaaatatgactacgaatcaggcaagtttagtagatacattcaacaatacaatgagtattgatattttaaataacacaaaaagcattgtaaatcaaacattaaactcaattgaacagataaaaaatgctacaacttcaaatttaccattaaactcaaccattttagaccaaatcaaagaaactagatctgttgcagttaaccaaacaacaacaactattgagaataatttaaacaacttgacaaatgttgatctagattcaaaagttgctattttaatggctccaatcaatgaaactttatctattcttcaagaaacaactaatttaacaggactgaccaacttaacaaatacattgaagggaacaaattttactggtgtagttgaagattctattttgaagaacaatttaacacaacaatttccatttaatggatctttactattaaatggtaaggtagcaaacattacaacatttgatattcttccagttggtcagaacaatctagaaattgatcttaacaatactaactctggaagttgtccgaatggagtttgtgaaagtgatcaagaagttgatgatgaatttacatttgattctgatggacacattatgtacaaacaaagtgcagttgagaaaaatactgataaagatggatcagccttttcagtttcttcatcaatctataactttgtattcatattctcaataatcatttcaacaatttatttactacaataa

SEQ ID NO: 3531 - DNA, 834 bp, Cryptosporidium hominis
atgttttcccacgagaagagttcaatgttaactacaattttaatagttgttgcaacttcagttggagttggatgtttttatattccagcagcatttaagaattgtggtgcaatggcaggattgataatttcattaatagttggtacattttcagtattatcaatgaagactttggcaaatgcaagtgtgaaatcaggtgcagaatcatatggatcattattatttatggcatatagtgaagagataacaacaagtttaagaattcaaaaatcagaaaatccatttttttctataccaagattatttgattttctggtatttttagattgtttattttgtataccattatttttaattgttttatcagacttaataccagcgctaatttcatattttgggtttgtgaatgactatttattcatgtttagttcaaaaactgcaataatatcattattttcactattattctttccaatatgtattccttcaggatgttttaattgggttggacttacatttttatcagtcatttccattttcctatgttttgcatcagtaattagccaatcaatttcatcaggttttggtattaataatattattaaagagatttcaaatatatctttcaacagtaactcaatttcaagttacttttcattattgaatatttgtatttttgcattctttgcacaattcaatataattcaagcagcatctaatcttaataatccaagtaaaagtagattacgtatattaacagctgtaactggtattataatagtatttacatattcaataatgtcattgatatcattttcatttcttggagataga

SEQ ID NO: 3532 - DNA, 2481 bp, Cryptosporidium hominis
atggcacttagaatgcaatcaggagttaatagcttcaaaaccctttcaagtaaaatactcaaggaaaactatactgatctaagaataggtactagattaaatgaaggaccaggattaacatgttcatccaaatttatagcttttgcaaacgatggaggaggagggtctgcaagcattatatcaatggattcaataggtattagaaaacctccaataatgatggtttctggtcactcagcaggaatcactgatatgaaattctctccattttataataactttctggcaaccagttctgatgatagaagtatcaaaacatggaaattaccaaataatggagaattctttgatgttttagaaagtgatatgaatgattctcaaaatataaaaagaggagaatttattgaaaaaatagtttcacctatagcaagtctacatggccatgaaaagagagtaactttgattgagtttaatagaaatgctaataatatcttatcttcaacatctagcgatggagaaatagctatttgggatcttgaaagatctttaaaaatcttctcttatcaagaaaacaagaatctttgttatgatattaaatggaactattttggtaatatcttagctactaccaataaagacagattagttagaattgtagatcctagagaacaaacgacagcattaaatttcttagcacatgaaggtacccgtattggtaaatgtacttggatgggtggctttggtactatacaaaataaacttgtaaccacaggatttactaaagcaggatctagatcagtaaaactttgggatatacgtaatatagaatcaccaattattgatgtacaattagatataatgtcaagtactttatatccaaattttgatgataactttaaattattaactgtttttggtaaaggtgatggaaatttcagagtctttaaatttgataatgaagaagattctttaactttaatggaagaagttagaacaactaaaccacaaagaggagtctgctttttaccaacaagatgtttagatgtatcaaaatccgaagtaattcgcttatttaaagctgttaataccgattctattgatgttgttagtatttgtttacctagaaaacaacattcatactctgaagatttattccctgattgttttgcaggtataccatcatgtacttctgatgattggagaaaaggagtttcaaatccaccagttcttgtttcaatgaatccagaatctgagaaaaagccatatctaccaaaagatgaagatgatctagcaaaacaactttctatcaggttaaaatctatgcaaagaagtgaatcaggatcttctattaatttaagcagaattaattcactaaataaacaattttcaataaattccagtagatcttttaattatcttaatgagctcccacatattcttgaagaaagtgaagatcaattgaatgatgttaattctttaagtagaagatcctcatcacttagaaaaggatcaaaatcatcaggtttcttttcaaaattagggtcaatgttatcatttggtaaaaagagttctagtaacgttaagattacatctaaaaagagttttgaattaccaaaagaagagcttttaattgaagatgatatattcaataccccttcagaaaagaattcaattcaaggatcaacaaaatctagttattacaatccagtgactgattttggttcactttttaattcaccttgtaaagttgcaccaaatccaaaagactgtaatttatttgaaaagaaagaacttgaatatagtgatatacttgactatagagcagaatattcaggaaatacatcagttgttgatcttccagcatgccatttcagtcttgaaaaaccagaaataccatgtaatctttcatctttaaacagtccaaaatgtaatacagattttaattccttaagtaataaaggatttgttaaaagaatggtagaaacaatcaattcagcaaattgtaatcctgcaacttctcagcttgaaagttgtggatttaatagagccaaactctgtaaacaaagtctttctcatagaagtccaagtaatgcatctttagatactctttcaattatttcaaaaagttcaacttgttcagattttgaatcaatttcatcaaatattattaccagtatcagaagagatctagaagatgctaacaagaggatttcacaactagatcaagctataaaatctaattatattccttctaagcataaagctattaaagaaaaacaagatattgataataaatctgcagaactcactcaacttagagacgaactttcaagattaagttcagaatattatgaccttaatactgcttatagacaacaatccgctttatttggcctttacaaagaattctatggagaacttgaagatattttagctgaatcattcaatggtatgaagaaagttgcagctgagaaactctaa

SEQ ID NO: 3533 - DNA, 390 bp, Cryptosporidium hominis; identical to SEQ ID NO: 3333

SEQ ID NO: 3534 - DNA, 867 bp, Cryptosporidium hominis
atggaaaataaaaaagaagaaaaacaaaataaaaagaaaaaaaataatttccttacagattttgttgtaggtggaatttctgccacaattagtaagacagctgttgcaccaatagaaagagttaaacttcttctacaaactcaagatacaaatccagatattattaagggtttaattcctagatatgctggaatatttgattgtttaagaagagtatcaaaagaacagggaatattaagtttatggagaggaaatacaactaatgtaataagatattttccaacacaagcatttggatttgcatttaaagatatgataagagatatgatgccacgttataataaagaatcagatttctggaaattttttggtgttaatatgttatcaggtggtttggctggtgctgcatcttctggaatagtttatccattagattttgcaagaacaagattagctactgatattggaaagaatggaagtaaagaatttaagggaatgtttgattgcatcatgaagatttcaagacaaagtggtattagatctttatatcaaggattttttgtatcaatacaaggaatttttgtatatagagcagcttattttggattatatgatacaacaaaagaaatgttttttaagaatcagaaacaagaaaatatgctttataaatggataattgcacaaactgttacaactagtgctggtataatatgttatccatttgataccattcgtagaagaatgatgatgatggctggtaagaaagggaaagatgttttatatactggagcatatgattgtttaaaaagattattagaaaagaaggagttggagcattatttaaaggttcattatcaaatgtactaa

SEQ ID NO: 3535 - DNA, 630 bp, Cryptosporidium hominis
atgacaatagtaacaacaaaaccaccagtgaaaacagtcaaaactacaaaatctgtatcaatgaaaaacatgcagaaccaacaacagtatttacatgcacaaaaattaatgaataagaggttattaatatcaaaaaacacatatttagataaaaattatgataaaggagtttcaaatattactaaagttatgaatcattgtattgcaccaaatgttacatataaatatgatcaaagatggtatattactgaacaaaacaaaatgggtccatttggatggtttgacggtaagtacaccattccaggctggagaacaatgcaaatggcttatgaatcatttgattttgataattttgattctaaaagattaagtaatggaacatatttactaactttagactattttataccacttattgaaactctcaatgaaattttaccactaattgcacaaagaattgtattttctaatattattaattcaaataatacaggaattagtaattctaataatcaaacaataatttctgaaaatatacaagaagctccaacgacatggaatagtcatcgtcaaaatgcatatttaaaatatagagctaattatgcacctattacagcacaagaaatataa

SEQ ID NO: 3536 - DNA, 819 bp, Cryptosporidium hominis
atgaagcaagatcagagtgaagaaaaaggtttagttttgtttattggaaaattaatagcggatacttggttaaaatcaaaagtattagatgaagcttataagaatggttttactgtagcagcagtatcaccaccaggttatggaaaatctggaaaattaactaattcgaaaattggaaataattctgaaacaatttcaagttcatcatttttatattggcttgtaaataattgtttaaagtttgaaacaagaaagattgttatagttactcatagtaatagtattactcaaaaatatgtaataccattgataatgagttacccaattgcaggaattgtcttttttaatacaaatatgggaattaaatggtttaatgctaaaaatccaataattaacgatcatctttactaccaaccaattaactttaacgatacaatagttagatatattggagataaagagcctttagttgtaagtagcaatacaatagaaaatcaatttgaaagctcaaaaagtaacaatattgacaaaatgtcgagtaacaatgaaaaaaaggttcatatttcaaatcaaataagtgtaacaaatacaaaaaggccaatatcttcaaaaaatcaatcaacgacgacgacgaagacgacgactactactactactactactactactactaccacttctactactactacttcttcttattcttctgcagatgttaccaattcagatactagtaatgaggaaacaaatactgaagattcagagagtagtgaattagaacttgaacaagaagaaatgcaacagggaagaatcaaataa

SEQ ID NO: 3537 - DNA, 630 bp, Cryptosporidium hominis
atggaactatgtgatggtccagatttagatacatttataaaaacaaatggtaatgttcctgaagaattagcaattatttggataagacaaattcttgaaggtattctttatttaaataacttggataaaaatggtgatagaataactccaaataggaatccaataattcattatgatttaaagcctggaaatattattcttcatagaggatgttgtaaaattgctgattttggacttagtaagcaatctgatcaggaatctgggaatattattattgagagaattggaggtggtactgtttggtatcagccaccagaaattctattaaggcctggagattctttagataatccaagaatagtttctcacaaagttgatatttgggcaattggttgtatattttttgagattcttcatttaagaaggccatttggtttaagaagtaattctattgctgaagcgttttcattgatacctttagaggctgaaaaaggtgcaatatttgaaaatcatgtttcttcagagtgcaaatcatatattaactggcttttgacttatgatcctgcaaataggcctaatatttttgaagctttctcacatccatttatacaaaatgtagctaatttttga

SEQ ID NO: 3538 - DNA, 1353 bp, Cryptosporidium hominis
atgaatttagaaaatagaaatgaaagtaatttagacctgagttcagatcgaattgatagaatttctgcacatgagcaagttcttgcaacaaagtatttgagtagatataaatcattttatgggagattacattccccttccaataatggaatacaacaaaaaagaggtatttttattcatcttgatgaagaaaaacagtcaataggagatcaaaattttgcgatacctttatctaataatactgaaaataggcatataatattggataatattgtaaaattgaaagaaaaacttattaagattaaggaaaatatttcagcttgtattgattatgattgtatggaaagaaataataagagtatagaagaaattatggagaaatgtaatgagattactttgatgaaagagaatctaaaggataatgagcaaaatctcacaagaaagcttgctctgattaagaatagctttaaaacatcagtaattcagcttaagaagattgaaagagagttaaatagaaatcaattattttggcaagaatctcaagtaggtcttgctcctgctgcaaatgccaatatattgaaaaaaaagaggcaaattattttaaaagaacaagaaaaaagtgataattccaatagaatatcacaagatatagtaactgaaagagcccaacattcgagtgaaaacaaagaatttgatgcaaatagctatattaaaggatcaataatcagcggaagcatggctttaagtaaaagaagtagtataaactccatgaataattcgtgttatactttgaaggagttacaaaaatctgaaattgaagaaagtcagatatcttcaagtgaaattgttcattataatacactagcctcaactaatccagataataacgatagtaataataataataataataataataataataataataataatatggctgagaataatcattatacttcacatattaatctaggatatattgatgatgaaatttatagagatgggttgaactttcagaatttaatgaatttaaagaatcgtctacaaggatacctaaatcagactccatatcaaattttgaatggaattgaaatgattgggaagaaacaggattctaatttagagaatactgcttattctatattaaataaaagacaagattatatattagattttacaaaaaaactagaattatcaggaatgaacttggatattgaaagaagtctatatgttaaaaaatctaggctatttagacatcaacaaaattcaagatacaacagtttgagtactttatctgattctcaagcatatactctattgaatatgataggaaaagggggatttgcctga

SEQ ID NO: 3539 - DNA, 2793 bp, Cryptosporidium hominis
  misc_feature (2719)..(2719): n is a, c, g, or t
atgaagagaagtaaaagctacagggacaatggtcgaaaaaagtttgagaggaagactactgaaagaaagaaaggtaggtttgagttaggtggctcttccaatattgataaaaagtttggaatcaattttcaaaaaattggagtaaatcatagggaaattggttatttatacaatgttcaagtatcatcagaattaatatctgaatctggaacagcatttgatggaatggaaattggaactttagaatcttcatcagaacttattgaatcttataaagaacgttcatgtcttaatttatattttattaataaacaaggaatgacatttaaaagcccattcttctttagaccatatttttacctagaagcacaaaaagctgttgatatccattggatactaaccaatcttgaacataaatatagagatactactatagaatttactaatataatgaaagaggatttaactcttgataatcacttaattggcgaaaaaagagaggttattaaagcttcctttgataatgttaaggaacttgtttctattagaaatgaaattcttgatcatatcaaaagaaataagcttgaaaagaaaaagaatgaaagtttaggtgcttattacgatcaggatcaacaaaacaactatgaaaataaaactcttgatgtattggattctatttcagaaatttacgaatatgatgttcaatatgaagcacgagttatgattgataactccatttctattggaatgtggtatgattctgtacgttggactcatgaacttttggaattaaaatgtttagatcatgatacttctgctcctgatttaagaagtttagcttgggatattgaaactactaaagatcctttaaagttccctaatgtagagaaagaccaaattatgatgatttcttgtatgtttgaaggtcaaggatacctaattactaatagagaaattgtttctgctgatatatatgattttgaatactctcctaaaaaggagtatgaatcattcttcaaatgtattaattatcctgatgaaaaagaacttatttggggatttattaagcttattcagactttaagacctcatattattgcttcttataatggagataattttgatttcccttttctatatgaaagagctaaaaaatatgatattgatgtttccaaagaatggggaatacgaatggaaattgatcattcctctggaggaggagggttacaatcttctaataaaactatcttttctggaactaatattattcatttagattgttttaggtgggtagaaagagattcatatcttccttgtggttctagaggtttaaaaagtgttactaaagcaaaattaagatataatcctgttgaacttgatcctgaattaatggttccttatgcaaaaacaaatcctcaaggtcttgcagaatactctgtttcagatgcagttgctacttattttctttataagacttatgttcacagatttatatttgctttagctactataattcccttatctggagaagatcttcttagaaaaggatctggtactctttgtgaacatttattaatgaaagaagcttttactaagaatattttatttccaaacaaaaaagttcaagaaactatggaattttatcaaaatagacccatcttaaatagtacttatgttggaggtactgtagaatctttatgtagtggagtatttagagctgatattcctgaaaaattttgtttaaataccgatacccttaaaaatttaattaaaatattagatactactttgaattttggtattaaagattctggtactacaattgataatattgaaaattatgaacaagtcagaaatgaaattcttgaaaaattacaaagtttattagaatctcccagaatcaaaattgagcctttaatatatcatcttgatgttgctgctatgtatcctaatattattctaactaatagattacaaccaacagcagtaatagaagagacaacttgtatgaaatgtccattcaactctgagtcaaaactttgccaaagaaggatgaattggagatggaaaggagatgtttttccaatttccaaaggagagatggagagaatgatgaatcatatccaaattgagacttttgagaatgttaagaatgaactaggagcagttaacaagaagaagaaatttgaagatcatgaaagtgattcagaaaatgatgagaagatggaatttactggagaaaatgtaaatattaataataaagaaaagattaaatggtcatctttaactcctagacaacaatcagagattttaatacaaaggatgaaagcttattgtaataagatatatagaaaacaaactgagaatattgaagagacaagatcttcaatagtttgtcaaagagaaaatcctttttatatagatacagttagacgttttagagatagaagatatgtttataaaggtaagaaaaaagaagcagaagaaaagttaaagagagctgaattattaggagatttattagcagtacaggaagcacagaatgaagagcttttatatgaatctttacaattagctcataaatgtattttaaattctttttatggctatgttatgagaaaagggagtagatggttttctatggaaatggctgctattgttacatgggtaggtggtaatgtgattagagaagcaagatctttaatggaaggtatcggtnagacctttagaattagatacggatggtatttgggcaatactccaaaaaggatttccagaggaaatcacttttag

SEQ ID NO: 3540 - DNA, 3495 bp, Cryptosporidium hominis
atgagagtttatccaaattttagtacatcaaattactcacaaaatggaaatagcttaccagtaaacgacattcctaatcaaacaaataattcatcttcaattcaaagtgcaactcaacaaccaaacatacctcagtatgtccaaaactactccgtaattaataataagtataatggtcagacaaataattacctacaaaatgctaataaccaacaactaaacaataaccatcagattcaaagtaacactaattctacatcaaatataaaccagagctacaactacaatacatataacaatcccacaaattcacaaacacaacctgttcaacaaactacatacccccctcctcctaacaataattcaagcatttcaactactggctcctcatacaatacggcctatgggagccagttcccgcccaagcatgaggcaaaaatgaataacccgcccatgcaaacaagtacaatagcggcaccacatcctggttcttccacacaattccatcagggtcagtatcagacaaatttgcagactcaacaacagcaatatcaacaacaacaacaacaacaacagcagcaacaacaacaacaacaacagcagcaacaacaacaacaacatttggctgaaaattcaacaaatcttgtaacatctttaactaaaccagtacaatctagagtggatccatcccagataccaaggccagtgtttggaaatataattgataaggattgttgtatctatgagagtgacaagtatttacttccgccaaattccttggccgaacctcactcaatgttgatagatagaggtaatgcaacaggaaagttttataagttaactttaaaccaaattccaagtcaacactcaattttgcaatctatgaaacttccatgtgcagcaattattcaaccgtttcctctcttgaatgattttgagaatccggtacctattgtaaactcctcctctactatagagccaatcaggtgtcttagatgtagagcatatgcaaatccatttacatgcgtttctcaaaatggtagtcaatgtctttgtaacttttgtgggcatacatttgatattcccatggactacttaagattactacaatcacaaatcaaaacacaaagctatcaatttccaaatgatgatcaaaataactatcctgaaatatatcatggagttgtggactactttgccccagctagtcttggcgttacaactaccccagaactaccttgctactgctttgtaattgaagcctcttctatggcattacaaggaaatgttacaaatcttatcctttattgtcttaaacatatttttactcaactggcccaaagttcaccagaatctaatgttactcttatactttattcaagagaaatccttttattcccataccagaatttaaatgaaaactctaaacctccaatcaaaatatgcgtagtatcagacataatggagccattcctaccttgtcctttatctgagctttgcgtcccagttgcacaaggattggaattcctccatgagctcattgatcgtattccatctctcatagcccctcactcaactccacataatgcatacttttcagcagtttctcttgctactcaaatttttaaaacaagaaattcaaccggttctatcttttcctttgtcaattcagtaccaaatattggatttgctgccattaacacaaaggaaaccaatgtggctcccaagtccccacctcgtaaaacttctaaagggatgaaaccatcattaggatttgtttctggatatttggtacataatattcaacagctagatacaatggttcaagcttgcagagaaagcaatgtctctcttgacacatttattgtaacaaaaattattcaaagagattattcaacaggagaacaaggtcaaggtcttactagtccgaatgcaaatgcggggtcagcttttggcgccaactctgtacctacaagtacatttgcatatttatctcaacatactggtggtaaattacgtttatttacagaatttccttttgagaaaatttacagagatatttatcaaactttatatagtatattttttgtacaaaatgtggcctatgattgtacatttaaactacgttgttctagaggaattgcagtttctaagatttatgcaccttggactgctggcggtccgacgcctgacctttcagcctttcaaattcccaaattggatagtaatactgcaatagcatttctacttcgtcatgaggagaatttggaacaaagaaaaaatgtctttctacaagctgcttgcttatatacatgcaaagataaacgacaaagactgttgagagtgcttaccatatctattccggtcactactagtattaccacagcttttagatatgcttctatcgaaccaattattaatatatatgctagaatggctgctcatcatattgtttcaaaaggtcaaagaggtttttctggttcttctggatctacttctgtaagttcaacaggagctatagctgcagctacatcagtagttcctggtcttccattttctactaacaaaaactctagctcaattctcacagcttggaagcaagaaactctaaattcaattatcgatatgctattttcttatagagaacactgtgcaaatacatcatcaactggccagctcattcttcctgattctcttaaacttactttgatttatgtttcatcactattcaagcatccttcgttaatgccactaaatactgttttggaatttactgtatcagaacagcttgttggtttatatgagcttctttatgcttcagtaagctttactacagcaactctttacccaagactctatcctttgcatcattctcttattttatccgaatctaatagtgagttgcaaaagcttgaatctgttggacttccttaccagcttacctttcaaaatgatacatctatcaatactgcaaataataccaataatatgatgggaataaatgcttctaatactagctccttccaatcatctgatgcttctattatctctagatattggctcaatcattcaattgcttgttctggagaaagaatactttctgatggaatttatgtactagaaaatgggaaagaaatctatctttattttgggccccaagttgattctaaagttatttcagaaatttttggagtcacttccatcaattttgaaaactttactcaactttctttcccacctgaagactatttacctacaatggaatccaatattggtatttctaaacgtatctcaaatgtggtacaacaaattagaaacgatagattctctgtgaattgttatatgcctgttgttatagtttctcccgtttctcagaatattgaagccaagttcaaggctatgctggttgaagatgcatatggatttgaaactacttatgttgactttttatgcaacgtacacaaattggtgcaaagcaaaattgttgactcctaa

SEQ ID NO: 3541 - DNA, 2154 bp, Cryptosporidium hominis
atgctagatgggaaaatcaagaagcctgctcatcaaaaattacatgaaacagttggaaaacataatagttacatgaaaaatgttgtatatggtgacgaaaatataactgaattaaataaaatggaatatccaagaaacacacttttgagaaataatggattatcagaaaaacttgaaaagcatttaaacaatgaaaaagaaagagaattagaatcattatatgaagaaaatcgacaattattaatggaaatttcaaaactgcgtaaaacaaatcaattgttagtcaaagatgtaaataagaaaaatgaaattattgatagtcttgattcaagtcttgttgaagttgaagaaaaattggaaaatgcaaaaaagaagaattggaatatgtataatgaaattctgaatagagaaagaaagaatcaacaacaaaataatgccagagaacataatacagattcaaatcattctgatgatgaaacttatgagcttaaggcctctaaaattggaacttttaatacagtaaatataataaaatctagtaataaaaaagatttaactggcaatagaccaaagtctacaagtatttctacttcaacagaaaataccaaatggttacaagacatgattttagaatctttaagtgaaaaacatgtggaaaagaaagcatatgataatttaaaatatgaagttgaaaagcttcagaaagaaatttattcaatgcaaactgacttattgaaaagtaatattcatgatgaagtaattcaagaaccaattgttgatcattctaatgggaagttatcagtcttccattccactagctcttcaaccaataattcttcaagcattattgggacatctatcagcggctttaataccatcaataatactttccaatctacttctctcgctcaagaactaaaggaggtaaacaatactacaactaatagctcctttgactcttcacagaaatctgaagaaattcaacaagaatctgaaaaggaaaatgagcaagaaaatgttgaatctattcctccaagaagtgttcacatattaatgggtaagactttctctagagacaataacattgacaaaaaaatcaacaaatacaaaaatggtcctagatataatcttcagaattctgataatgacaattttattcatccaacttctaattattacagatctgatattcaaacattccaaactcaaattaatcaacaaccaagtatagctactaatggaaataactattattactactcatactccaatttgaataataaacatcaaaattacaacaaccttgatataaagaactattctcatatctataatactaattacactaatccgtttttaagtgtatctacgaatgataattataatagtatgaatagacctttacaaggctttcaaaacaataactattcagtttataactcaattagaagacccataaaccttgctgaatatagagctaattatacaaaccaacaaaatatggaaaacttggtaaatcatcatcccctaatgactaactccatgttagattcaggtttaaaccctcaaaacttaaaacaaggatttattcaacatcaatactctaaaattaaccttccagaatcaaatttaaactcaattccaagtttaaatccattctatacgcaaactattaacttaaataattattcaaatttaccatttccaccatttcaagtcaaaattacacaaagatttaggagaaatagaaacaattctgttcctcctccaagacctaaaaatgaattaaattctgaaaaagttgctattgaagaaaatcatccagtatctaataaaattgatatatctgattctaataatgactcagataaagatctcccacagggatatattcgtttcaaaacttctatttcttctcctttgagccaggatgatttcttttctccaatctcaggaaatgttaataatatctgtccttgcgatagagccattgattcatgcgcagccatatcaaaaaaactaattcaaaataactatgagaagaaaaacaagatgagatcatcgtcaacatctcttccgctcccaattcctttaatcgcaaaaaataaccaatttcagggaacatctggtctactcaagtttagtaaatactag

SEQ ID NO: 3542 - DNA, 6021 bp, Cryptosporidium hominis
atgcagaacaagggaggaatccctattaccaccaatgtattggcaaatttggaggaacttggaatcaattcatcatgttttcgatttggtagcctgacattggaaggagataaatatgtcggtgtaaaggaaacaagtgttgatggtggttcacagattgtcgtgattgatactcaatctaaaggaataaatagaaagccaatgaaagcagaaagcgctttaatacatcccattgaaaatattctagtagtcagaggaagatatgaagataatggttgtacggtccaaatctttaatctagactctaaagagaagcttggagcattcttatttcctgaatctgtagtattttggagatggttgactccaagaattctagcaattgttggtgataagggtatatatcactggacaatagaatcgggaaattctaattcaattcctgttcgaatttttgagagagctggaaaattagcagaacaatcaactcaaattgttggatatcagacagactctggccaaagatggtgtatgcttatgggactttgcccagtaacaaatgagtcaactgggtcaatttccgttaaaggtcagcttcagttattttcagtagaaaaacgacaacaacagcttattgaagggttttctggtaactttggagagcttattgttgatgattttgtacattctccagcatcaattgtctgctttgtcgagaagaaacaagaacattcaaatgctagacttcatgtaatggatatttcaggccaaagagcaggatctggtgaattcgggtcatcattatctcctccaacaccattcaaagctgttattgaacttccaactgtagatgaaggctcagctggaggtgcccatagctttgactttccaatatatacttatgtttcaagttactttggagttatattcattattacaagaggtggaattctgtatatcgtggagccaacgtcgaatactttgctttattgcaataaggtttgtcaggattctgtgtttttaggttctccaagccgttttcacgggatttgtatggcaaataaaaaaggactggttctccatattactttaaatagctcatcagttcttacatatatccaatcaaatcctgaattatctctaaattcaaatcttcttagatggactcagagatacggttatcagggaacagatgaattctcaattaggatgttcaatgaatcaattaagagacaagactatcaaaatgcttgtagagttgtttcccttaataagaatgggagcttaagaactcctgcaactcttaatcacttcaaaatggttgattcttcgaataagttattattccagtactttacaactgtattcaagtttcacactttgaaccaatttgaaagtactgagttttgcagactattactttctccaaattctacaagtttaatttcagaatttacctccattacacaacctttagttttcttacaagtcctaataaatgaagaaaagttagctttctctgaagaacttggagatacactacttcagaatggcgaaaagaaacttgctcttaagatttttaaaaaatgtactcctcaaaatccaacgaaaattttacaaacacttattgaaattggtaatttctcacatgtttcagaatttattcgtgaacagaaagcttcaaactggcctactattactactgatatcaggtcattactcaacagtcttttaattgctaacaatattgatgctactgttgagtttgttaaaacggttctactccctcctgcgccttcatcccaatcagatctggccaattctatctctgctgaatctcttgatcttaatatagataaaacttcagttgttgagatttttgtatcccattctagatataaggaaatcacttctatccttctagaccatctcaaagctaataatccggaagattctgtcctccaaacaaaactacttgaagttaatctccttcatgctccacaagttgctgaagcccttttccaaatggaccttttcactcattatgataaacatgcaattgccgccctctgcgaaaaggcgggcctttatgagcgggctcttgagaatttctctgacatgcgtgacataaggagaatattaggagtagcttgtgggagtttaaataccgattggttggcaaattacttatctaaattaagtccaaggacaagatttgattgtttgaaggagctactattggtttgcaagaatagtagtggggcaggtggattagtttccatgggaggtggactagcctctaatggagcattaccgggtaatggacaagcagggttaataggaaacagttcatcaaattcgatagcattaagtaataataacaccgttttacagagtgtcattcaggtatgcattaagaatgtggacaatattggaatagagaatattattactttatttgagcaacagggaatttgggaaggcatttactatgttgtggggtccaatctgactcaatatttatctgggaatagcttatcttcatctagttctgctgaatctttgaatttgtctagtgaaagcttaattggagattctggtactcaaaatagaggaggggctggagtggttctggcaggatcaggaagattaccatcttctaatacaggatcagttaatggtggaacaggatcattttctacctttattgtatttaagtatattgaagcttcagtccatcttggccagattcaagaggctgagaggatttgcagggatttcccacaatcttatgaaccagaacaagtcattgagtactttaagagcattaagatgagtgatttaagaccattaatttgggtttgtgatcttcatcaccgtgtagaagaattgattagttacttgtaccatatgtcactttataagtacatacaggtttatactttgaagattaatccaagtcaaactcctttggttatcggtaccttaatagatcttgatggatctgaggatttagttaaatctcttttacaagagatcaagactttaggttcttcattctcttttggagagctaattcaacaagcagaaaacagaaatcgtctcaagttattattatcttggcttgaagaaagagttcaagaagggtaccaagatccagctttacataatgctttggcaaagatttatattgatatgaataaggattccgagaatttcctcaagactaatcctcattatgacgcaaaaactattggagattactgtgaagatagagatccttatcttgcatatattgcttatagaaaggcttggggacaatgcgatgatgaaattatacaagttacctacaaaaatgatttatatcgtctattagctaggtaccttgttgaacgtcaagatcttgatctttggaataaagttttgggaaattcttcgaattctattgaacctgttgttaatgagcagtgtagacaagctattattgatcaggttacttcttcaatattacccgagttctataataaatctgaggaaattagctgcgtaattagggcatttattaatgcagaggtaccgaattcattattagaagttttggagaagattatcttccatgttaataacactgaattttctcagaataagaaccttcaaaatcttcttttattaacttctattaagatagatgttcgaagattggatgattacgtactcagattagataattatgatgctaaggaggtggccaaagttgcaatagatcatggactttattcacatgcttttcagatctataagaagttctcttttaataatgaggctgttgagaccttattaatgatttcaaagcttgaattgttaaagaatgagggtatcgatattgatggaaggggagctgagtttatgaaaaacttggattctatgattagtattgaaaagttggccaatatggatctatctaaggttcaggattttgcatcatattgcaatgataactctgtttgggatgttcttggtcaacaatatctcaagatttctcgaacaaaggacgctgttgattgctttattaaatctgaaaacaccagagattatagacttattattgaacattgtctttcagttaaagcttatcgagaactattagggtatttacaaatggttcgaagattgaaagattctagaacatccaaagacccaattgttgatacagaattagcttactgtatgtctaagttggagcttttgcaagatctccaaaacttcttacaaggtattaacacagtacaacttcaaaaaattggagatagacttatggatgaacaagattatagatactcaatcattttctatcaggcaataccaaattactcaagacttactagttgctatattcaacttggagagtataataacgctttggaaactgctaagaaggcaaactctcctaaaacttggaaggaacttttgcagatttgtatgcagattggtgaatctgagttagcacatcaagctggacttaacataatagtgtatccagattactgtgaggatgtggtatctgaatatgagaagaagggtcttacagctgagcttctaactctattggaaggagctattcaaaacacagatcgtgctaatggtagccttttcacagaacttggaatactttatgcaaagtatactcctgaaaagcttatggattattgttcttcttactcaggaagaattaacatcccaaagcttactaggatctgtgagcagagacagctttggaatgaggtggtatacctttacctccaatatcaagagtttgatcaagcagttttaacagtaataagtcatccaaaagaggcatggaagaatgatcaattccttagtatactacaaaacgttacaaatgtggatattctctataaatcaatgactttctatctacaagaacatccagaattgctaaatagtttattaatgttaactttaaagcctaaaaaaagttcagaaatgataccaaagtcaaactctagtgatatatcagactattctcccactaaatcaacaggtggagctcatagtcaatcagggacaggaagaactggaagcaattttgatcttgctaatattactactagatttattcaacagtattttagtcaaggactttcctcaacaagccctaatacagtgggtccaattacagggatttctccaagaccttcagttgggaaagagagtggatcacagagtggatctagttacgatatttcaataattcaagaattcttagaatccattagtgatgagaacattcaagttgtgaatgaggctttgattaatttatacatagagaaggtggaagttgaaaagctaatgaaattaattttaacttgtgacaactatgaccaggcaaaactttcagccagattagaaaaacatccaatgaatgatttaagaaaacttgcagtgaagatcttagataagaactcaaattatcaacaagctctttcaatttgtcagaaagagatgctaatagatgaagcaatcttagtggtttacaagagtggcaatgttgctcttattgaagagcttttggaattcctccttagtaataacaagaaggagaactttgtagcttgtttatatacatgctatgagtttttaagaccagatactgtaatggaaatggcttggaaacataattgtctggatgctacaatgccattcttcatacaaagtcttagagatatgaccaatagaattgatgtccttgaaaagaagcttgaaactcttcaaattactgacattgcaactacggcttctggcggtcatccaagtgtttcgaactcgcaaaacatttcaagttgcgttgacatggggcccaattcttcgatttctcctggtctgatttcatctcatcatgtgaacaataacagcagtaataataactcaaattctaactcttccaatacaataaataataattatcatctaatgtcaaacaataaattaatctttcactag

SEQ ID NO: 3543 - DNA, 498 bp, Cryptosporidium hominis
atgaagagaagaacatcaccaactagaaagagaggaaatgagtggccaggtttgactgatgatgaaattgaagaaataagaaaaaccttcaatttatttgatactgatggttctggaactattgatccaaaagaaatgaaggcagctatgcaaagtttaggatttgaaagtcagaatccaacaatgtatcaattgatcgcagacttggatagagaaggttcttcagccatagattttgaagaatttttggatgcaatagcatcaaagcttggtgataaggatagtagagaagggattcagaagatatttgcaatgtttgatgatgataaaacggggagtattacattgaagaatttgaaaagagtagcacacgagttaggagagacaatgactgacgatgaactaagagagatgattgagagagcagatagtaatggagatggtgaaattagctttgaagatttctatagtatcatgactaaaaagacttttgtataa

SEQ ID NO: 3544 - DNA, 1347 bp, Cryptosporidium hominis
atgttagttccagtgaatattattaatgaatatccaattattgggtctcaagaattcagaactattaatatgagagctttgtttatggtagtgatgtattttaatattctattcacttctttggttattcctttttcaatactttattatgaaacacagtttgatacaaaaattggactaaatagatcttacactccatatctagcttcattcttatctacgttattttgttggatctttattggtggtaattatgcaattttcaaagaaattcacctaggtagcatttcaaaagagacatgcataagattaacattacttggttatatcagtgaagctaattgcgcaagtgatcctttaatttttaatggaacattctccgtagcaacagctggattattattatttattgggtatatttttaatgtattatttattggagttgctagtgttttgattccaattaactacttaatttcaattattagaagaccaaaactaattgatattcatttatatcaaaaaaagaagaaagaaatctatgtagtctctaaagcactatctaataaaggagagaatctgaaaagaaagtttgatcaaagctctaaaggacttgaatcagaattctacacaagcaaatatttaaagtcttggcaggaaacaagagttcttaaacaaaaaatatataaatataaaagtgaggtatttgcattaagctcatattttgaaaatttagaggagagattcaggactaaaggacaaaatatcacttttattattattaaattagtacaaatgttctttacattattattaactatatctatatatgcaacattaatcattcatattgttgtcaagaatcctccaaattatagtggtaatcaattgattaatatgatttttataatattctcaatgattttacctatatatattggatcatgtatatgctatacttggaatctattggctaaaaaaatatgctattgtttaccaatacatgttttagttaaatcacaaactccaatgaattctatgatttttattattggtatagtcttaattccaatatctaatattatatatattacaaatttatcaaattcttggctttttaaatccgatctttattatatattcctcttagcatcaaatacaaagcttaattacaaactaatacctaatcaagttcttatatatagcctttttgggatttctatatgctcaataataatacacctattttcatttctatgggatacaagtatttcaatacaagaagaaattcctaagatgctcaacaaatatttaaatgaccaagaatctggtaattcaaaaaaataa

SEQ ID NO: 3545 - DNA, 1584 bp, Cryptosporidium hominis
atgatcaatcttggagataaaatgaatacagtattattaaataaagatatagtcgaagaagaaaactttgaaattgagcaagttaatcatcaaaaaagttcagttgaaattgaaattgaacagttagaattgaagattaaagaatcctataatacttttcaagagcttaaggaacaatacgatggagaaactactctacttaatatgattactgagtgtattagtaatgttccttttttatttgagaaaatatctagtttgaaaaaaaaacttgttaatcttgaaaaagatatgaaggaaaatacaccaaatgaatcagaaatcaaattaaaaaatcaaaaacttattaagtctgcatttatgggtcaaaatccattggatgatttatcagattctatcatttttaagaccagtatatttaatgaattaaacaaaattaataaactatttctagaaatttctactcaagattttactaaaaataaggaattgaatgaaaaagttattcaattaaatactaattattcatcatttcaaaaagaaattattcaaaaaaaagaagaaataagaaaatttgaattagaaatgaatcaagttaatgaagattatgataaaattatatctaatttggatattaaaagaaaggcttcaatagattcttatcttcaatactattcaacttattgtcaatattataagagattaaagtataatgattttaacaaaggttctaattctaatcataaatcaaatgaaaatatttatgaatttatttataataaaattggtaaatgtgaaaataatcaatctcaagatcaaaatgattgtaataatgataaaattaatagatcaaattgggataatcatatttctgatgttccaggtgttaaattcttttcatttataataagtggaaataaaccttcatcagttaattgtgagaagattcctgattattgtttagaaatgattagtcaagtatcctctgaatttggacttcttaaatatgaaaatatacaatttaaagaaataatgaataatacattaaaatattcatcaaacttgagtagttataataatcaaatattaaatcatggagaagaagaaatgaaagagaatactattttagaagataatgaagttaaagtaggaaaaagaggtattaaaaagatttcaaaaaataattcttctaatcatttaactctatttgatattttacttgataatgatgaatataaaataagatatgaaaatctatttaatacaataactagcttagaagccaagactcataacacaaacttagagagaatggcagatttagaacaagaatttgagattttaaccaaagaaagccaagatttatctaaaaggattactatatatgaagattttgtttctaaacattataagaaatggattgatcgattaacaataattgaagatgtagtttctcattgttttggaatttttatgagatttattaatgataaacataatggaaagattattattccttttattaataattctctactttttatgaatacttcaatggatacaggtcatggaacctatatttaa

SEQ ID NO: 3546 - DNA, 489 bp, Cryptosporidium hominis
atgaaatcatacactcgtgacaatgtggttaagcatatgtctgagatttttagtgatatccctgatattataataggagacatttttgattatttagttaaggaaaaccttaagctatgtaaacagttatctagctgcgataaagagtatagttacgaaaatgaaatgaataatattataaacgaattatatgagaagttatctgaaatttcaatcaaagaaggttataatgattgttgtcagatcgattttcaagaatcttctaaaaattccggtgaatttgacaaacaacaggatttatatgatgatatagattttaatagatatttgaatttaaatttctactttaatcagattcaaaatgatgaattggatacttatatgaaagattttcttaaacaaaataataaattgtcatatttgtctgtgtgtacgcaaaatcaacaaactagtagtaatccgataaatcccttaaagagtagtaataat

SEQ ID NO: 3547 - DNA, 510 bp, Cryptosporidium hominis
atgagtattaagttattggattcttattttcaaaagattatgtatcctattagtgataattatagttttatagaaattaatggtaaaattctacatcataattatagtgaaaggtattatattagtttaatgagaaattcaaaaataaaattggttcctgctatatctaataaatattttaatttaaaaagcaaaacagataaagtaaatactttaaattcatttaaaagtgagttatctgatgatcattttagagttttaatattattagaaattaaagaaaaatgtaataattttaagttacgaatttttccagaaacgtttgatgaacaagacaaaatcactaaattgagttccagtaatgatttatataataatagtaattgcaaatttactacatccatttgcagctatggcaattactttattttgattgattttaaagaaaaacaacaagattttgtaaaaggtaacttttttaagcttattatttattatcaaaaaatttaa

SEQ ID NO: 3548 - DNA, 882 bp, Cryptosporidium hominis
atgaaatattgtgttataagatatagaaaatggataatactattaattattattgagtttgttattaagattaatttgttgtatggattaagaaataatgtatttgggtcattagatccaaatacattattatcaaatggtggattattgcctcaaaatttggttaatactgccaatttacctacaacttctacaagtactcaaggtactactattatagtaaatagtccacaacagaatactggtaatttagcttctagtaattcatttttgaatgatctttttaaaaaaccatcattagaacaattgaataaagatattaaggaaataatgcaaaaagaatcttcatctaaaggttttggaatatgtttattcacaaataatccatatttagatcttggatatagagatttggattatggaaaatgtactaaattcttgttatctatggatacatggttagatgaaagtgcaataaataatttaattcaagaacaactagtaaaaaatggattatcaattccttctaaaaaaaagtttaaagttccaactttggaagttttatacaaggagacttttcttcaagtttgtgttactttttttgttggacttgtaaattctggattattagaaatgaataataagacttgtactggtaattcttgtcatgatcaatttaatgcagtttgtacagtggctttcgatacttacggtaaatctgcatctatactaggaggaccagttatcaatgatgtcgtaaaaactatttgtcaagaatcaagaagacaaattgcttctaaatatcaaactataatatcctcacctgctgatataagacctgacaatgttcccgttgaagcttctgagcctattcctacgtaa

SEQ ID NO: 3549 - DNA, 3720 bp, Cryptosporidium hominis
atggcatcatttgatgtcgatagaaaacatattttaagttttaataaaaaatgggaaaaaccttcaaaataccataaaattccacaattcattaactataaattaccttctgcagaaattaaggttgatggaaatatagtaaattctggctctaattctaattctaattctaatatggaaataaaaaaggaagttaaaaaagaaactattattaaagattcagtttttgaaaaagacaataaggctaataataatattaatagttcaagatctgatctaactgatagagaaagtaaaagaggagatattgaaggaaagattttaaaacaattggattataatgatggaaatgaaaatgaaatttttaattggctattggaatatgatgtaccactttttattgcaaatgatctgattaatagtgaattaaatatgaataattgccattatatggcaaatgattttactaagaaagagaataagagaagtttttctgaattagaattggaagaaaatagtagctctaattccagatttgattccaattctattggaattgttgttaataatcaagatttggatgagattagtcatgtaaagaggaaaaaacttggaattggtgattttcaacaaatttctaaagctgagaattttgattcaatttcaattttgagtaaaaatgaacaagagtcaacaaaaaacgttatgatcactaataaaggcattaaagaaagtaatataattaatagacaaggtttatcatcaatattttatccaatttttcctcttgtatgtttccctgattttgtaagaagtggggctaatatggaacatttaatggtaatggatatgtcatatagtttggaactttttacaagtccaatatcaagtgagtttgatatattgggtcagactttacaacatttcggaagtttaagtcaatcacgtacattggttagaattattacaatagctttatgttcttctttaatggtaatacgtgatatttctgtattattaaaatatccattattatcaatacaaggaaagttaccagtaaacattgatttgatttgtcagtatgatgatttattagttccaatagaaaaagaagagaagacttactttttaagagggttattatataggatatggaagtataataggaatggtaaggtaataaataactcaaatcaaataattgataatcagtttaataataatttcaataaagatgaaggtattaaagatcatagttatgttgatatatatataacagtaagaaatattccagtaaagtctattgaagatattgagattaatggatgcaaggcaagtcatatttataaatctctaatacaacagaatatgtctcatatgtcaattttgtcgataatattagaaagactatttaactctccatttgaagaattacaaaagttacactctcctaatacttcacaacaactgttggattcttctcagttaagaggggataattccatgaacaattcaaacaagaatacaagtcatttgaatatgggtgttgcggttggatctaatatgaatcaacaaaatcagcaacagcaacagcaacagcaacagcaacaacaacagcagaaacagcagcagcagcaacaacaacaacaacaacaacaacaacaacaacaacaacaacaacaacttcatcaacagcaacatcaacatcaacatcaacaacatcaacaacttcagcaacaacaacttcatcaacaacgacaacagcaacaacatcagaaacaacagcaacaacatcagcaacaacatcagcaacaacagctaggctttgagaatcctggtaacagtaaaatgagctatttgccaacaccttccacatcaactttccctttaactagttctcattcttcttcggtattcaattctaatagtgcaatgagcagcaatacgaatttccccagaaatgtaaacaatcaaagccaaaatgtgaattcaatgattaattttcctacaagccataatcaaattagaaatggacaaagttataagagtaattcaactggtcaaatttcggtcaataatttgcctaatgataacattaactatcttactatgccttctacaaagcaaattccctactcttatagtagcaataataataacaataacagtggaagtcacactaacagtaacagtggttctgccaatttaggacaaatgcaacagaatcagcaccaacaccaccaaaaaaatttaattcagctccaacatcagtcaatgcaacaacttcatcaacaacaacaacatcaacaacaacaacaacaattttacaaccaaagacaacaaagcaaccgagtatttggttctcagcatatacaacctcaaatgcaacaccaacatcaccagaaccaacaacaacaacagcaattccaacgtcaaaattatggtcaaaatcaacttcaacaacatcaacaccaacaactatatcaccaacaacaccagtcagttcaaaaacttcatcatcagcaacaacaacaacaacaacaacaacatcaacaacttcagcaacaacaacaacaacaacaacaacaacaacagcaacaacttcaatttcaacgtcaattaattcagcaacgtgttcaaaaccaaaatcatcctcaacaacaatatcgtcaaatgtatacccaaaataactcttctcatgtttcccaaggtaataattttcaactttcaagccatcaaagtaggcaataccaacaaaacaatgccaatgaaatgatgttgaattctagctataacaaaaatcaagaacttagtaactttggaagcaatggagaagcagcaatgggagcatctataggaagttctaatggccatggcaataacctgggaaattcacaacatctttattctggaaataataataattttgaaatgggaaatagaggtatagtggtagctaataatacccactcctcttcctcttcttctaacgttcacagccaacagtaccaatactcaaaacaacagcaacaacacactcaatatcaaaagcatcaacaacatcagcagcaacaacaacaacaacaacaattttacaaccaaatacaacaaaatcaacacaatcaaaatcaatatcagcatcaacagcaaagatactcccaaaatcaaaatgtattacattacaattcaaacaacgttaatattcgatctaaccatattattaatggaggtaataatggtcttattgggacaacaggaacaggagctctacaaactggtccaaatggaccgaatggaaacttacaaggaggaaatttaacaggaaggattcaaacaacaaatataagaagaaatccaactctcgttgataataatcatcatgatcaataccatcacacaccagcgccaggagaagtggcgccggcggggcgccctagttatattgtgcaaaattttcaaggacaaaaaggaggaataatgaatagtggctataatggagaggttagtaatggtgttggtaaccaatattacggtggtcagtataatcgcatttcgggtcataatcagatgagtatggggggtggagtgcaaggaatgggatatagaggtggaataggaatgcaggatcaaccaaatcaacaggggcagatacatccaggtgggaatcatatttctgagatgagaggattggattataattacggtaattacactcagtaa

SEQ ID NO: 3550 - DNA, 4179 bp, Cryptosporidium hominis
atgaggctaacaaatgaagaaacagaggagtttcagaagtcatttgctccagtttcttatggccatctttctcgtcagttggtggaacacagttatagtgagtttttggatttgttaggacgttgtacaagtgacccaaatgtgcaagaggaagcaaaaacttgtttgtgggagtattctgcagaggttagggaggtttttctgagaattttagcaattgggagcttaagtagaatagtggatgatataaacagagcgatacaacttagagagactttagtatcaatgaggtttaaacaaagaaagcttgcattcgatttttaccctgcattaacaatggtaggcaccccaagtccaaatataacatcagcaatggatatgatattgctcaaagatttttctcaaatgccaaatttattggaagaattagtaacacaacatggaaaaccagtaattgtcccaaaaatgagcgaaatacaagaaaaactaattgagaagcagcttagagatgaattctttattatgtatgcaaattcaggaatttgtaaatcaagaatgatccattttgatatagtaaagggaagaataatgttggaaaagaagtccagattctcattgattttaatttctgatctaaaggaatggcaagtaattgatgctaagataataatacctgagattttgagtttatatactgtaactaaagagcagaattcttcttttaaagagattttacaggcacagatttattatatgtttaattgtagagaagatcaaagtgttgaaccagttcaagatatagtgaaagcactagagaaggattctatagagaatggtttggataatataaattcagagaaagaagagattaagaaatttgaaaaagttaaagattttaagaaagatatagatgttttgggagaactatacaaaatatcaaatattattacaggagaaataatactggaaatgtttttagagcagtcaattttaagtattaaagagcgtggtattgcaggtatttaccattctgaaaggaatgaatataaatataaaaatgatacttacaagtatattgatatttatttatataagaatgcagatataaccaatttaacaaattttgataatgaaggtaattttgattttgcaagatattctttggtaggtaccggcttaaataattctaatataggccaaacaacagtttataaaagtatgttacataatagaaatggcacaaatataatacttagatttctaatgattccaaatggtgacattaagtgcattttatggccattttcccttttatttatacataaaaatgagttatcagatgatgttaactcggtacttgatataataagtgagaatgaaagttggaaatatttatgtaattgggaaaagacaaatcataataatattttagatctttcaaaagttctgaatcatgtttcaaatgtttttagatgttatttactggaattgtattcattaaagttagaaaagtatttggataagaatgcaacaatagaaagaaataaatattcaattactttacgtcttttagactatagcgagtatattttaagcatagatatatttacaggatctctagtaattagagattcaaatttcgggaataattcaatttggaaaaattatccaacatattatgagaacatgcaaaaagcattacagagtaaaacggattcattctttcaattattaccatatttgttgaaattgactaaattccaaataattcgaaatgaattttcattaaattatggttggaggccaatatgcaatgtccccacgcctatacaagaatctatattaaaagagagaaaactaaagattgcagaatttcccgaattggaagaggataaaaggaatgaggatgagaatggggcaaagattaacaaatttgaaagttctcaaagtaatttaatgaagaacggatctagtgttataataaatacagtaatagacaacattttaacaatgacaaacattcttgcaaagcctgaaagagctacttatacacatatttcaagagacagaaatgaatttgactactttttctaccctaagaaatttccagataattcaagagtgatttatataaaattagatacagaatcatgtgaagtccaagtatttaagatatttttaacaaagaactgtcgttatacagaagatattgataataagctttctaagaataacgaaatttatagaatcctaggcaaacacaactttgaaaacaataagagaaatgattattacaaaggaaaagtaattcttgctgaatttgatattaatttgacttgtgcaacaatggatcaacacttaacatattcgggcgccaaggacacgttgggcggtaaaagttccgaattacatgcaccggacttgcaagtgaaaaatcacttgcatgcagagaatgagagtgataaagggtatgtattaaaatatgtggggcttgatgaaattgagattagaagaagtgttggtgaagtttttgatttttattcaggaaattttgagacaaaacatagtgaaattttagagttacttgaattattaaaggagtcagcaagtgaccattattttccattcaaattatattcaagattagatagaagcggccagcttgaactgaatagatcaattttttgtatgggaataaaggagtatagtttatttttccagccatataaggattttgaaagagaccagtttttattgggattaaatagagaaggaacaaatctttctgagaaaagaattcaatttaagatacaagtatgtaaaattggggcgggaaagtttcctattttgaacagatcaaaggattattctggagttcagagtcaagagagttttttttataggttaatattagaaactaatcaagataaaggttttctgacattttttaataatggtgaaatttctattccattaatatgtagtttaaatggtgaaaatgaggctttattgtttgataagaactacaagatggaattttctgtttgtgatgaggaatgtaattttaacccaaatatatcaaaagaatggaaattggttaatacaatctccttagttataagtaataatgctttaattcaagaaggatttgtcagtacttttattgattattggtatcgtattttaagatttttacacaaatcacttgagactatatatatggcatattattctaaacctaattatttacgaaaggctggaaatgaaatggtttctagaagagattttctaataaagaagatattaccatgggaaattgagttggaaattattccatggtcacttttatttggtgattctttaagtaataagttatttcaaaagttaaattataaaggaagtttgattaagatacagttgcttggttcatcagtagaacatggccaagttaaccaagtagatagtgaatctttgtcaaatattaataatgaatcttgtcaaggatttgaaaacattgatttcattcaaggaagagtaagaggagaagaagtagaatcttcggatttcacttctggagaccatttaagtgatgttaatgttgaatcgacaagtaatagtaatagctatattagtggtggctttatagatagtcatcatttattggaaaaaagagaatttattattgtggatatagtggacaatttactcacaaaaaatcatattgagatatatcaaaattatttgagggatgcacttattattgatgattttggggataaaagtaagaatatattatgtaaagcattttggaaaatcttaagatcttatgagatatcagcttcaatttctttaattgagtctaaaactaatccagatattcaagatatacttcagaaagatattcatggtctttatgattcattaaatacattatctttaaaaagaattgatgaaattgataaatttttgttatcttttggattaagaaaagtgggaatgcatatcatttttctatttgaaattgacccaaaggtgcattataagataaaaattagtttatttgatgttcaaaatattcaagttggaggtagtacaactcaacagtcaattgaagttattaatcatacaaaaaggctactttttgaatttattcgcggtggtttcctgtcagattattga

SEQ ID NO: 3551 - DNA, 1083 bp, Cryptosporidium hominis
atggtgcaagaagagaggaatttgattgagagaggtaaaagtaaggataagctactcgttttagaaggtgaagataaaagaattacaagtcggttggaaagttcggtatgtggcataataagggagttaataaatggaggaagtaggagtcaaatttacaattcaacttgtttggtttcggttatgaatattcttcacagaaatgtcaaggaaggcttccactcgactttaagagatatttattataataatccgagtttatatacaaaacaaagtatttcagataaatatattgcacaagtaactcatctagtacagactcctcgggaacttttgaatgtggtttccacagctagagggaggataagaggtcctttgataattcaaggatacgaaataggattttgtgaaagaagaagagaggttagattggattgtatgtccatttttgaaagtatggggcattcgataagtccttatttattcaagggtatgaatggtttgaagtttagctactattcaaagatcaagtttgttttagttgttgaaaaggatacgattttccaaagacttttagaatttggatttcataaagagtttgataattcttgtatattaattacagccagaggattttcggacctacctactaggactttactatacagactaagtcaagatcttccagaagatacaaagttctggattctatgcgattacgactgttttggactttcaatagcagcaacgtatataatgggtggtaaatcaggcacttggtatgattcaagttttagtatcccaaaacttttgccaattaaagttcctcctgtttcaaagttgatagagagcgggttaatagctacatataatgtttttgatattacacaagatgaaatttcaagaataattaataccagaaacagactaatgagttcaaatgagatttctcaagaatcaaaatcagagtggaatacattttgtatgcaaatgcagcaggatcaaaagagattcgaaattgactgtattgtagagattgagaagtggctaataaaggttatccgatcaaaattatcggagtaa

SEQ ID NO: 3552 - DNA, 1875 bp, Cryptosporidium hominis
atgtggcataacgtttcaaataattcattggcaaactcatgtcttcacagacttgatgattattttcgacatgaaagttcatcaagttcatcacaacttattcagaatggtataattcaaagtaatttaggaggtaatcatttaattaagacatgttcctctccaataggtaactcccagtattaccctggaaaagatatggagtgcataaatgctccaagagaccaagagagagtacttaatagctataaaagctttctaaatatggatagggtgatgccctggatgttaaacattgattcttttaacttaccaaatagcaaccaacaaccttgttctccttcacctcctaacaatatgaatcctgggcatcaatttggcttaaattcgaatccttgtcagaatccgaatatgaattctagtacatatgttaacaatcaataccagaattctcagcaacaacatagcttgcataaccataatcgtattgatgatttaaaatacatggagaagataaatttatttgcggaacgtaatcctcaattgggactgaataatgtttttagtgcatctccagtcaagagtgatacatctacagcaactccttcatctatgaggtcaataattaatgatgggtttttcaataattatcaagatgacagaaagtctagtattcaaagttacttttcatctggaacaagcaatcatcatggatatggtttaaaccttaatggaggaaatagtacagccagtagtggttacaacggaaacaataatatatttacaactggtttaggagggacgaattttggaggaatggagcattatcgtttaggagatgttccacctcttagttttggttaccttgataagaatagaaatgaagcttactacacccaagcaagcaaccttttgaagattctgagtccatcttggattctttgtattgatattgctgccattttacttactaatacagataataagatggcattaagcaacattggtcctaaactatcatgttttgccagagacgctttaaggcaaattaagcagaagaaactttcaagatttattaaagaacatagtaatttctttgatataagaagaccttctccttcacactctgcattgtatgttactttgaaatttcctttgccaaatattgttcaacaatttctaccttcaatagtccaactaaggaaatatgaattagaaagaaatcagatgaacaataatatccaagcaatgaatgaattttctgagaatgatttggaacaatctcaaaatgtaaactcaacagcaacagtggtaatgtcggaagaaagggtgaatacaacttcaaaagaaggtagtgcatgcaaattgtcagaagatactgacaataaagtggaatgtacttcaatttcaaataaacagcagtttgaccaaaattcaactcaaagaaagaatttagaagagaagaattgtataaatgatcaaattcctagctctgtaaagtcttatcaagcttatgagtgttggttgtgcgtaagggagtttgcaaatgttcttattcatcaaccaacacatacaatggaattaagggaaatcggggttctaatgtctcaaaaggcaaagattcaagctaaaagaaatagttcaaaaaagaattacaaatcctttttattatcgtacccaaaattgtttaggatttttggtaaagatgataatcactctattcaatggattgggtccagccaagacttcatcaaattgaactcaattaaatatcaaccatctcaatcagatgatgaattatttaatataccaactttaaatcaatcacatttacaatttttgttcaatcttaacaactcttcaatgtcactttag

SEQ ID NO: 3553 - DNA, 913 bp, Cryptosporidium hominis
atgatagaactttcattgggaaaactaagtcctgaaagaggaggtgataattcattgattaattttcagaaatattatgaatttgaaagagatttaacaataaatagccacgagaataataacacagaaaattatgatataagtaataaccaatttgtcaatgttggaaaattcttaattattgaagatgaaaattttcaaaataaaagagaaataattacagaacctgttatagaagttagagaattaatcaatacagaattaaatattaatcaaccttcagattcttttcaattagtgaaggttgaagaatctattacgagcatttcaatttccattaccatctatatgattgtgagtatttcaatagtgttcttgaactataaaattttttcaggaatcattgaatttccaatatttgtttcttggtttcaacaactagttgggttggcaatcttccaaattctaaaaatttataaaaatcacctaagatttggattgactgaatttactcactttaatcattttgaatgggaaacaggaaggcatatgataccattagcattatgttttattggaatggtttctttgagtaatatatgcttaaaacatgtattagtttcaacttatcaagttgcaagaagtacaacaattatttttaatctaattctttcatataaaatattaaaacagaagtcttcaatttttactgtaatatcttgtattattgtaatgattgggtttacaataagtgcatttgattcaaatacattaaatttgaatggagtaatttatggggtattttcatcaattatacaatcattctatagtgtattaataaaaaaacagctaaatgttgttaataacaatcaaattcaactcttatattatcagttaattttatcttcaataa

SEQ ID NO: 3554 - DNA, 765 bp, Cryptosporidium hominis
atgagtaataataacattttatcctttgagaatgtatcaaatgattattcgggttataatagaataattaatattgaaagggaggaaaatgttcaaatgatttgtatcaatttgaaatatagaaataaagactttataattatagaaaatttaattgaatctacaaaagctttattggctccaagttctgtatttaatggaaataatacaattagagactttattactgaggagcaagaacaggtgaataaattggagaaggagcagaaacaggaacaagaacaagaacaagaacaagaacaagaacaagaacaagaacaagaacaagaacaggaacaaaaaaatgaacttgatcaagatcaagatcaagatcagaaacaagccctaagtatggaagaaatgcgtgaaaatgaagaaataggaaatgaagtcgacataatatcagttatatcatataagaaagatcaaaaagtcgcttcgaacgaatattcaatgaaggaagaagatgatattttaaagaatgagatcgattacaaatcaatgtgcatttcaactcaaaaaaatagtactgaaaatttacaattacttacgatttgttctgaaacaaatgtgaatattactcaaaataaaaaaccaaactccgtaacttcaaattctttagttattaatagagaagaagtaattatcaaccaagttttcctgatatatattaagaaaatactatatcaaatactaacgaatgccaaattactaattctcctctaa

SEQ ID NO: 3555 - DNA, 912 bp, Cryptosporidium hominis
atgataaacacagctcaattaagatatgaaaatagcaatgaccaagtgtcaaaaaaggaaagtattgcattaaattggaatagctggtattttttcccagagcaaataattgatttatctttggtaaaaattcaagatttcctaattttagatagaaatcttatgaattctaatgataaaaatatttatgaaaaacttaaagaaatctctttaaaaagatggaatatgccaaatactggatcatattcaattactattactgatgacgtagttcctggtcattatttaatattaatactcaatggaactaaaaattttgtgaatattaatagcttagtggaaaatggattagtttcaaagccaatcataataaatcaacgaccaactaaagagcaaagaattgttttaaattatccaaagtctagtagaccatatggtttctctgatgttatttatgttaactatagaatattcaatgaaaagaatgaaattgaagatgcaaaaaataaagcttctattcatatatattcagtggatccagatgattcttcattaattgaacctagacaatactttgagactattagtaatgagatttccatacttggtcttggattagaaaaatgtccaacttattataaaataacagcaaaaatgcttgaacatccatttcatcaagattctagtcaatatatatgggttctgccaaaaaatacttctccattgagtctttcaaatgctgatttattatcaacaagacaattatgtataagacaaaacaataaatttggtatgtttcctaccataattgaattcgggattcttttgattattactgttattaatattattggattaattacactaggagtcattattaataaattaaacaagaaaaagaaaaaaaagtaa

SEQ ID NO: 3556 - DNA, 900 bp, Cryptosporidium hominis
atgccagaggagcaaacaatgacttcgattagaaagtcttcaaacccaaaatggttaagatttattgtaacagtttacacttattcaatgatttttatttcaattattttgggattaattactcaaattttactttggatatttctgttcccttaccttctttataatgaaaaattcaagataataattatgggacaagtttttagattctggaatgcttttctagtaatttggacgaatcctttctggacagttaaagtaactagggagccaaaaaaaaactataagccgagcaacactcttataatgactaaccatttatcaacagccgatccttggataatttcttcaactcattttccttgggaatttaaatatgtatacaaagctgacttacttaaagtacccattataaactgtgctatatcattgacttatgatcttccaatttacttcacaaaggagaaaggtggatggggaatcaagagtggtacaattgaacccatgtttaaaagatgtgcagaacttcaaaagttgggtattggtcaagtaatttatccagaaggaactaggtctaaacttagaagattacagccattcaaaaatggcttctttaaatttgcaattgaacatgaatctgaaattcttccagttgtttcccataataattggtctctctggcccttaggagaacctcttcttgatttgggaactgcttacgttgcttatggtgatccaattcaagtcactaaggacatggatattgaagaacttaagcttaaggtccaatcagcaatgatggaactctttaagtgctgtcctacacacaatccagaacttgagcaaccattatctacggcttcttccactcgtggccacggaattactggcaccagctaa

SEQ ID NO: 3557 - DNA, 891 bp, Cryptosporidium hominis
atgatttcagaatacgatcaaaacccatacagtgaacatgtttttcaagaatgctgttatgtattatcaacttatgacgatagttctctcttttcattaaatttgaactcattaagcatcaatttatttagagaatatgttacggatagattggcaattcttcattttattgactctaaatcaaagcttgaagataataatacaagaactttaacagattcaacaaatagatcgttattagaaaaacttctatctgaaaaaggatttaaactatttgattctttaactccaattaataaaacaagtccatcacatttagaaaattgttggagaaaagatcttttaagtcatttcttacttaagctttgctttataaacaataaagaaaaacaagaatggtttattgaacaagaaattaaattacttttatttaaattatccacaataattaatagtaatttatttaatcaaaaaagagataatattaaaagcagtaaatcatttattattgaaaaattactcaaaatgtatggcgttaattatcctatttggaatttagatcaaattaaaaatcaaaataacattaatgattctgaaactcatcaagcacaaaaactttgggaagatgctgtttctgttataacaaatggacaccttattaaaagattatttaaaatacctttttggccagatggatttagatttattaaaaatagaaaatacttcattaaagatggaatatgttttattcctgatactgaaattgaatcattatttatatataagtataaaaaagaactaattaactcatttattaatttaaaagaaaatgaaataatattagaaaaaactatcctttcagatcaaagagtttcatcattaattcgagaa

SEQ ID NO: 3558 - DNA, 681 bp, Cryptosporidium hominis
atgaaggattttctttataataattatattattgatatattaacattacattcagaaggaagtatttatttagatgatggtgaaacatattcatatttaagaaatgaatatatttttgatgatataatatttactttatatcataataattttaagaaaaatattggtgattattgtttaaatattattgataatattatggagaaaaatatattattatcaacatttgatgaaaattaccaaaaagataaattaagattatttaaagaaaattttggatttgaaatttatattaaagaaaaagaatataaattaaaaaataatataatgagtaataataatgataatcatcatatattatcattattagatgaagatttaagtgatatattcaaatttaagcaagctaataatattaatcataaatataacaaaaaaattaataaaatagaaattaaaggtataatgataaaaccaaaagaaataatattggaaaagaatattattaataataattcattgatttttcaaaaattaaaatataaattaattaaaagtaaatattctggggataataatttaatacgaggaagtttatattcaatagaaataaatcttgaagaaaataataatcaaataaattttggtgattataattggaaaataaaaatattattataa

SEQ ID NO: 3559 - DNA, 384 bp, Cryptosporidium hominis
atggttattcttggcactgatggtctttttgataatttatttgattttgaaattaccagcatttctggtttatcattttctcctattgaatcaaaacttttttataactgtctagattatactactactccaatggtaatagcaaaatcaattgctttatcagcatattacaaatcacttgatccattttccaaaactccttttgcaaatcaggcgaaaagattttatagtggtggtaaaaactctctttttgaaagtcaatctttttctgggggtaaagaagatgatatttctgttctggttgcttgggttgtacataaagatgactttgaaactttaactaaaaattcacctcattattgcgatatttcaaaaaagttataa

SEQ ID NO: 3560 - DNA, 204 bp, Cryptosporidium hominis
atgaattttattaggaattttattaaaggaagaagaggtatatcgcaaattcgatggaggaaagaaacctctttagaatcagaaattgaagataaagataatgattccaatgaaaatgagatagaattttgcagaaaatcaaattatccaaaaaattcatgtgaagcacagtggatgttggtaagttctgagaaatattattaa

SEQ ID NO: 3561 - DNA, 267 bp, Cryptosporidium hominis
atggaagatcatccaagtgaggctagtcttgaatctgcaaaagattttattagaaatattccagatcaatgtaaatttactcaaatagaagatacattttcagaaggagtaaaagattttgataacgctatttccactgcaaactcaaagagagaacttcttcttttgttatgtacaattgaaaacaaatgtaggcataagttaggaaagccattagtctcttgtaattattctgagataatgaaaagatggtataaaaaggattaa

SEQ ID NO: 3562 - DNA, 1254 bp, Cryptosporidium hominis
  misc_feature (144)..(144): n is a, c, g, or t
atggaaaagggtaaagaaaatcaaacatttcaattcaaaaaagcattatcattaatactttatggccttgtatcagtaactttggtttttttcaataaaagaatatttattgggagttttagttatccactatttacaacatgnatacaacaagtatgtggaatgatattctatttaatagcatatgcaaccttgaatttatttgggattcataatttggtttcaaaaccatcaattgaatacgaaaaggctaaagactgttttcctatgtctttatcttgcacaatatttatattgttatccaatctttgcttgaaatatgttccaatgtcatcatatgcaattacaaggtctttgacactattctttaatataatcttttcaatttttatattaaagcagcaaatttcaactatatgtatttttggatgtggaattgttatattgggatttattattggttctcttgattcatctactttaggattctatggaatattatcaggaactacttcttctttatttcaatcaatatatactgttcaaataaagagtgtttcaaagaaaataaatgatgaatcccaagtttactggtataatgctcttactacttcatttttagcagctattccaatctttatatttggtgaacacaatgcattcattgagttatatactttagattttggagaatttataattaaatttggtcctattttaattagtggtatattgaatttcttccttgggataattataatatggtgtattcatactacatctcctatagcttataatctaacaggctatgttaaatctggagctcaaactttaattggagttttattaaataacgaagagcttaaattttcaactattttgggattggttatgacaataggaggatctgctatttattctttttcaaatcttttcaaatttattccaaataaaaatattgatttgaatgaaagctttaatataacctttggacaccagctacaacaacaagaacctattcaacaagaaaattattatgaccatgattctacaatatcagggtcatcttctttagaatatgatagtgagaaaaaacctgaaatgaatgataatttctatgataatgagcatctcaactcttcaaacaattatgatcaattaattaagaatagcaaatacagaaaggtatctcaaatcggatcattggatgaaaatctaataaattattctaaatctaatggagaaattcagtaa

SEQ ID NO: 3563 - DNA, 1860 bp, Cryptosporidium hominis
  misc_feature (1772)..(1772): n is a, c, g, or t
atgaagttactttcaaaatggtcagattattatgatagtaatcaaatcgaactagtggatgacttttatggaactatttttgcctttacaaattcaaattcgattgagtctttttcatactttgattcagataaaatcagtcaaagaattaaaaaacttaataagaagctaaatagagactccaatgttgaatctaatgagtctaatatttttgctggaagctacgaaactctttcacttggtaagagactattgattccagaagaagaaatgattggaactcgtcttttgggtattgattttgatcccactagtaatacatttattgctggattagggaacaactcactaagatacatttctctgagtgaaagttttattaatgaaattgtatccaaagaaaagtctaaagataatgattcaagctttcaaaatgatgaatcaggttcttatgctcaagcaagtgcttgtaatgtacttagaaggattgaaaatgagggacatagaggaatacctagggctatcgatatttctcaagatgataagtttattgcaacctttggtgatgatacaattaaaatttggaatatgaaaggctttggatgtgtaagaacaatgattgctgagaatcctgtctgtggatttattgttcctggaggtgattatacaatatcaggaacaaaacaagggagtatacagttacatgatatttctaattgtaagttaatccaatctttggataattcacacgaaaatgcaatccaatctttagcattatgtcctgataatacaagttttgtatcagttgcacaagacaaatccttgaatctatataactttggccttgaggaagactctgatggtgatgaggggcaggtaaccattaaattaagcaagactttaccacttttagaagaaggtctagcaatcaaatttactccaaatggtaaatatcttgttgtatctttattagacaatactgttttagtattatatgcagatactttaaagcagtttttggtcttatatggtcattcattaccagttgcatgtctggatgtttctcatgataatacgattgtagcaactggtagtgctgacaaaacgatcaaaatttggggtttggattttggtaatattcagagatcatttcatgctcacaatgaatgtgtaactcaagtttgtttcattagagatactcattaccttgtaagtactgcaagagatggatcattgaagctatgggatacagataagggggaactgattacgattttacaccaaaaatctacttatggtcaagttccaatactttgcttgggtttaacttttgatggtgatcgtattatttgtggattcttggatagaactatcagagtttggtttagaactgaccagcagctatttcttgaagaagaaagagaaaaagaacaggaagaacagcttgaaagagaaatccttcaggggaatacaaatgattatgcagaaaattttgcctcagtttcagttatgtctcgtccaacacgtaaaacatttgaatctttgaaatcaacagaaaggctcatggaagttatcgacattgcttataattattatattgacttattcaaatataaccttgctataaatgaaattaagaaagaggacaagtcacaaagttctaacaatatccctcctcctccttctcctttagaaattggtgaatattcagttcaggagtacgttctattatcaattcagaagatatcatccaatttactttcagaagttgnttggtctcttcctttactttatgctgaaaaactattaatttgggtagaattctgggctcaagttaaatgtatgatcattcaatattaa

SEQ ID NO: 3564 - DNA, 2220 bp, Cryptosporidium hominis
atgaacaacatacaagatgaaatagaagaagaatacgaagttattttatctcatattaacgatgtatctttccacatttttcagtttccaatgacttcaaaaggaaattcaacagagaaagtatggcaatctgcttttattcggccagatggaggatcatttcaactttcatattactctggtgaaaattctgaagttaataatgcagcttctaatgaagaaatgagtgaccaaagtattccaaggcaaggatcaagtgaaaaaactgaaaatattgataagagtcatttatatacagtaaatagcaaatcttgtctttcttcagcaaattgtttggttgcaggttattttgatcatgttaacaagaaattatatattactccaatttcttcagtgcaacaatttcgtccaaatttctcatcaatcgatcagaaaagatcagcgagtacgaatgttggtatggtagaaagactatctgactcggctgataaagatgaaagaaatcaatctttggatgatttggttttaaaccatggaaacaatactactttagatcacgatatgaataccagtggtaataataacccattatattctggtaattttcctttagatagtggaagattatatacaactggatttgagaattggattaaaataccatgtatttatccatcaaactcatatgaatcactagaaattattaagatgctaatggatgtatattttgatgatttcatttcttggaataacttgaattctcaaatttcagaggaaaatcccatggttaaccaactattatcaatgaagcatagtagaaatagaactcacttttttgataacgacattgtaagatactttaaaatgatttctggaattgcttcggatattaattcagagtttaaccttccatttggaggagatggacaagtacttccaactttaagaacagcaggactaccaaaaatatatacggcttatcaatatccgccatgctgtcctaactcaagtcttggaggttctatgggctataattttggtggaattgatgattcaaattcaattgcactagctagaagtaatccaaataaatatattgatttcttgccttcccatggtatttctgggaagttattaatttatgatgattggctttattttggtccattatcggtccaagagctttataggatgaaattaagtgaccaaatacagagaattactctagtttatcaagttataccatttaatggaataaaaaatatcttgaaaaggatttatgatataaagcttgaaacgaatcttaattctgaatctgagttatctccagaaattgtaaaaactcaaaagaatgataatactattgaacaaatcctttctaagaataaaattgaaaaattcccttctgacaagaagttgattaaaatacttaaaaagttttgtgtattggtttctggaaattgggtatataaatcagaacttatgtacaatgaatacgagtcttgctgtagagatcttattttagttcttcttcagagagacgaaaatgctggtctaaatagagagccaattagggttgcaacagatcttccacaaattaaagtcaccaatattcttcaagaagtggcagtttataggtcaactgcatggtatccaaaattcttatttgataaaaaattcattgaagaaaatattgaagaagcctcgtattggaagaattattgggctgaaagagaaaaatatgtggttcagtacattagagacaatagagatacctccatttgtacttcaacatacctaaataatctttctgcagcttctacaagcgtgagcaattcacagcttcaattactcttaatttttattcttaagatatatggcgcaatgaatgtttcagaactcttgaatttatgttcatatcacttaactttaatgtcagtaggaaatgcgtcactagcatcaattccaagtaatattgtaggaagtgcttcattagcaaactcttcaggcaaacccaatgattcatcttctcagaatgtaaattcaggttctctttcatatggaaaagttggttctaattccaaatttaccaataaagccgcatccaataatttaatatcaatgccttctggtccttctttttctcagaactttattgctcctacttactcaccatttttctctagtaatccaagacataatatgaaacagattccgttc

SEQ ID NO: 3565 - DNA, 462 bp, Cryptosporidium hominis
atgaagaagaaggcagactttttaaatagactaaagctattaaaaagagatgataaagagcagattaagctattttcaaagttagtaaaggaattgaaggagccaaatatttatttattggaaagaattgtatattttattccgaatgaattagtatataaaacttttaatgaaacaaaaataattataaagaatggggggtatcctacagaagatagcactagattaaaaagtccaggtggcatattctttagattaataaggaaccaaatttctcatgaagaatacaagaaaatttggaatattcaaagacaaaaaaagaatcagagaaataaaaaattgtcacttagtaagatcgataataatgaagatataaaaggtgaaaaagatgatgaatatgaagatggagaattatctgaggaggctatattaatggatgacttaaagtgcatgtatttgtaa

SEQ ID NO: 3566 - DNA, 975 bp, Cryptosporidium hominis
atggttctatctgagagaatgctcaatcttcccggtaatgatccactttgttggatttggatcgatctggatggaactatcaacaatatgaattcattagaacaaaatgacgattttatgatgttatataataaatacctggaggacataaaagaaaattatgatgagaatttgaatgtatatgaaaaattttcttccccaattgaatctttatactatgaactaagttgtgaaagaatgccagacaatttggaaaaaagctatgaaagactattagatagcttaacaacaaagagaatgaaaattaatgaaataatgacttttgttgtagattattcagaccaacattcggtccaaatgattgaattattaatacaaagatttccaaattcaacctttgaagttaaggtttcaattttatattgtatttcagatatattatacaattctcactcttcaaagataggagcttggaagcttagaaattgtattatgaatatatttccttatctagtttcacatatatcattccaaagtaaccgaggaaacagttgttatattgatcttattaataaaacaaaaagtatcatagaaatttggatagattggaaaatctttcctttagaatatattgagggtttaagttcatctctttgttttgataaaatgctggatgaaatgaagaatgacaaaaaaactaaattgattagtaacataaatgatgaaatttccgatggtattttgcttgataaagatatagtttcaattctatcaatttggccaataaaatcaagacttccagtttggaaggtttggagagaaatgaataatcttttaataaacaaaagcttacatgaaccaaaaatcagacaagactgggttatgaattatggaatagtaattgctccgttaaaattatttggattgacaaattttttacacagaatttcaaactggtataattacagaaattaa

SEQ ID NO: 3567 - DNA, 612 bp, Cryptosporidium hominis
atgagaaggtataaaggtatggaatttgaatcaagtggaaagcattcaaatgttgaagaaataatacttagaaaaagaaaggaagcaatgattccgagaattattagctataattatcatttgtttaaattaatttctccaaaacttgctgagaaatggtatgttaacaaatatttagagttaagaacaatgggcggggtttactatgatattgcaatttttgattctaaaacaatttgtagagcattaaaggtaattacagtttcaatacctccaatattgttacatgggaatttaggaaaagacagggttggcgtggttatcgcaatattattgagcattttgggagttggagaagaatttattattagagattactgtgcgtcagaatctggcttactttcaattactgaggctatagaagctgaagtggagcattttccagattctgctaaggattcaaatcctgaatatataaggtattttctttcaaagatgaaggaggagttcggaaatatgaatgcttatttggatttaatcggatttgatgctagttggagatataaactatgcagtaaattcaaaatagtgcctgataccaatagcaattag

SEQ ID NO: 3568 - DNA, 2907 bp, Cryptosporidium hominis
atggaaactgattcagaaagcaaaaaatcgccaggtaaaagtattagggatgtggatgaggaggttctttcaattttactaaaaattgtggatttaaatccaaatagtgaagaggttttggagactattaaaattagtggctttgagcttgacaaggtgagggatttgctgacaaagcaacatccagaactatgtaaacgaagtcaaataaattctggagagatagtttctagtaaagaagagaccaatcaaattgagccaacagttaagaatgatgacaaaaaggatcaattagacaaaacaaataccgtatctactaataacagtgaatctgaaaaggttgtagagaagaaagataatatggaaacaattccagaaaagccaattgtgaaaggaaaacctcctggccctccgcctcctctaaaatcaaaatctgcattaagtctcaaatcaagtggtaatattggaactgagagtgcagctgcaagtaaagtaccaggttcttcaggaaagagagcgccacctccgaaggctcctcctcccttgaagcctcctcctaaacgaggggcaacatctcaggggtttggtgggccacctggagcttcggaccctgaaatctcagggggtctaaagcttgcagaaatggattttggtccctctccgcctttgggatttgaacccaaaagactacattggtcagtaatccctccaaataagatagttgggacaatttgggaagatattcatattaagatgaaagaaaactcgcaggatgcaaaagattgcaatgaaaacgatcctaatgaacttaagtttgacatggactcaatattagaacaattttttgaggataagagtgctttaatgcaaaagatcactatggattgcaacaataatgcttcagctacttcaggtggttcaaagaagttcagaatggttttagactcaaagaggtctcagaacattgaaatagcattgaaagctttgcagttatttgatagcagtaatgaattggatctttctccaattaaggatatgcttgggtatacaagacagagtttaataggtggaattgacgcttttttgaagggagtttctaaagaaaggcttaaaattcttttagatttgtatcctactcctgatgaaattcagctattaaactctatcaaagatgaaggtgagaaatcagctctccctttgaggagttcagagttctttatgattaacatactgggtttaaatagattcaaaattagagctcaatgcgttttggcaatgaaggcttttgaagaagaataccagagttgtttagaaaggctaataaagctagaagatgctgctgttcatattcgatcaagtttagaaaagggaggagtgttacgtcagattctaaagttaatcctgaaaattggaaattttcttaatcatggcacaagtagaggaaaaagctgtgggtttcgtttccattcaatagaacttttaaagaatattaaatcaaacaattcgaagagtaatttactcaaatatatttcgaaagttgtttatgagcactctgaggaaatgaggcaaaaagttgaagtaatttcccaatcctgttcggaagctgctcctattgatatcgccgatgtgtatagagatatggaggaacttgggagaagcgtgaatcttattcaggatgaactcaattcattttccactactaagtcagatgtttccaaggaagataaagaatcaaagagtcaagaattatgcagtggcaaggatgagaactctgactctagagataatattaaaaatgagctcaaaattgaaaatagtttagaaatttcagtatttggagtgaaaaaagaagtagaaaaaacaacagaagagctttatttggagattgtggatacttttgtgaagaattcttctaagaagcttgaaatcacaaagaaacaattaaatgaaataatagtaaaattaaatgagttacaatattatgcaggggagactcagacattaggaaataataacgcttccaagcaaggagcttcaattacaacatccagtggtgagataattaagagatgcgatatgttttttaggcttgttaagtacgaatttaatgaatttcaggcaatagaaaagaagaagaaagaaagggacctgcgaaagttaatgggagttagagggacaaaatctagtgaaagtttgccagcaataaaaacttcagatcataattatagtttgttgaaatcttccactagcttaactgaaaaacagagccaagcgatttctgaattctctcctattcatgaaattgagaacttttctccctcaaacaatattagtgaaaattcaaaccaattattattggaaatatcaaatattactttaacttcaaattcaagtactttttcttcatctgactcatcgttcttccaagatcaaggtcgtactaaaagcaagtcaggccaagccactccaactggtaacttagatcagactccattaaataaaaatagaaaagaatctgatgttatgaattcttctccatttaatcttaattctggttacgatccaatttcaagttctataataaggtatccaaattatttcaataatcaaggtttttgtgaacataattttgcagaaatttgtgacaattcaaatagtatttatgatcttagaattattcattcagatcctcagttatgcccttcttcctcatcttctgtttgcttacaggatcaaaatatacaaaacattggtcagcataaatctgtagttaataaccatcaaccaatacatttgaagtctttctttgatacaaactcaagcactgtaaatattgctgccaaagtttacaattctcaggttaaccaaagttcaagcaggtcaagaaatcctaaatgtgataattaa

SEQ ID NO: 3569 - DNA, 531 bp, Cryptosporidium hominis
atggcaaaatatttttcttctatacttattttcagtactatacctttgagtatagcaaatactttaagtttactcttctttagattggattgtttggatggtataatttctgagattttattactgaattacatttctaaaatgaagataaaaatgataaatattacaaatcgtgtatcaatctttcaaccaattcaagttattgtaatcagtatgttaattctatttggaatcagtacagcattaattattacattatatataaaattcaagcaaaataagttaagaaaaatttcgaataatggtaataatccaaattgcttaatttctaataatcaaaactattcaagagaagatcaagaaattaacttgaataatatattagatgacgtttatgagtctttaaaagttccagaatgcattgaattatattcaaacaaaaagattgagaatttggggaaaatgccccaaaagcttataatttcctttgcaatgcttgaaaatcataaattattaaacaaatataaatag

SEQ ID NO: 3570 - DNA, 3621 bp, Cryptosporidium hominis
atgttaaagaagatttttggtaaaaagaatgaggagggagaagatggtgtgaaaccagtaaaagctaatttaggagaggaaaataaattctattataataaggagttaaaaagttgggttgttcgtggggaagaacacttggtcgagcagaagcaaaaccttccacctccacctccaaagaggccaacaacaacggattctggtactaggacagaaagtatggcatctttttcctcaggttctcagagtacaggaataagaaagaatttatatacttctacacctggattgaatattatgaaaaattccaaggagcaaataggaggaataatacctgctgtaggctttaactcttcaaatgcaaatgcaactttatttggtccagttggtacgcctaataacaataattttatagataatttggacaatcaaagtggaaatttagaacctggtaaatacaatccaaaggatttaaatgaaaagcaaggtattcaagagcaaatccaggttagaagtgattctaaggaaccaagaagaacatctattcaaggaaaggaaccagagggtgaacatttagagttgagtccaagcagctttgaaggttattctggtgaaatttccgggtttggtcgccatttacaagaagatcagaatatatcagtcccgtcttcgtcttatacaaatttcactaatcaaagcagtgctaatacaatatcaataactaatagagtactccctcctataccatctttaccaaatgcagctatttcaaatcgtgatttaacatatggagtatctcaaagaagagcatctgtgcaggattctcctttatcatttatttcaactccaaatgtgattcagaatccaaaggatactttaggagagaaaatggaggagacttcaacatcccagaatcagtacattcaccaagagatttctggaaagcaagtttgtcaagaatttgattataataatattggaatttcaatccaaggtttgaatgaacagcaagaaaatatgatgatggaaagtatgagaaaccaagtagaggaaagcaagatgaactcaaccatttcaaatttagagagtgaccagactgaaattctatatactcaaaatgatatgagacaaagacaaagaataagaccactgtctcagagaagtgctgcttcaaacggtgtttctggattaattgagaagaatgaacaaatagatgtaattaaagaaaaaatggatataaattggaataaagcctcctctggaggtgaagttgtaaatcatagagtgagcaatacaccaaaaatggagtcatccattcttgagttgatttcattttttggattcaaatatgacgagaaatcccaaaagttattggataatttcgagtataatgagaatatgaatattaacgaacaacattattctgctcagaaagaagaaaagagaagtttaacacaagtttgtatagatattaaggaaaataagttaaaacaaatgaactttttggttggaaaagttttcaaaagtttacaagattctagtactgagtatgatagtttattggagatgattttgaatattggtaacattacaaataagacatttcaagaaatttcagggactgttaacacaataatgtccaatagtgatgagattgaaaaggagcttattaaaactagggggttgtatctagacttagttaaaaagtacaaggcaatatataagcagtacgagacagatatgataactttgagaagtgaattggaaaatgagaagaatatgaacattacaaattctaaagagtttgaggagaagttaaagagggttcaggatgagttttcatcaaatgaagcttcaaataacgaattactgcaccaatattattcatatattcaagatctacaacataggtttgaagagatgcaagagaatatgcaaggaaaggatcttaagattaagatctcagaggaagagattcagaagttaaaatctgaaattgaagaattaagaataaagttagaagagaaaaaaagagagtttatgctagcttcagaaaagcttgaagggtatgagagagaaaatcagagattaagagaaagtaatgaagaattgatttcgctttcaaaattgaatgaagagaatagcaaacaagaaagaatagtattaattgaggagcataaacaggagctagagttaatggagaagttcagtcgcgagcaagatgaacatattaatcaacttcaaaagagtataggtgacttaagtgaggaaagatctgagctactgaatcaaagtgaacagctaagaaatgagattatgataattaaagcacaagttgagaacttagtagaagagaagtctaagatagaggaggaagtcttgaccttaagttcacaaaaccaagacaagtcctcaagaattattgaactagaaagtatgattggaactgagtcgcagagaatggaaacagtttctagagaaatggaagaattaaaaggcttgaagagtcagatggaacaaaaaatagaggaaattgaaaaggaaaagattcaaatagagtcagaattaaggctagaaaaggaaagctcagtcgaaaatttcgagaaattgtcaaaagaattagaggaaatgacactaaagagccagagtttaatggaagcttccaaggatgaaatggagtctgagagaagaaagttgaaggaagagctggaatccaagactgaggagtataataagcatattaattggttagaaagtgaaatttcaagggttgatgaagagtggaggacaagacaaacacatattgaggcaaactatgaacaactttatgcacagtatatggatttgagctctagagaaggcgaacttggaactttacaggaaagggttaatgaacttgaatctgaaaaggttaatagaaatgagtacatttcagaattagaaacgaaattgaatgaaagtcaaaatgacaacagggtttcagagctagaggagaggctgaaaaagattgagatccagaatcaagacaattcagacaaactcaaagaatctgaggaagagattctgagaggcaaaatgtccattagtgagcttgaggctcgtcttgaatctgaaacaggtagaaacaagtctctaagtgatgaagttgaaagcttacagaattcaaatggaacttatttagctagaattgaggaactggagagaaggcttgaaagcactgagcaatacaaagactacatgtgtaaacttgaacagaggacattagaactcgaaagctccttagaagtaaagtgtaaggaatatgactcattagaagagcaacataacaagttgataaatgaaaacaaagaactcgaaagattaaatagtcatgaaaataatcaccaaatgaagcttgagaacgaaaaacttaaagaaactaatgaagcagtctatatcaaactggaagctttctccagagatattgacatgcttaataatcaacttgagtgggtcagaagatattccccacaagtatatgaagcaatgctcgaaaatacctatcaatattctgccccatcctttggtagtaatcccaacaatcccggtgctgaacatgaaatttccgatattgctctgtag

SEQ ID NO: 3571 - DNA, 825 bp, Cryptosporidium hominis
  misc_feature (313)..(313): n is a, c, g, or t
  misc_feature (339)..(339): n is a, c, g, or t
  misc_feature (478)..(478): n is a, c, g, or t
  misc_feature (527)..(527): n is a, c, g, or t
  misc_feature (538)..(538): n is a, c, g, or t
  misc_feature (574)..(575): n is a, c, g, or t
  misc_feature (580)..(581): n is a, c, g, or t
  misc_feature (587)..(587): n is a, c, g, or t
  misc_feature (602)..(602): n is a, c, g, or t
  misc_feature (605)..(605): n is a, c, g, or t
  misc_feature (608)..(608): n is a, c, g, or t
  misc_feature (618)..(618): n is a, c, g, or t
  misc_feature (634)..(634): n is a, c, g, or t
atgccggatgacgggaaaaggcgggccgcaacacggaacacaaggcgaggaaaagccacgcttgaaaaggcggacgacgccgaaaagacacacggggaaggggcggaaaggggagacgagctcgagatacggaaagggaacacagatgggagaggagaaaagaaggagacgggcaagagcatccgaacagaacagaaatggagaaggaacagggggcgagccggcgaaaaacgggagagagcagcgaaaaacgaccaaggcggaaagacagcggaggagggcaaaaagagcggaagggacacacgcacaaaanaactggagcgaagaaagaggcgcccngggggggaggacgaaagcgacgggagcccgccggcaggagaaggaagagcaaggagcagaccaacggacgagggggcaaaaccaaagaacaccccagggagagggaagaaggcgggcagaggggccgggggacgcggcnccgccgagggagaccgagcccgaacggggagggagaataaggcaaagangagctgggggncggccccaagagagaccaggcggctccacaaagagnnggagnncaaggnagaagaacaaagaanaancanaaggcacacnaccaacaggaccaacnagggtaacaacaaccacctatattcaaatattcacagttataaaaactttaaccttaaactccaactcattttgaagccgtcctggtatattcgagtagtcatactgtttttctctactcgagaagccttccatggacggcctctctatattacgcccagtatgcatttactcagtcttactagaaattaa

SEQ ID NO: 3572 - DNA, 4806 bp, Cryptosporidium hominis
atgcatactgggcgtaatatagagaggccgtccatggaaggcttctcgagtagagaaaaacagtatgactactcgaatataccaggacggcttcaaaatgagttggagtttaaggttgagggttttagaagaaggattatggagatgatgaacagtaccgaggggggtacgaagaaccgactatattcaaatattcacagttataaaaactttaattttcgaataatgattcttccaaaggttaagttgactagtggaggttcgttagaaggtcatatttctgcgtatttggaggcaatcccatcgcaaaattggccttcaaactgggtatggttgaatacaagatattctgtgaccttaattaaccaaaaagattataggaaatctcactttatgagtgatatattcagctttaaaggagaaaatgacccaaagaagaaacttacattggaggagagaaattatgactatagctctgcaggtccagaagctgatcgtggttggagtgatttttttagcttaaagactctcttggatccgaaaactggttttattgattctgagacagaaacagtaattttcagagctggtgtatttccagttttatgtgatccagtttcgtgtggaaagtcaagttttgaccatttgggtactgatcgatcactaactggatatgttggaattcgaaaccttggagctacatgttatatgaactccttactacaatctctatatcatattggaagattcagaaaagctgtctatactattcccctgaacccaaatagaatcacatcaggctcatcatgttctaatactccgataagtagggaaacaagacctgaattaactcctatgagtgcttgtattcctaagatagatgatttcggagaggttactcctcaaagtattagttctgaatctaatagccttgccatttctttattgggagaagcctcagaggatgctatagaatggaccagtaatgttgcaaaaagtctttttgagtatgaaagtgatggtattgctagtcttgaaagtattatgtcttcaaatgcatgccaagattatggacagaataccggtgtagtaagcggtaatgtatctggcccaggatctacaataggaggaaactgctcagcttcggatgccggaaatgatcaaacgaaaattagttctgctctccaaaccttattttacgaacttcaaacctgttcagaacctgtgaattgtcgcgaactgatgagatcttttggctgggatgcttcagatgcattcacccaacatgatgcacaagagttaaatagactactttgtgaccgtcttgaggaggaaatgaagaatactgctgttgatgggagcattaaagctctttttgaaggagagtatgaaaattatatcgagtgcttggatgttgattgtacttctagaaggagagaaaacttttacgacattcaggttgatgttgaaggagtaaagtcattagaggaaagtctccagcgttttgtagaggaagaaattttggatggtgaaaacctctatgaggctgagggctttggaaaacagagagcaaagaagggagttagattccaaagattcccacctgttgttcagttccatttaaagagattccaattcaatattcaaagtatggatatggtcaagttgaatgattactttacttttccagaaaaattggatctatctagctttgtgaatcataataataaaggagaaacagatactggtaatattgtagaaggtaccgaaaagtatatattgcatactgttgtcatacatcaaggggatgttcatagtggacattattatgcctatatacgtccaaaacctgattcagactggtttagatttgatgatgaaaaggttactctagtttcatcttctacagctattgaggataattttggaggccatgagtatgaagtttgggattatttgggaaacccagaaagtgatattccaaaaagatccaaaacccactcagcttacatcttggtatatgttagggaggaccaagctcaagatttgctttcggagccaattcctcaggaggtcaatcctgatttagtttctaaatacaagaaagagattgagatgatgaatcttcgaaagagacttagacaagatctgaatgagcatgttcgaattcaattattgttatcaactagttataatatctcatcctcttgtcgtccaaaatcccaaggtcttcatcaaagcatttcatcctttccatggaactacatattcaaatgttcaagggacttttctttgtctcagtttcattctgagcttgaaaagagattcttgaacaaaaggatgcttcataatgatgttcctagtagtagtgttagttgtaataaagcttttggatctcatttattcctgttggaaaccaacccggaggggaaccacactgcttcaggaggaggaagaggaatgggtggattacatcatcatattggatattcaaatggaggccctacatcctcaacgggtctatctttttatacatgcatttcatctccccaaggagagggaattagctctggaaaccggatatcagattctcaaagaggtggaatgctaggtagagctattggatttggaagttcaacttctggtacgagatcaggagatgagatcttaatgtcggatctatgtagaagataccatcgtgcaggcctttgggactcatcttgcccaactttatatatgtgtttgtatcttgatgatgtctcaagtttattaatggaccgaatccctccaaatttaccaattaatgcagatggttcatatttagagaagaggcagaggattgaaaacaagctcagaaactttaatgataatggaggagaagaagttttgcttctcttgagatattttgatatttcaaaccctaggatcaatgaaccctctttaaaatactctaaaaatcaggagattccaaatctttataatctaggacttatcatggtttctcaaagcaccacacttaaggatttaaatgaatatgtaatgatggagatagagaaagataaagataacaaaccaagtggaggattgattagtggctttgagtttggacttagagtatgtctggaaacggctttagatagtgataatttattcccattattggatcctcgatgtacaattcaacaacttcagcttatcaatggatccagtttaatcttttcaataaatttggatgattcagtaattaatagaaagagagaagaattgaggaaatctcttgaagaggttgtgatcttcccaaatcaaaacctttggttacaagaggagaaaacttctcaatataatagaattgaagatgaaggaaaatcttctgaatcggaagattctagtttcaggcttccagtagaactagagatggttaagtgcccagaatttccagttttggactttcatcactggtatgaaaatttccagaattctctccatctttctctatatctatgggatcctctagatggtgaatatcacccgcctcatttgggaggaggaggaggaacgcatttgtgcctgcctaatacaaatcaatatggaataatggaagccatgcaggcgagcaataatagtataatacgctcgttttcaaggtatcaaattaaagaagttcatcaaattcatgtggatctccgctggccagctattaagacttggatttatgtttgtaatcaaatcaaagtagatcctagaagtattgctttagcaagaaatgcactaaatccactagatgcttctttgctaactttattctctctgattcaagcccagagacatgatgaatcgatatcttcagtaatcagaagcttaagttcagcacattattatggaaaaataccacgttatttagctatcctggctctaaatctgaaaggtcactcctttgttagtttaaacagaaaagataaacatattctaactgtgaccaatactgtaaattgttctgaaatacctaaaggaagatacatccttcaggtagaatccagtgatactgtggattcagtcatacgcaagttaataaagaaggaaaatattttatctcacaggtcctttaatgccaatggtaaggatgccatgcaaaccggaaatggcgccaaaagtcacacagacatttccaagcttaaatcaagattattcgaagcgagtaaccaaaatgatcatgttggtgtatatcgaggaggggaaatgataacaaggattttaaacacagatggaatgcaaaatacttctacttttggaggattatctattggctcttttgtggattgctttaggattgaagaagattattcacaagaagagttggatttacttaaaaaaggagagttagtaaatattttggttattcaggattcaaggagtggttttggcgggaactatggagatcattaccataatgatgatcatcacaattcattagctggaggtacaagttatttagtaacaataccagtaagttcaagattggtagatttaaagaataaactacaagaaaggtttgatttggacgagaagataatatccaaatggagattttaccgtcttgagtcaaagagtcttcaaggaattaaggataatgatttaattatgaatagttttggaaataatggtgttggtagtaataatcactataccacaaatgcaaagaataacgtggatattaatatatatggttttgagcctcatacaattttattggctcaacaagtttttccaattctacaaaagagtggctctagacctctgagaatttaa

SEQ ID NO: 3573 - DNA, 654 bp, Cryptosporidium hominis
atgattgaaactcaaaaaaaagttaatgaaaggtatcgattactattaaataatagccaaattaatcaatttactaacgattccgatatttctggagaagaaagattattatctatcttagaaactttgggtctagaattaacagaaaatggtatcattaatattcctaataatccacttgttaatacagaaactggaaataattctgataatgttaattccctaacatttattaccaccaccaataatagcaatttcttgaatactcttaaaagtaacataaaaagcgagttaaagaagttcgattcagactttcaaatgttatatggaaaactaccatcaaaatccgacaaagaaccactcaaacccttgtatttactatacaggcatctcaaggattcaacttatcaggccaaaaatcattccacacaagatctaatatcagaaatagagtctctaaaacaaaagaaaactcaactaagaggattactggaaacatttcaagatcaatttctcaaaaaaaaccacagaaaagttctatatcacaaagatttactacctatagaaaaagaatatcttgagtataagtcgatcaagaataaaatcaaacaacttgaagatatatactcaaatcaaaagttaagctccacataa

SEQ ID NO: 3574 - DNA, 1152 bp, Cryptosporidium hominis
atgcagaatgtttcagcattatgtacggtatgtgattacaagttggatagtacaagtttattgagagaacattataagacagaatggcataattacaatcaaaagagaaagttagcaaataaagacccagtatcagagatagcatttaagagaaaaatagaactattagagtgtacaaaggtggtagtgaataaaggtagttcacacattaagaataaacaaaagatagatggacaagaaaattataaaatgaatgaaagtgtatcggtagatatgaatcaagataaaccaagacaatctgatacttatgaattaacatattgttattttgataatacaatacactcaagtatggaagaatgttttgagtatatgagaataaagtattcatttataataccagataaagagtatttggttgactataaaggtttagctcaatatttgggtgaaaaattgtttgaaggtcatatttgtttatattgtgataaaacattttcaagtttaagagcagttagagatcatatgataagtttgggtcatacaatgttaggaactcatttagatgttcaaaaagaagagttggaaagtttttataattattctttatcatacaaggaactaattccaaattttaataaattatcaattactgatgatgttcttaaagaggagaataatgatgactgggaatacattgatgaagaagaagatgatgatgatgatttgagtgacaatacaaatgaaattaggaagtcaaataaaaaagaaatgacattggatgaaatttttagtatgtataatttaagtaagccagaaattactgaatttggtgatttaagacttccaaatggaaaagaagttgtacatagaaatttagcatatatatataaacagagaataccaaaaaaacatcaatttgaaatggaggatgaaaataattcaactcttgttttaaaaaatagacatcacaataaaaaaattaatatttatggaaataatcaatttggcttaaatttgaaatttaaagataagtcacatttgaagcaaaatctacttttaagtaagagaattaagaatgttaatttaaaggttggggttaataataataaattacagaaatattttgtaagaagagatgttgtttggtaa

SEQ ID NO: 3575 - DNA, 570 bp, Cryptosporidium hominis
atgattaaagacccagaattaagaccacaaagacataaagataatcctgtagtctttttggatatttgtttactagatgaaaacaataaaattggaagactagtaatagaattatttcaagatattgtgcccaaaacaagtgaaaactttagacaattttgtactggagaatataaaaaaaacttaaaaagtgtgggatataaaggatctgcaatacatagagtaatcaaagactttgtaatacaaggtggtgattttgtaaatggagatggtactggtagtatatctatatataatacaagctattttaatgatgaaaattttgaaattaagcatacaaaacctggacttctttctatggcaaataatggtagtccaaatacaaatggatgccaattctttattacttgtaatacatgttcttggttagataataaacacgtagtttttggacaattattaggacatgattcttttgcaactttgaaaaagattgaaaatgccacagttttacctccaaatagtaaacctaagatacctataattatatatgaatgtggacaattataa

SEQ ID NO: 3576 - DNA, 1683 bp, Cryptosporidium hominis
atgagtaataggagaccatgtcaattctatttgagaggatcatgtagatttggtgataattgtagagactatcatccaaatggatctatgtttgatcagggtatcaatagtagaagtggtaatgtattgagtggtactactacaagtgggtttggagtgggaggaggtcagtttaatccattttctggttctattggtaagcctttaggtgatatgaatagttcatttacttcaggaggaggaacaggtatgggtccatttgggaattttggaggtccatttggaggtggtggttcaggagcaataggagtaggtaatagttcttttggtggtggggcaacatcaaatccatttggaggtgggaatacatcaactacaggattcatttttggatcaagtccatttggaagttcagttagtggatctggttcttcaacaatatctacaacagggcctacaacagggtctatttttgggtcaagtccatttggaggttcaattagtgggtctggctctacatctgcaattggatccagtccatttggatctgtagttggtggatcagggtcaatatcttcttcttcttcttcttctacaggaaatgttaagccatcaaaatctgataacccaacattacagattttggaactcattggagtagttgttaatagtggagtgtggccatttggaaggataggattattaaatcagtctcaagattcatctaattctcaggtatttccaagtttggatttaagtattgaagaatatagatggaagttttatcagagtgatccaggtaattggaataatttacatttggaaactttaagattactaacacaacaatataattcgtttattgaacagggaaaaattcaatcaaaacttccagctacacatcaactatataatttagactttagtttatattctaagattggaaactggtatttacctaatttaggtaaagactatgtaaataagcctaataatacaaatactggtgctactactaccattaatactaatactaatactaataatactgctaatactattggatctataacaaatccttttggaggtacaacattaggatttggccaaggaacaggattacaaagtaataattctaatacaagtccatttggagtatttggatcttcttctgcttcatcttcttccattatgtctaataatgctttgagtccttttggaggaacaggaggtggtaatggtattggaagtggtatagttaacaattcagtatttggtattacaaaccaatcacaaatacagtcacaacaacaacaacaacaacaaacatcacctttttctggtggtaatattcaaacaaatataaatcaaccattttctattgaaagtaataataataataataactttggtatctttggatcacaaggtaccggttcaaatatatccaacaattttaataatatttttggaaatataacaaatcaacaaaatcaaacttcaaattctggtggaactaatataaagtattcctataataacccagatgtgaatgatgataatcattcatttaattctcaaaatttacaagaatgggaattgaatgcatttaaaagttcaacttttgaagaaaacaagattcctgaaaaaatacctccaagataccttagaacgtatacttga

SEQ ID NO: 3577 - DNA, 975 bp, Cryptosporidium hominis
atgaaatctagaaatagtactaaaactcaaatagagacagacttcgtctccgaattcatttcagaaacagattcttcagaaattgaatctaaatttgaatctgaaaagaatgaggaattggacaagaaggaagaggaaaaagtaagtaagaaagcagataaagatgaagtgatagaagtgaacaaggaagaaaaggcggatgaaaaagatgatgaggagaaaggagaggaggaagaagaagaagaagaggaagaagaagaggaagaagaagaggaagaagaagaagaggaagaagaggaggaggaaaaagaagaagaagaggaaaaagaggagaaagaagaacccaccatcaaaatagggctttgggacttttgccaatgtgacgtggctagatgcagtggaagaaagcttctgaggtttaactatgcaaaaaagctccaatttagtagcaactatgcaagaaagtggccaggaattattttaagccccagagcaaagaagaaggtttcaatggaagatttaccactaatattgaaaggaggagtaggagttattgactgctcatggaacaaaattgaccaagttcctttccataaaatacataatggaaatgaaagacttcttccatttcttgtagcggccaattctacacattatggaagaccttatgagctttcttgtgcagaagccatttcagcttgtttgttcttctttggatttcctaaacaagctgagaaacttcttggaatctttaaaggcgggcaccactttctagagcttaataaggaagcatttgatttttataaatccaaaggaataaactcccaatcaataattaatgctgagcaagactttattaacaagtatatgaataagcagcaacagagagagtccagagactatgattccctcttttcctcgtcctacgaagatgatgattatgatgataatgatgataatgatggaaaagcctaa

SEQ ID NO: 3578 - DNA, 1317 bp, Cryptosporidium hominis
atgaatgagataatgaattcagctaaggttgaactaccattagcaataacaaatggatttgattatcaaaaagaatttaaaaaggtaccgggagcattatgggtacaagaatctatgttatttaagatttttaatgatgaatgtgttcatatcccatctttagagactcagccattcccattatgttcttgtaggtattttgaagaaaatgaaagtgtggataagaatatgatgaatgattataatcatttacatttagaagaagaaagtatagaaggaatcataaataagagtagaccagtttttgatataataggagcaaaggattacgagtataatattacattagaggagtatttatcttttgtgaaagaagatagtgaggaggaggaggagagagacagggaggaaaggagagaatttacgggagagaaagataaagaaaaaggaaacggggtttatatattgaatgatacattaaagttattatcagatagtataattgaattgcctttaactccagtttctgaaaagatggctgagaattatttaaagtataataagtatttgggaggtaaatttaatgataagaaaatattaaagaagaaatggaaaatttctcaatcatgctctagaatgaggcaaccaggttgtttgttgaaatatttaataattaatgaattggaggttaagaaggcatttcgtgaggaggaaattttgagggaaagagaaaaggagaaagataaggagaaaaaaggggaggaggatttagaaaatgatagaggcgacaatataactaatttggacgaaaatgaattagagaagaggctggaggttgagatggaagacttggaggaggatttagaaatagtaggagagtggggagaaggagaaggagtagaagaaggggagagaatagagggagaaggaatagaaggagaaggaacagaggaaggagcaaaaggaggaataggcgaaaaagagaattttgaagactttattgatgagagcgagtatgaaggcatgccaaatttaaaaaagaatattctacctaatagaggaatatatattaatgagaaattaataaatacactaaaggtattttgggatgaatcctgcgatttctatggactgaatagaattggacatgaacatggagaaaaacaagctacaatagatttacttaatgacgatttgtctcagtggcacaattatccatatatatcttttgaaagcgtggatgctaatattgaagaaaaagagcagctcaggctatcgttaatgagttatgttgatactcagttgagtaacgtttag

SEQ ID NO: 3579 - DNA, 2376 bp, Cryptosporidium hominis
atggaggaactaaaactaaataatgcaaacaatagtaattattgcgaagaggaggagatcgatttatgcgttaatgatgaattgagattatttgacagatctaactatttggaaaagtatgagagttgtgatgattcaatgtattcaacttcgacagggtttccttcttgcgatggaagctcaaagtcaagtagaaattacaatagtatagataatttatgtatgttaatgggaaatggaagtaatggtgttattaagccaggaatagtaataagaccaggagatgagtggcagaaaatggctaatttggaaaatgttaatatcgaaaatattttaagttcaaaaaagagaatgataaatttgaggtatgaatggttcattagcaagttaatggatttaacaatgatgaaaaagttactccctagtatgtcaaaagacgagtataacaaattctttttggcttatttatcatatttagttttgtattcaacaagaaagccgttttcagttgttaagttacaaatacaagaagatttatcactttctacatctgttttgggatggatagatacaacttttttgggttcttatgcatttggccaattaataattccgacaatgtttgaaaactttaaagtgaatgagtacatatgcatatcatttatttgttcagctattacatcattaatatttgggatttcttatagctcaacttctcttttgttatcttggtttttcaatggtttattccatgcaggcgtatatccaatgctggttaaatatttaataacttgttttggagtgagtgaaagaggaaggattttaggcgtttggacaacaagccaacaagttggagcaatggcttctacagcattttcagcttcaatttgtttaaagttaggatggaggtctgtattttatattccatcaatttttgtttttctttttggaattatagtattaaagtatttaaagaaaccaaggaatttatatatttacgataatgtaggaaataaggaattaaacgaaaataatatggttttagtaatgatggaagactccaataacaacaaagaagttaataatgagatacagttcaatagagaaaaggaactagaagctattggtataggaaagcctaccaaaatagatagtgttgaaaaagaagaagattatgaggagttgggaagtattgcagaaggggcacatcaagaagagatagaaaatgggatgaccaagtacagtagcaacttattagattcaaggagcaatcttttgctggcttcttcatctcatttgataaatggagaagaagaagaagaagaagaagaaggagaggcttatttgaatgaactagacaatttaggatttgagaaccatcaaattcaagacatgtctgcaaattcaagttcaaatagtggaagcagtagtcaattattagtgcaaaaaagtctttcagagaaggaaaacgactctaggactgatctacatatggaagatggagataaattcataaatgatggctttggtacatcattaagcatagaaaaatcagaatttagtgatcatttaagttatatttcagagctctctccaacaaaaaagaatagaaagcagttaaacaataaggatacaacaaatagtagtaatggagattttacacaggatccaaatttaaaagaaaataatgtggaaaataatatctactcttcatttgatattcaaaatatggacgatgtaggctttgtagagaaattaataatattattaaagataccaaatatattaaacatagcaataagttactatttcataaaattgattagatattcaatgctattttggttaccttattatttaatacgtgaattaaattatggtccttcagttgcaggatactcatcaatgctatttgatattggcggtattgctggtgcaatttctgcaggtgcaatagctgatacatattttggaggaaaaagaattttggttgcatgttatatgtcgatatttgtttccttgagtatatcatatttcatgataatcacaaaaacaggattaaatttacctattttatttggtattgcttttatgggattctgcgtttcgggccctgatagtattttgggttcaactgcagctcaggatgtttttgataaatctaatattacaactaaatctattgattctatggcaacaggtattgttaatgggttgggagcatttggtgctgtcactcaaggcactcttactgcttatattagtgaatattatggatggagtgctcttttcctttgtttattacttttttccactttttcatttctaattttgattcctgcatcttatactaaagaacaaaagtcactagtataa

SEQ ID NO: 3580 - DNA, 753 bp, Cryptosporidium hominis
  misc_feature (750)..(750): n is a, c, g, or t
atggataaaagtaaccaacttaaggatttctatcctttgctattggatccattaaaaggtttgacaggcttaaatagtataattaatattgatttgtacgaactcttgattctttccagctcacaaagacttttactactttcaaaacatgctccaattttggatgatctaagtagtaaaagagatgagcgtttcccaatggataatgtagctaaagaagggtttgaactacttaaaaagtgttcaagaagcggatgtttgttaagaaaagatacagatattgaaaacaaatcattacatgttgaaaaaaatgatttattaagtgaattatcaattaaaagagttgattataatagagctgataataatgatccacatattaaagttaaaagtaataatactggtgattacaaagaaatgactaaaaatacagatgtgctagagagtaacttggactcaataatcaaagaatatataaagaaaaatcctctttctttaggaaatgcaacagatgagagtcttacaatagaagaaatcacgaaaatggtagggttttggggtgagaaagtttcttttgaagccataatcccaaatgcaatctcacgtaagctgactttgaaatctattgatcataatttaattgaagattacttatctagaaagtttgtgaataattatattcaaaacgaagtaatagatatggaagacttgaaagattggacaggaattgaggatatgaaaattgaggantaa

SEQ ID NO: 3581 - DNA, 1431 bp, Cryptosporidium hominis
atgaaattagaaaaagatgttaagagcctgaaacggccggaagtagatattaaaaataaatgtgagcgatttagagtaaaagattacagctttccacaccagtactgccacttatgtttttcaagattcatgagtttgcgtccatttttattgaaagcagtacaaagaaagtggaagtgtcatctttcagtagagcaggaaaaagtagaggagaaaattgcaagtcagggtaaccctgaggatagattgatacctattttaaatgagcttaaagatatgaaaatggagtctgaatgcattatcatggggtttgtgacaaaggaaatgaagaatagaccaacaattttggatgagtatcttcaagatattgaggagactacaaagaacagtcaattaagcaattatactagtaatgatgacaaggtttatatagaggatagttcatcgagaattccattgactctaaaagaagaggtattttcagtgaataatttgatttctggtaccatactagcagtaaggggagtacaaaattcagggggtaactttctagtctcggatttgacttttgcctctcctcctgaagagatcattggaaaagaatatacattagggaagtcttctcagccagtatatttggcttttgtttccggtttgaatataggatcagaaatagagaattcattatctttacaattatttcgtgatttcattatgggagtttcttcatatagtagcgaacacagacttttatcatcacaaattgcttacttaattatagcaggaaacattatcagacttttagatactgcaaaagagactgttactggtactggaaccaagttagttgtaaataatgagttgctttcaagcaggcttggcgtggttgattcctttatttctcagctggcttccactatatctcttgcgatcatgcctggagaggatgatcctgttccaatttctcttcctcaacctcctttccagccttatatattcaaaaattcaagaaactatcagtcgtttaattctttcacaaatccttgcttgttttctattaacaatataagagtaactggtgtttctggtcaatgtatttcaaagatttctctattttcttcatactcgaagcctattgatgctctcaaattttgtgttgaatcaagaaatattgctcctacatgccctgatgtaatacctacttacccattcttcgatcgtgatccttttgctttggattataccgatgaatcttttccacaagtcattttcgcaggaaatcaatcagaatttgggtcatatagattccctaataatggaccattatgcttcaccattcctgagttctctaataaccctactttggtgcttttagatataaattcatatgaactcaaaacaatatctttcaaaacaagtctttcaatataa

SEQ ID NO: 3582 - DNA, 582 bp, Cryptosporidium hominis
atggaagttgatggaggaattctaggtattgaagataaaatcgaacgtgatctaattaacctccatattaacagatcaactaatatgctcaaaatgtacctgaaacagagaataatgaagatttcagaatttcctgatttctctattgctaattcaagaactaataacgatctaaactctgagtcaaatattagtcctgaagaagctattttcgccttaaagctttccaagcttcaatggaagtatttagatgaaaccatctccaagatgaaaaataccctggcaacagactcttccgtcccaattccagccccatccttacatagatccgtcagattcaaatgcattgactccattggaagagttcaattacaatctcttgtaacccctgaaaatgtttcttttactcaatttgatgctcaaaaccacttttctcaaaatgattcagaaggagtcatcaatattgaaaagggaaagatatatacatgtaaatatgaagatgtaagaactcttttggaccaaaataccatccaactttggccttggcctcccattactagcaacaaaaactacttttattag

SEQ ID NO: 3583 - DNA, 681 bp, Cryptosporidium hominis
atgtacagagaacaatcatcaacagtcttggattctcctatgaatggaggtagtgctaaacttggagcttctggttcatcatctatgagctcaaatttcactagaatggacagttttaatcgatcaggaagcaaaacagggtcaattgcaccaaaatcttcagaatatggtccaacagtacagcagattttggaaacttatgagagtcttagattgaaagctcaaggacttgctaagagaaaattgagatcctgggatggagacttcttttgcctttcatctttccaaaaagtatcacaaccaaaagaaattacagatcgacttgaaaggaatcttcgatactttttactaaattatattgtaattatactgggtatgactatgctctctctaattttgaatcctatttctttaatcattattttaatatcaaccttttcttcagcttttgtagcatctagaccaacagatatggtagtattgccaggagataatgtaattagcaagaaagtggctctatatgtgatagcaggaacatcaactgtggtcattcttgtattttcaggagctctattattcacatccttggcagtatcgctcattcttgtatgtatccatgcagtcatacacattggaaagtctaattacgaccaggttgcaaacttagagagcgaagtataa

SEQ ID NO: 3584 - DNA, 639 bp, Cryptosporidium hominis
atgggagaaacaaagagtatggatatggatatggttgaggagagacggactgaaggaccttttaagcctttaactggaacagaagttaacagaagtaatgaaataagaagagtgatggttcctgaaaatagaatgactcctttaaagaaccaatggatcaatattgttactcctttggtagaacatatgggattacatgtaagaatgaatacaaagagaagatgtgtagagcttaaatatgggccagattgcactgatattggatctcttcaaaaaggagttgactttattaaggcttttttacttggatttgagcttcaagatgccattgctcttttgagattggatgatctttatatagaaagctttgaaattaaagacgtaaaaagattgaatggagcacatttatcacgttgtattggtcgtatttctggtagggatggtaaaacaaagtatgccatagaaaattcaaccagaactaggattgtcttagctggtcagaaactccatttaatgggagcctttcataatattaaattagcaagagatgctctatgtagtttaattttgggaactcctcctggaaaagtctacaaccaccttagaatagtctctaaaagagttcaggagaagctctaa

SEQ ID NO: 3585 - DNA, 1215 bp, Cryptosporidium hominis
atgatgattacaaaaggaggagattactcagaatattcagaaatacatacacagtatattgagaaatataaagattgtgatgaagaatgtgtagaattaaggaaaagtgtgagagaatatctcgaaaaagaaaacaaaacaaacttatacttttcagaaaagaagagctatttgataaacaaagaatttatagatattcaggtccaactaaactcacaactttgcccaaaagttaaactttggaaacaaattgaagaaccaaactcaaaagaattctccaaattaaaaaataacccaactcaacatctttttgcaattaaaatctattcaaaaccccaactcatacggagaaacattgtctattcttcagacgggaaaatcaggacccaaatgcatcgtgtaattaacgagatcaagattctacaattccttgcaaaaatcaatcccacatactactatattgctaaattacacaaagttcttgaatcttctccttctaccttatcttccggaaaattgtatctcatctttgacttttttccgattggacccacaatggcgcccgacacaggggcaaggtgtgagcgcgcgcgctcagggtttgaaaagaatcttttagtgtatgctccaagtcctgcattagagaggacagaggtaagtataaggagaatggcttactgtattggagtagctctatctagacttcatgagttagggattgtccatagagacgtaaaacctgataatattatgcttgcacatactggagatgcatttttgaatgactttaattctgcagaatttttaattcaaggtaaatatgttcagggcactgaaggaacatatgcattttttcctcctgagcattgtaatataaacaataacagcaataaaattgttactgaaaggaatgaatcatccgaaatcaatgaacaagaagaatgtccccaatctacactccaattgggatgtccagcagatatgtgggctcttggagtcacaatttggtgttggttttatggtacattaccttttcaaggaaatagtattttagagctttttgacaacattacaaaatgtaagattgagttccctagacagcctactttatcaaatgagtgtattaatgcaattttgcatcttttagacccagaaccaaattcccgttggactgctcgtcagtttcttgagtccgactggttttctaaaaactaa

SEQ ID NO: 3586 - DNA, 1482 bp, Cryptosporidium hominis
atggtaacttcaggccaggcttatgaggcaaatgtagcagcagttacacgaaactataatatcgctcctagaatggagtatagaacagtttcaggagttcaaggtccattagtaattttagataatgtaaagtttccaaaatacaatgagattgtaagaattactttgggagatggttctgttagagaaggacaagttttggaggtcaaaggaagcagagctgttgtgcaagtatttgagggtactacaggcattgacaatcaatcatgtagagttgaatttactggggatgtattgtgtatgccaataacagaagatatgttgggtagaacatttaatggaagcggaaaaccaattgataatggccctccaatttttgctgaagattatattgatattaatggtagtccaattaatccatactgtagagttcatccaagagaaatgattcagacaggaatttcagcaattgatgttatgaactcagttgttagaggtcagaagattccattattttctgctgcaggacttccacataatgatattggtgcacaaatttgtcgtcaagcttctctagtatccggaaaagatgttatggatcattctgatgataattttgctgtagtatttgctgctatgggagttaatatggagactgcaagattctttagacgtgattttgaggaaaatggttctatggaaagagtatgcctctttttgaatttagctaatgatccaactattgaaagaattttgactccaaaattggcattaacaacagcagagtacttggcttatgagaaggatttacatgtatttgttgttatgactgatatgagttcttatgcagatgctcttagagaggtttctgctgcgagagaggaagttcctggtagaagaggttatcctggttatatgtatacagatctttcaactatttatgagagagctggaagaattgagggtagaaatggttcaattactcaattcccaattttaacaatgccaaatgatgatattacccatccaattccagatcttactggttacattacagaaggacagatctttgttgatagagctctctataacagacagatttatccaccaattaatgttttaccatcattatctcgtcttatgaagtctggtattggtactggtttaactagagaagatcatccatcagtttctgatcaactttatgctaattatgctattggccaggatactagagctatggtagcagttgtaggagaggaagctctttcagctgatgatttattatatcttgagttcactagtaaattcgagtccaagttcctttctcaaggtccatatgagaagagagatatctttgagagtttggatcttgcttgggaacttcttagaacattccctgaggatatgcttaagaagattaagcatgatttattacaaaagtattatccaagagacaattatattcaacattctaagtaa

SEQ ID NO: 3587 - DNA, 1446 bp, Cryptosporidium hominis
atgccacccaaatcaaaaggtcagactatccaacttagggacttgcaaagaatggcatatgagaatggggaagtaatggaaggaattttgccaactcaaagtcttggtcttgaaagaactgatagttataatagtaatagaggcggtagtagaatgtcgagtagatatgataatgatgagaagattgctcaaatgcttgaaacagactggagaaaaggcagagatggtggtgatcttcaaagaacaaactctaaatccggaagagatagatttaaccgaccagatatcgatgatgcaatttataataccaattggagagatgatgcaggtagatccacagaaaagccaaaacctgagctggattttagaaggggtacatctaaaaactatgataactcttctgaacccagctcaatcaacttcaattggcgagatagctccaattctgcgcaaagtggtacaggatcatcttcaagttttggatcaagatttggacgtgaaaactctgctaaagtgcatgttgacgatagaccagactatctgaagaatagatttaagaagaggactgatgttgaaaataccactcaaagtaatggtagtaataatgttaccaatagctcaaatattgataatatttccttttctcaaaaacttaatatttcagatcccaaatcatcatctaatacggctagtaacccttcttcatctcttaatggtattttgaatttgaataataagccacagcaatccaataatactcaaacaacttccaaggttgagaagaaaccaaaacaagttaagaagattcaacctgttaaggaaacgaaaaaaatcgacgattctgaaacaaatcttgcattatgggaagtttctgatccaataattttgaacacatttgaaaaagagttatttgcattcttaaccggagagaccccaagagaaaattcttctccagcttccccaattgaacctaacacatactcacccccaagttctgataaaatacatggatttatttcaaactttgtagaaaaatccatttctcctgaggattcacaatctctttcaattattgccaagctttctcatgtatttactttattctcaactgcaatgcgttgcattgatgacgttattttactctctaaaagtctctcaccaatatttaatcactttattaccaaaaacaaagcaggagaagctactgcaaagctttacatccttattgagattcaaagaatggcttctgtgatcggaaatccgaaagttgataatgttactagtattcttgagtctctgtggatttcacttttaaaatccagaatcgtttctagagatacattcaatctttggctaagtaagaatgatcttttaggtgaagatagcaagcttggaagaaaaaacgctctctttgaggtaagtttattcttttttggagttgattaa

SEQ ID NO: 3588 - DNA, 330 bp, Cryptosporidium hominis
atggcagatccaagtgctatgcttaattataatgctgaactgatgaaatgcctggaagaattgaaggaaaaaagggatgaggtcaacaggcaaataaagagggaagaagaggataaggcaaagatccagcgtgaattaggaattctgaatgaacgtttgaaaagagtgtctgaaagtcttcaaagaaaaacaatcgcaagagctgaatatgataagaccattcaagagattgaaggagcatacactaaaatcttggaatcttctcaaactcttctccatgtgttaaagagagaatctgttaatctatccaatccaaagaagagggcttga

SEQ ID NO: 3589 - DNA, 1410 bp, Cryptosporidium hominis
atgttaattcttacaccaataatatactataatatggattcctttagagatataatctcagatttgttggattcaaatgtggggcgagccatattggtattttcttcagcagtaaaatgtcaagcgatgagagttgagtcgatggtgaagaagagtggaattcaaatagagttttctgagctatgtgaatcagatgcgaatgcattaagcacaattcttttgcagatgaaatcatataagcctgactgtataatagggatgggtgggggacattgtatggatatagcaaaagtactaagagttttatatgaggatccaaacacgactttgcgttcacttgcaatgggaactaacaataatgataaggaaaagagttcaaaaaaggcaatgatacatagaagagggagtttaataaagaagttggtatgcattccgacaacatgtggttctgggtcagaagtgacatctacagcagttttaaggaatgatgatggcaggcaaatgatagtttcaggtgtggcgtttttaccagatatatcagtaatagactcgagtttcatattaacaattccaatgtttgtggcttctattacaggtatgagagctcttcttcatggattggagtcttacattagtaattcttcaaaccattattcatcatgtatggctattcagtctttaagaattttatttaatagtttgactaaagctgtcattgagaaggatattagattattgcaagaaatccataaggctgcttcaatatctggagttgcaatttcagcaactgatgtaggtcttgggacaatcttatccagaagtatttcagaagtatttacacttcctcatggacttattgacagtattgtgattactaaagtgctcaactttaatataaagagaagccagactgttggacctttgattgcaaatctttcagttgagcttggaataagtaacccagaagattcaaattctaataaaatacagacacttttaaatagaattgatgaaataaaaaagactctcttacttccagattctctcagttcaattcattcttctttatctaatttcaagtctaaaggatggtttgatccaataggtgttaaattgtcagtattctcgcaatgcatggaagtagatgatcaagaatttatcaatcatgtatctggatcattttcaaagtctgataaagaaactcgagtctatgttacagaagaaaatgcattgaggaaaataccaattcttagtaaaaagagtgtaatcgaaaatttaaattccaatacattacaaatgaacttggatagaatgatttctagagctttaagtgatgaagctattcatacaaatcctgtaacagttacaaaggaggatttatcaactattttaaaagagacatggggttaa

SEQ ID NO: 3590 - DNA, 2469 bp, Cryptosporidium hominis
atgggattgttagaggataagataataaagaatcactttgcatctgagaatatttataataagtacagaaatacaaagactgtaggagtaattgaacatgatgaatttggaggaattgatattgttgctgaaccattgggaattttggcaggaatctctccatgtacaaatccaacatctacaacgatcttcaaatcccttatttcccttaagacaagaaactgcatagtattttctcctcatccaagaactgctagaagctccataagagcagccaaaattatcagggatgcagcaatagaagcaggagctccagaggattgtattggttggatcgatgttgcaagtatttccttatgtaattccttaatgaaccatagctctgtcagtgccattctagcaacaggttcagtggctttggtgaaggcagcttattcatgtggaaaaccagccttgggaggaggagcaggaaattcaccagtattagttgatgaactctcagatttggaaatggttgtgaactcagtaattttatccaaaacatttgataacagcttaatttgcgcatccgaacaatgtttggtggttctagattcagtatatgataagttgatttctggattcaaaaatagaggagtacatatcatttcttcaaaagatgagctccaaagacttgggaatttattaattgacgaaaatggaaatatgaatcctaaatctgttggaattagtgcagttgagatcgcaaaaatggcatccattgatatcccaaaagatgctgttatgattcttgctgaaatcaacgaaattggaagaggggagaaactgtctcacgaaaagttgtgtcctgtattgtcaatcattagagctagcgactttaatgatggtgtttccaaggcaaaagccttagttgaatttggtggtttggggcacacatcttgtatctatactgacccaaattctgatgaaggaaaacgcagaattactgagttccagagaagcattcccactggaagagttctagtttgcatgccagctgctcaaggagcaatgggtgaaatgtttaacttccgtcaaactccttctttgactttgggttgtggttcctggggccatacttcaactgctgagggaattggtgtaaaacatttgcttaattacaagcaagttgtacaaagaagagaccacatatcctggtttaaggttccaccttctatttatttcaatagaggatgccttgaagaagctttacaagatctcaaagaaatcaatttaaagaaagcctacattattactgacagagtcatggttagtcttgggtttgttgataatcttattgaaggcctcaagtctgtaggagtagcttctgagatgtttgcagaagtccctcctgagcctgatgttgaaactgtcaaggaaattgttaaaagattaaacgtaagcaaaccagattgtcttattggttttggaggaggctctcctatggacgcttccaagcttgtaaggcttatgtatgaacatccaactgtcaaatggaatgaagttgttactagatttatggatattagaaagagaattgtcaagctacctcccagcggtggaaaaattcaaagatttatttgtattcctactacttctggaactggagcagaaatgactccatttgctgtaattaccgataacagcactggaatcaaatatcctattgcttcttacaagcttactcctgatatggccattgttgacgccaactttgttctttctatgccaaggttccttgcagctgcaacaggcttagatgctctaacacatgcccttgaagcttttgttgcaacctatgcttctgaatacactgatggactttgcattcaagctatgagacttatattcgatcatttgccaaactctgttatcaatgcagatgccaaggcaagagaatatgtacacaacgcatcatctattgctggtatggcattctcaaatgcttttcttggaatttgccatgctctggctcaccaactgggagcccaaatgcatattccacatggaattgcaaatgcaatacttctaccacatattatttcttacaatgcatctaatagaccaacgaaacagtccattctatctcaatacaagtatcctgttgcaaagagtagatatgcaaagcttgttgatatcttgcatttcaagtctaatcagagctttgatagtaatttggatcaagagagtattaatattagaattctagttgaagcaatacaaaatctcaagaaaacattacaagttccaatgtgtgttaaagatcatggaatagaggaagaacattatatgtcaaaagttgaatctatgagtatccatgctcttgatgatcaatgtgtgggagctaatccaagattccctcttttaaatgagattaaacaactctatattgatgcttattctggatttgtcagatatccagaacattaa

SEQ ID NO: 3591 - DNA, 936 bp, Cryptosporidium hominis
atgaatagtgaatgcaagactttagaaaaagatataggtcttgcttattgcaaagtactcttggtgggtgttggaggaattggaacagaaattcttagatgtctgatattctccggatttagacgaattgatatcgtcgactatgactacgttgaagtctccaatatttccagacaactctttttcaatcttggagatgaaggaaagtccaaggtgcatgttttggcggcaaacgcaacaaaccacttcaagtcagcaaaaggattagaaatcaagccttttcattctgacatttccgactttttctcaaagttcaatgtgaccccatccgactacaaaatcattctttctggtttggataatattcatgcaagaaggacattgaatgctatagtaatgacgcaatctagtcctcaagcttatccaatactattagatagtggtactgaaggatttaatggccattctagaatcattattccgggagaaacatcctgctatgaatgtacaatggggctcaacgtccaagatactaactttccactctgtgaaatcaaagaattccctagaacacccattcattgtatagcatatgcaaattttatatatgaggaagatgaacaagacaatgaggagtgtaaaaatcacaaaattcttaagatttatcaactagcacaagaacatgcaaaatcttttggaatccagggagtcactttagaattaacaaaacaaattattggaaatattttcccaacacttctttctacaaatacaattattgcatcctctgtggtttcccaggccattaagtatctaagaggctctggacaagccaagaaccttaaaaactatttcatgtattatggtcaaacaggtatatactcatcctgctttgaaattcacaaagacgaaaactgtattttttgtaagatataa

SEQ ID NO: 3592 - DNA, 4521 bp, Cryptosporidium hominis
atgctattaaggagaatcccatgcctactccttatttttcttattcaaatttcctggctaaaaaatagcctagtcctctcccagcttatgccagaaagctacactgtcaattccatgtttccaaatagtacaatagcccaaggtgcatggggaatggatatcaaaattgatgatttagcaaaccagcctagatacgacctttctttatggtctactatcggatttccagctattttaactccttgctcttatatgtacccaattgtaatcagcctcaagaatattaactatgtttttgaaagtaatccaatctcattctcatgtaatcatgcaggcttaactgacccaatctggatctctacagcttttggatccatctctgttaaccaaacctcaagctactatgttgcctgcaacatggttgtagattacttgaataattttgagccaaccatgattcaatctacctcagctactaacttcactttcctcataccaggaactataattggagatgcacttgcgagtattgtggaagaaggagtctcaactactccttctcctgatccagtccttacctggctccagcaacattattatagtgaaaattggcttaatgttgcaagtgtcctaaatttggctaattctttctcagatatggttgttttaccatttaaatataaaatagaccttcctccagaggtccttcctggaagctcaatccaagaatctgatcctccagatcactcatatgtcgatctctttaacatgaccttttcatatggaagatatgattctgacctaacatctgggatttggaagcctaaagaaaggtttgcaggtttccaaccccctattataaactctgctcaaggagctttcattgcaatccaaaataatgttactatcaacgaatataattctgcagtaccttttggttggacaaacattcccttaggtgtctcacctattagagtggttatgccatctaatcttccatccaacagtagttcaagctgtgtaaataactatttattctattaccctatggaccctttttggaattatgctaataattcttccaatccattcaatatcaattaccttaaagatttacccccaaaaaggtttatttcaaaatactcaaaaaatgactctactatatccagaaatactgtactctctagcatgtacttctctaaaagaccattcttaaatggaaaaaactaccctggacaactccaaaacactatttcaacatatctcacattttcaaataattttcttggaggatgctattataatggtactttcccatattctcccaaatcttcctataccggtgtacatgcaggtgtggggttatgtggaactcatctcagaaattcaaatacccaatttaaatcccccttctacctccctccgatcaaatatctttcagctccatctcctataagttacttttttgtattgtcatccctaatccaatatgtcagctatactcacaaaggaacctttagatcagatataaatgatgagacacgaaaatttaagaagatataccctggaaacggtcttcttcactctcttttgattgcaacagcttcaaaccaaccttttattttctataatttaccatcttttgtgaatcatgatacttcagttactcttggaagtgaattctatcagtttagcgaaaggtatattaacaggaactttggaaactatgcaactcccggatcaggaatgacttgtagagctgctagatttgtacctatgaaaagagatatgtactcactcaaaacagcttggcagtgtaaaaccaagaagactacatccacaaatacttggcaagatatgattgaagtacctagagacgaaattacatcatgtaagctaaacaatgaatttgttacatgcttaagtactccagatacccagaatcagtttattggaatggtaaatactgctccagaagaacatgtaaccactctgaaagcttcatcttttaagactactgactatcttgctataacagtaacaattttcactgatactatttcttatacaagtccttcaaagggtatttcagttaagctcttttctcctccaatttcaggctttctatcaccagaatattgttccaaaattccaatgataccaatgattcccacaactgttgaacagatcttcattatttacccaacagtaaaggcttgggatcatcttcataatacaaagtattcattcttaatcccttttaacaaagttctacagatcagacacaaagtagttctagggaaaacttctggaattagtattaacaaagaattctatgtttcagcatatctttattgtgaatcaataagaagagtttcagggactccaagtgtttccaagatttcaattgctgacttttcaaatctagggggatctatgatcataactactaagtatccagttctacaaaactcaaaattctcaaattgtattcatgaattaatcatttcagaatccagttctcctagaacaacttttatttcgtatgaaaccttgatccaaagtaatccacaagccaatacaaatgaatttgtatctatagaatttggagctgttgactttcctccaactgttggaaagctttctctatatcaaccagaggaaaaaggagcttctattggagactcaattttcctcactcttagcaatcttgcattttcaaacacagagcaagatgaaggtttcgcaagttttggaattatcgcatcatcatcgcaaattattggacagaattccacagtcattttccttggagattctttgactcagcttccaccctctttaaggctcccagctaccagcaaagaatggtttgtatacattagagcccaaacagtaacattttctggttgttatattccttgccaacctccattcaaagactctttctactctcattggtgttccaatgacttgagtctgttgaattctttcccttgtccattttccaaagttttgatgaagaccgaagattctcaatcagagattgaagatgcaatagctgtggttacacatccattggcttatacatcaccaatagaaacaattcaattggtgagtgctctttttgaggaaaacaaagataaccagttaatatggaaaaactattttgagtcgatctattccacagcatttgaactccagaatattcctcaaggctatgactttgcttctttcaagcttatgtctctgtatattcttaagaagatttacaaagttgcctacgaaaatcctaaacttaatttggatgtctcaagaccttttgaaatattgatgaatattactttgaatgcagaatgtaccagtagtcctagtgtctcaaatcttgttctagagactttggatctattagttgcaagcaatggatggagtagaatacttggagatagtaatttagagtcaaccatttcgcatatgcttgaatctgtgggtaatagattttcattttggacttataataaagattctttagattggaaaggaaaagaaagtggtatttcgctttctgtaattactttagatgaagtatttacgagaagatcaacaagtttgaatggaatggcaatttcaggctttagatttaacgaaataaagaaactttcccctgttgaatctatttactttcaagcatatccggaagaatacgattcagagatgctagaatttgcttcaagaagttgtccaaatacatcagcaacaatttctagttatacttacccaaggaaatatatttcgaatattttaatagagaatgctgttagaaaagtctcaagacccattccaataggaggaggagctctttatctttgttcgattgattattatgcatatggaactcctacagtaacattttcacttcctctttcttttgagattccagtaaatatgacaaatataggatgttcaatgttaagtgattcagtttggagagaagatctttgtacaagtaatatttctccaagtaaacaggaaagcaagcaatttgtgattgaatgttcatgccaaggattagctccttatgcattaataggaacaataaactcgacagaaatagataatggaaattttggagattcaagtggaaatgatggaagagctccaataccaccaatgaataatagatgggatgggatttcagggaatcttacaaatcttggtatttcaaaagatctagcaatagaattgatcaattcatcgtattctggattcatttatttggatgagaaggttagaaccccatatatacctcctaaagctcaaaaagcgcttgaaggatcaaaaggtattgctggactatacacagaaatggggaggtctcagtatattggaaatgtaagctcaacttggggacttaatgctggagaagcatggttcaactcttctgtagctaaaggtggagatgctaatgttgaaagctttttatcttgggagcctgtgaatacaacaaagaagaacaattaa

SEQ ID NO: 3593 - DNA, 1002 bp, Cryptosporidium hominis
atgaatttcccttactttttctggattatattttcaatattgatttgcaaagttcgattagaggttgtcatagagaatgaagacccaaaagcggatataagtgcactggaacatttagattcaagctttatgcaggacagagagagtgtgggaattgagaacttgagttctaatattgatttatcagcaggttttgcaggtagtgaagaagtacaggatagttcaaatttaagcatgaatagaccaattgaggggattgataatgagaagttttctatcgaaggtttggacacaaatgatggctttgaagaagtgaaagactcaagtttccaaaatcagcttgagattgaggaaaataaaaatagtgatcattcagtaggaaatggtatatattcagaagatagtattttgaatggaagctttgagagtaagtcagttgatttgaacgatgtagataaagtttcagcagaaaacgatttaaatgataaatttgaaaatttgagtttttcggataaaagtgttggaggttttgatgaacagggcaataataatgattttcctgaaatagaagataatcagagagatttttccagcgttggaaaagatttttcattagcaaataaagaatcaggtgaagaaaatttatccggggaacacaccacaacaacagtaatggaaagaatggactcagatcaacaagattctcggtctagcatgtttcgagaaagcactcttccaactccacctccacaaacaactgattccacagaagcgactggaggtggtggtgggggaaatgggagtggaggaggattcccaaatacttcaacatctgtaccaacagaaacaacagcaggttccggaggtagtggaggtagtggagggggtagtggagggggtagtggagggggtagtggagggggtagtggaggcagtggaggcgatggcgatcaaaaccaagtaggtaggttaaatttttatgatattctatacgaactctga

SEQ ID NO: 3594 - DNA, 3723 bp, Cryptosporidium hominis
atgaggtggttacaccttattgtaatatttattcaattaagttgggtatttggtacagaaagtcaaaatggaaagcatagaataagtgttttatttgaggatactggttctgaggtgagattgtcaggttctccaaagacgactttaggacaagcattagtatcttttttccagtctagcatggaaaaagagaaaggactttcatcatataattacttcttgaagtcaacaggttcagagattccaacagaaactcccatatctgtaatatcatcagatgatttggtaatggcaattccaaataaaaatgaggcatctggatcagaaaacttgaatgaagcaaacttgggagaaactaatatcggaaacaaaaatcaaaattcttcaaaatatgtggagttgtcacctgatgatgctcatttgagagtaacattgcctgacggtattgttgaagacataataataaaaaggcaacgtacaataggtaatctaaaagataaagtgatgaaagactttggtatcacaggtaattacgatatttcggatggagagagaatattgccaagaacttcaactgttgatgagttaggattggaagatttggaatctccattatttttagtaaaaagtagttcaacacataatagaagtagtcaaaagaaagagagagttcaagtcgtaggtagcgaaaactctatggttgatgatgattatccatcatataatacaggaatagctgaaggaggagtaactcgtcaccaaagtcaagcagctagaggatttgggggtggaatcccaggggattacattttgaagacagtcaaaattaagctatatttcttagcaaaaagagtgaatgttgcttattcaacattgtacagtcgaacaggttcagatttaatatatgatattaatatgcaaaagaatattccggttaatcagatcaggttagggataatgaaagaagggaatccatacccagtaaatattggaatagattctccagaagcggagctatctttatacgagctgggaataaggaatggggatgtggttattgttgcaggcccagaaacaaacttttcaaggactgagttaccatttagaaaaggaagtagatttaagatttatctaagttgccaagatgcaccacattctcaaaaaagattttctgttgaagtttgggaaaatacttcaatagattcaataagagttgcactatcaggaccgttaagagttccattttccgaaattgatttagaagttgaagatattgatattaacggacaagttgtaatgtggagaagattaagaggttacaatttaagtcagttaaatattgtagcagatactgaattgtttgtaagaactggaccatataagtatgtaactttacaaccatcatactttaataggttaacaggaaagcatgagattccaatggatgttaggataaggtttgatgatttttcaggatttgatttattattgggggtttatccttctactactattaaacagttaaaacgtttaatagcttggagaagaagctatattccaagttccatacacttggagattattggaattgatagaagaatgatgccaacatcattaattccatccaatgacttgcttactttaagaaagttaagaataataccaggaattatctttagagtaaagctatcaggctcaccaattgagccttccacaattccagttgaggacattaatgataaagagtatgttgatggtactcagaaaatggctgaaaatggaaaaccaacaatgactttgaatattatgatcattaatagggatttagcccccgtacaaattgtatgtttccctactacaaagatcaaatcaatcattgcaagtatttcaaagaggagaaatattcctttgggaacaattagattatattcagagaaacaactagagaatggagctttatatagaaggtactatgaaaaattaccagaaaaaactgtggaagaatcaaagattacaagaggaatggaactatttgtggaagtcatggaagaagttaaaaaagatgatactggaaatattattagagatggaatggtaaatttgatcgtcaaatgggatgatggatcaacatgtaacattcctgttccattatcatccaagttaagtcagtttagggggactttagcaggcttaaagggaactaatccagaatctgttacattaagtcgtaaattgggaggagaaaaagctcataaaatgatcaatattgacgcttctatagactcatataaattaaaagatggtgatatgattgaagtagtagtcgattctaatggagaagttgattccagcacttccggaggagagtcttcctcggatactggatcacaaagattaacaggattaagattttcatggccagatggaacaactgttgttacctctggtagaggatcaaagaaactgggagatgttaagactttcttagcagaaagacgaggaaatgatccaaagactgtcgcaatctatttctcaagcggaagaaagttagttggtgacgataagactttatcagagttgggggtgcaatcagatatgcaattctgggtagagactgatgcattacattgggagaatcctaatgatccagtaaggtttgttataagaaatacagacactttatggtcaacagtagtatttatttcacctgatgcatacgtaactgcaactattaaagatttgattgaagagtataaatccaagtcaatgattccaagggaagcaaatgttcaaatcttaggttttgaaggaattcaagaaactgatttattgtcaaagtatgaggatgatgagaggattagacatttattggttgaaattaagctaccaagtgagtcaggattaatgggagcaatatctggtgaacctgagaatcctactctaccaattgacaaattgaagcaaattattaattgggatggacctgttaagttcactccaactcaaaagagaggaccattttctgcaaaggcagaaactaccgagattcaagtcatgatgcctgttgcagcctttattcgtccaagattagttgttgatgaggctttattacaagcatttggagaaattgctgattctgaattgaatgaaagaatatttggtccagcaggaaagaaaatttcatccaaaaacagagaacagttagttgcaaaaatggcatcaacaagaagagctgcgtatatattacacgtcatttgttctttaaataacttatccactgataagtttatgatgattactcaatctaaaccaccatttgaagctagaaagtgtacaaaacatttagctttagggttggataaacactatagatatgcaagaggagttttaggaaagagaccaatccgttataaaaaggctgttaaggctttaaggaatgcaaggaaggagtttactaaagcttattcatatgttgttaagaattcatccaaaatggctaggattataaagagaaaaagcaagaagaaaggaagcattccagatcaagacttcttaaatgctttggcattgtcaggaaagatgaagtatgaaaagaaacaacaagttgatgttaacatgcagaacttatatacagttttaaaacctgttgcaactcaacaggatattgatgaatcgcttaagagggaaagagagacttcaaggattttgcatattggtgaataa

SEQ ID NO: 3595 - DNA, 3189 bp, Cryptosporidium hominis
atgaaccgaaaggtagcaggaatactttctttaatattggttctttgctttcttgggcctacatatcaggcaagtggagaaactagaagtttaagacctaatgatcaaagttcacaagtagtaaacccagaatggaagttttttactaatgttttggagttattactcttccaaccgggaagggccatgggcacaccttggccagagaagggaccatacgaatttacgaagttatttaataataatgataagcaagatttttgtgaaagatgcgttagattaatggacaattgggagaattcagagccacatatgattctctttagagctccaaaatacttttccaaatttccgcaggtgttttacgtggcttgcggatctgttgaatccaaattcttacgtgatgaaagttctaaaggcgaaaataataatgaatctgaatgtattactatttacaacaaattcagtctacacaagtactacgaaggattcagttctgctccaactttaagaagacgtgcagcattcccagctacacatactgatcatagaccatttaaaccattgtatgatccattacataagatacctacaaagacaacacaaattaaaaagactgtagttgattattctaagcacaaatatattccaatgattccaaagaatactgataataagccaagagcttcttatccaatttctcatacatctgtgttggtcgattcaaaacataggtatgttccaattacgcagaaagttcctagacctgatagtcttaagagtagataccccgagaacacatctcataaatacattcctgttattatgacaactaggaatgatgaaaatgcggccttcccagcatccagaactcaatatccagctaatccaaatcataaatttgttccacttgtaaataaacaatctccaagccatgatacagcttctttaccagcttcaagaactggagctccaattgactcaaatcacggatatattccattatatatgacatacaattacacggagagtgcagcattcccagcttctagaaccagtttcccagctgatccaaagcatggttttgttcctctatatattttggataactcaacagaaacggcagctttaccagcttcaagaactcactatccttcagatatgcatcatagatatattccattatacatggcatccaataatactgagaatgcagcatctccagcttctagaactagtcaaccaactgagaccaagcataaatttattccaatatttgagatttacaaccaaactgagacttcctcacttccagcttcaagagtaggagccattattgacaccaagcatggatatattccgatcttccaaagagttgcaagcaacgaaactgcctcattcccagcttcaaggacaagccatccctctgatccaaatcatagatatattcctctatttgaggttatggaaaacaatgaaactgcatctttcccagcttctagaacaaagtacccagctgatactgaacatggatatttacctattttggagaggatctactaccttaatggcactgtagctcttccaatgtctagagtaagtgctccaattgatactaggcacaattatatcccagctttcaatagtaatttagagtataatggtggaaatgcatctttcccagcttccagaactcaatatccaaccgatccaaatcatcgtttcattcctctatttatggttgagaactctacagaaactgcagcattcccagcttctagaacaaagtacccagctaatactgaacatggattcgttcctttatttgaatcttctatatttgaaggaagaaacgcttctctaccagcatcaagaacccaattccaaatggactctagacatgcctttattcctctatttactagcacaaactatagtgatcataacgcatctttcccagcttctagaactcattatccagctgatccaaatcatggtttcattcctctatttatggttgagaactttacagaaactgcagcattcccagcttctagaacaaagtacccagctaatactgaacatggattcgttcctctatttgaatcttcaacatatgaaggaggaaacgcatccttaccagcctcaagaactcagttcttagtagattctagacatggtttcattcctttattaatttcagattatagctccaacgaaacagctggattacctgcttctagaacccattatccagccgatacaattcatggatttgcgcctttaattccagactatgagtataatgttggaaatgcatctctcccagcttctagaactcaatatccaatcgatccaaatcatggtttcattcctctatttatggttgaaaactttacagaaactgcagcattcccagcttctagaacaaagtacccagctaatactgaacatggattcgttcctttatttgaatcttctatatttgaaggaagaaacgcttctctaccagcatcaagaacccaattccaaacagaccctaatcatggatttactcccctatttacaaagttatacctttataatgatactgcagctttacctgcttccagaactgggcaaccttcggaaacaacccacggatttattcctctctttggatctactgaaaactttgaaacttcatctctcccagcatctagagttaaggtaccatcaaacttcaatcattcatatattcctgtcattcctgaacaccttgaccaagaacacgcagcaaagcccgcctctagaactggggctcctgcccctggagcgccggcgggaaatctcccatatacaatattggtttcaattccaaaggcagcattaccagtatctcgtacagatacattatcagaaagtcatgcatttgttccattaataaaggaaagagaagatattggccctagagcagcattccctgcaactcatacatcagttgaagctccaggattaggaagccagcaaccaggaattaactgggaacatttcactgaggtacttaaagtcgactctgaaggtaatccatatgttgacactaaatacggaaggatttatggatttggtgatttgagttttatattatctcagcttgatcaggctgaggcaatagaaaataccccacagcagattatcgaagaccattaa

SEQ ID NO: 3596 - DNA, 2106 bp, Cryptosporidium hominis
atgaaaaggatattgtgggtatgcttgttagcattatcaatatgtcagaaaggattaggactgggagtaagagtgggagtgggagaaagtaatcctcttcctgctcaaacaaagtcaaggattaatttaattattaaaaaacaaattagtaattataatttagatattcctgaagtaattattggaaagatttcggaggtaatgaatgattccatctctctcacttttgaaaaaatgaatagttcagtattggactattgtaataagaagattggggaaatacttgaaactctgaaaataacttttccagataattttgagaaagatctgtgttataacgtaattgtaaaccatctaaagcacgttataaatcgtcaacattttgctgaaaatatatatcaagtatcatcaaagaatctatgtgaaaatcctgattcttcatctccattaagtaaatttagccataaagaatgctcattcaactctaatagagaccgaaatagtagcaaggagagaattattgtgaccccagaattagcatatttgatttcagatctatttcctattgagcctaatcaaaaagagtgtgtagtagcatttatgagaatcttatctttaccatttggtttagaaaaagaaaaagctgaagaattatgtaaaacagtgcttgaaacaaggaaaacagtacatttttatagaaatgatcttgtttcagactctaaaggctcattcaataaagtacatgaagtttctttgtcatcaaaactgacaccattcaaaagaactcctccttttgtggaaattagccatcctcatggagttggtggtatatcttattcttcagaaagagttagtgaaattaaacattctactcaaatttttggaaaactggttactttaccatttatcaatagtccaattgaatcaattagtcattcagaaaaacaactaaaatactcacaagaccatagtaaattaccaaaaaatgaaattccaaaactaaatactagagaggaaattgtattcaatgacgatatatttagtgaccttattttcccctgtaaaactctcaattatgaagcaaaaatattagcatccatacttttctattactcaaatttattgaatataccaattactactgaggatgcatgcattacatgcatgcgtagtgttctggttcccgccatttctgtacctaaaaataaatcaagagaaaagaaaagaggaataacaccaagtgaagtaattaatccatttattccaacatgtgtgaatgctttaatgacaatgtcaatgttttctcctgcaagtaaattaactttggattatattccatcacttaggacttcggaaaatgcatctaaagcttttgggaaattatgtagcaaaacaatgaacagatatattcagatttttgggatgattggaattggaaatcacggtatttcttgtaatcccgcccaaattcttttgattaattctctccaaatctcaatttggactagatttaatgctttatttgcttcaaatgaactagctcaggttgcatgtagagtcaacatagattctcatgcaagtcaagcttcaggggaatgtattaatttgatgaagaagattactttaggaatgtcacacgatgacattaagactgtatgtcaatctactgtcaagtttttacagccacaaccggttgtattgaatccaatactatacacaataagttcaatttttcaaagtattaccgagtcagttgtatatagcaatagtattagtggttcccccaatatctccagttttattaagctatcaaaaaagatactttacttttctaaaccaaaaatggatcctcaagactacattgattcttgcaaagctctattagggaataatattaatataaaattaaagagcaaagagatatataagatttgtaaattcacatcaaaacctgtcttaaatgtagtcatgcattaccatatcccattagaacttcaactttttcacaagaagcaattcaaccctaggatcaccttcatcaaaaacacaattaaaagctacagcaacctggttaaaagagagtttagtattcacaataacgagtga

SEQ ID NO: 3597 - DNA, 1443 bp, Cryptosporidium hominis
atgattatttataatgagattgaggaaagaactccaagaattgaagtaggtaagaaagttattatatctccactgaatttagagttattggataatgggagtaattacagcaagactcagagttttaattcaattaattcaacctttcatgaaatgtcacaaagaggaataagtagtacagagagtttggaatatcaggacaagtatgttacaccaagtattcttagtgatgataatgaatcagatatagagagagctaaaatagtagaagaagcagcactagtagcagaaaaattgatgagttctcagctttcaaagataaattatgagacagaattaagaacaatggagacaagatttccaacaagagtaaattctccgagatattataatgaaaagaaggaagtaatggatagagcaaatagaatgttaatgaaaggaagaagagaatgctcatcaattcctggattctttcaaaataagcttggatggtttaattgtgttgagaactttttctcggtttgtaatgatgaacagattgttgaagataatgaatcttgtactattatagaaacaaatccgtacttttcaccaaagaagaaaccaaatgcggatacgaatatgaagattttggaggaattaaaaactttaaatttggatagtgttacaaaaaattcaacaatagatgaaggaaggaaattagtaaagaagatgacgacaaattcaactaatgaaggaaaagttcaaaaaacacaaccatccaaaagattagttaacactgaaaagagttcaatagcaagtaagacaaaaacagatattaattcaaataatgctaagaagactacacaaattaaagtatcaaataaatctttaaagccaaataatgagatatcatccaattctaagaaggtggtaatttcagaatctaattcgtatgatatagagaacgatgtattttacttggatgatggagctggttatattacttttaattcttcaaaattagattttagtgaaatggaaaaaagatccaaaccacaaactacaaagaataaatcagagaacaactctgaaaagacaaaaataataaattcaaacccaaaggattcagatattgagaatcagaaaatatcagtttcttcattagttaatatggattcagagaatgctaaaaagagtccaacgatgagaaaaagtaattacacaaaaactaataaaattgacacaatagcaactgagaagacccaaaatcaggtctcatccaatgatattccaaagaaagaatgcaaaaagaaactgaaagctacaaaacttaaaaattcaacagaattaaacggcgccatcatagaaaactctaatattgatgatcagaatattttcaactattcttccaattgtattcgaggaagaatggattacatttcaacagatgtatttgtgtga

SEQ ID NO: 3598 - DNA, 1098 bp, Cryptosporidium hominis
atgaactttagattagtttcagttttggttgcattatttgcaatagttcaattggtggtgtcaacttcagtaataggaattttggaagggttttcaaagtacttttatagtttaagttatgaaagaaaacaaaatatagtacatgaagcagtacaagaattacagagtgtgtttccacaaggaatggaaacaataagtcttccagagtcagtagatttagatacatgcaaagctactttacaaaaagcagtacaacaaaatcatgaatggtatctattagctatgggacaattcactcagttaaagttttataacagtttcttaaatgaaaaggtatcaggtgacttaaaagaagcaattgaaaaagcttcaatgagtagcaattcacaaggatcatcagattcaattgttgttaatggtgttttatataatgctcaacaactttcacaggtgttagcagatgctcaagctttaagagaagaaaatgttcaacttagaaatgcattgagtagtgttagagaagatcttgagaaatctgctactacaattgaagaattgaaattggaggcacaatcttcattacaagaagccattagagcaaagactgatattaataaatttgaaaagagactttcagtatgtagacgtaatgaatataatctaaagaagatcatatatgaaaacaagagaggaagattcagtaaattcaagtcagccatttcaaggcctttcagagctcacaaattgaagaaagcactcggaaaggaaggatacaaggtacataaacaaaagaaacaggctgattccaagaagaggaaagaaatggtgaagaagattaagaaggagatgaagcaatctaagagcgataagagaaagaagcttttgaataaatctattgcaccaggagaagatactccaattccttcaagtattgagagttccctccaaactgagcagagtcttggaaaaggcgaaagaagcacttcaaatccattagaaaactcggtttcttctgctgcctctttctcaactactgaaaactcaaagagtgaaaagggcgattcatctgtgggatcgatttttgagggttccagctaa

SEQ ID NO: 3599 - DNA, 774 bp, Cryptosporidium hominis
atgacggcaagtatttggaaagaactgggttcgttttcgtcaatattagggtatattccctataatattttattggcatcggagaatattcaaaatgagaaagaacttaactctcagactagaagggataagtttggaataagaaatttgctacctgcttttggtcatattagagattactttaacgtgaataaaaatggaagtaataaggattatcaattagagtcaaatacacaaaaaaccagttctgataaaagtaactcaaaacttactagaaatgatttagagcaaagattggccaaaaaaattcaagaattaaaacaaaataatataaatagtaggagaaataaacaagattcaaaaaaatcaacaacaaaaactgctcagaaagcaattgataagaagaatgttaaacctgaatctgatgaaatacaacaatctgaatcatcttttaagtttggaagaattattgatagtactttatctactccaagtactgctgattacttgcaaaagaaagaatcaaagatgaaaaaaattaataatgccttaaatgcccttaaaaaggaggaagagcttattaatagtttgcctgaagaacaacaaaaggctaagattaaggaaattgctatggaaaaggcaatgaagaaagctcaaggaattaaagttaaagataataagtctaagttaattaagactaaaaagactattttagctaaaaagaaaaaatctagacagagatgggctgaaatttctaagaaccaaaagaaatga

SEQ ID NO: 3600 - DNA, 1086 bp, Cryptosporidium hominis
atgggaatttatgaaaaaggatttgagagaccatcaccaattcaagaagaaagtataccagtggctcttgcaggcaaagatatcctagcaagagcaaagaatggaacaggtaagactgcagcatttgttataccattattagagaaaatcaatactaaaaagaacattattcaaggcttgattcttgtcccaacaagagaacttgctttacaaactagcagtattgtgaagcagcttggtaagcatatcaatgtccagtgtatggttagtactggtggtacatctttaagagatgatatattacgtttaaacaacccagttcatgtattggtaggaactcctggtcgtattttggatctgtctaataagaaggtgtgtaacttgagtggttgttttatgtttattatggacgaggccgataaattattgagtccagaatttcagccaattattgaggaactcatagagtttttaccaaaagaaaggcaaattctcttatattctgctactttccccgtaactgttaaaggttttaaggataaatatcttgcaaatgctcatgaaattaatctaatggacgagctcactttaaagggtgttactcaatattatgcttttgttgaagagaagcagaaactacattgtcttaatactttattcagtaaactacaaattaaccaagccattatattttgtaactctgttacaagagttgaacttttagcaaagaaaattactgagcttggaagctcatgcttttatattcacgcaagaatgctccagtctcacagaaatagagtatttcatgacttcagaaacggtgcatgtaggtgccttgtatcatctgatcttatcacaagaggtattgatatccaatctgttaatgtcgttattaatttcgacttccctaaatattccgaaacataccttcacagaattggtagatctgggagatttgggcatcttggcctcgcaatcaaccttataacttatgaagatcgctataacttatatagaattgaaaaagaattggccacagagatttcaccaattcccgcccaaattgattctgccttatatacttaa

SEQ ID NO: 3601 - DNA, 1383 bp, Cryptosporidium hominis
atgaagttattaaaatcaaagaattccgggaatggatttggatatgtaaaattaaagattgaatcagaagatgatatctgggagttgtataatttaattctgtcaggagatagtgttcggtcagtaacatatagaaagactcataaggaaaatacatctggtacagtttctgttaaagtgcataagttggtaatgacagtaatagtaaagaatactgagtacggaggccagactttaagagtgagtggatttaatgcaatagataatgaacacgtgaaaatgggacaacatcacactttggagcttaaggtagggtcagaattgattttatataaaagaagttgggactggttagcaagaacacgcctggatgaagcttgcagaaagaagattggaacaggagacgatattttgattttactaataggaaatggagtagcaaatatgtttctaatttcatctcaaaagaccaccaaattatttactgttagtcataatattacaagaggaggtcaaaataacaataattcatataaagaaagcaagaacaaattctttcaaatgattattcaaaatttagtttctcatttaaactttgatgatttggataatattatattaggaggcccaggtttcttcaaggatgattttttcaaatatttgtttgattcagataatcaaaagaataaagaatttactagtattttaaagagaaagaaacatatctttattatcacaaaaacaagtagtgtatttcaatcatcaattgatgaaattctttcaagtgaagattttcaggaaaaacttaaagatactaaagctttccaacaagttaaattaattcagcattttcaatatcttcttgctactaatcctgatcttgtttgctatggactaaaaagcacagaaaatgctttggaaaataatgcaatcgaaacactcatggtttctgatgctcttgttagatctgattgtctcaaaattaggtccaagttagctaatattacaggaatgaataatagtatgggcggcaaaacctgtattttttcatctacacataattcaggtaaaactttagaaaatatgtcagggattgcagcaatcttaagatttcctgtcgagcatttacaggaatgtgaagttgatgaacctaatcaggcatgggaaactggagatgaagggggaggaagagatgatggtcaagatgaggattttgattggtttaaaaaagaaaaagacgaaattaagaaacaccaaatgtcacaactagataataattctcttgaaaaacagttccaacaaaattcaacaattagcgataattttcttgcaagcttgaagagcgataagcaagatgatgattctttctctgaaatcgactaa

SEQ ID NO: 3602 - DNA, 330 bp, Cryptosporidium hominis
atggaaagacttggactcctttctgaggaagagagaaaattggattatgtacttggtttaactattagcaagttccttgagagaagactccaaacccgtgttttcaagctcggattggcaaagagtattcaccatgctcgtgtcttaattagacaaaaccacatccgtgttggacgtcaaatagtcgatgtaccatcattcatggtcagactcgactctgagaaacacattgactttgccttaacatctccattcggaggaggacgtgcaggccgtgtcagaagacgaactttaaagaaccagagtggaggcggagaagatgaggagtaa

SEQ ID NO: 3603 - DNA, 243 bp, Cryptosporidium hominis
atgaataacgcaaacttaggagctggagggtttgttccaagtggatattctcaacacccagtatctgttgggggaggcatggagcagcatcaccctggacaatttaaaatgccacaaggcacatcagcgggaggaacaaatgagcaattagtttctgctgatcactcatctttacctcatttatcgttattgcctcaacatcacttagctggtactggtgctgggtgccggaggtgcaggtaa

SEQ ID NO: 3604 - DNA, 2115 bp, Cryptosporidium hominis
atgaagattcatctaacttctgatgagattaacttgttagtttatcgttatttgattgagaatggtttcgtacatacagcttttagctttaattctgaagcaaatgttccaaagaatccattctttacaacccagatggagagagtacctccaaatgctctggtaggattccttcaaaaagctctactttatatttacttggagtatcacacatcagacgagactggggaagagatcagatgcgaggagcctttttccatattcaagagacatgagtgttggtgcaggcctttagaacaaattggatcgaatacagaaggtacagaaggccaatcttcttgtcaaggtattgaaccagtgggaagaatagaggagaatatgcaagttgatatttcttcttcacatacaaacaaaaatacaagcattacagaagatttagtagatacatctattcagcctccaacaaagaaaaccagaaagtctagatctattaactcaaatctaggcttagatcgagtagcacaagctaatgatgctgattcacaacaaggacaggatgaaactttgatttcaaataagaatgtatcagagtctcctaaagatcaacaaattgaggtgggttcgacgatgccatccaaagatgtttcatcggtgaagcctgggattgatgaagatgccaaaagtagcctggatttaccagtagatataaaggatgaggattcaaaaaatatagaagtgaaacaaattaaaagtgagaaaagtcctacaactataatagacgatcctttcgagatggtagtagagaagactaatgtttatgatgagaataatgacgatgttgctggtatgagtaacaatgttagtgttaatgttgataataagatggatgttgatgtagttggatcagtaactttgccatcatccagtgataagtatttatcggaaattccacattttaagcttttcagaaaaggaaattgttcgaatggaataagggaagttcaatttagcaagagacaagaatctccaaataagttggtaataacttgggaagaaggatgtccagagctttgggaaattgatccaaatagccaagagagaaacttggagagttcaataatgcttccagtttctgatggaggaaatatgatagccggaacagtagtagcaatgagtagtgattacattgcaattgggtatgaaaatggaagagtgactttattttcttataatggtaaagaacttacaatggttaggagtagccatgatcaagaatctccaatagtttctctaaaattaagcgaatccagtgaatatctggcaattggggatgcaataggaaacgtgatagtcttaagaataaattttgaagaatcaatagaacgttgcacaagccaaataattaataagcatcagcataattcagcaatttttggactttgttggtgtaataacgactcattcttgctttctgggtgtcttgatagacaaattacggtattaaatataaaaaataatatggtgaaatcttttaaccaagaaggtccaattctctcaattaatcaagttagtcaagaaagtcctttggtgacttgtgtattggaaggagtctcaactattccagttttgaagatttctggtgatgataatataaatcttgattgtatttcaaagatctctatagatgatagcttgggaattaaagaagagagtcaaaatactcaatctccgcttcagataaattttattgagagcaatatattagatggaaaagtattccatattgtagcaacaccatataatatttatttatttgatacactttgtaatttggtttctttccagaagattacaaacaaagagttagaatcaagcgagattgtctcgatttatgttgataataaatctaaaacaattattgcaggattgaatgatggatctataacattgcttgagctttcatcccttaaaattaagtcaaagtttttggagcagagttcaccaaagaagctaacctcattaacaggagttggattagtttcaaagaattcatctgggaagttagtatttgttggagggccatatttacctgcaatttatatttttgataattaa

SEQ ID NO: 3605 - DNA, 396 bp, Cryptosporidium hominis
atggatccaaatccaaatcttggaaatgaggatttctacgagaaatatccaacatatcattcattggtaagttcgatagagatcccaaaaggtctaaaagcattcgaagtggtttgtcccaagagaaagttaactagagaaggggaaactgcattaaataagtatgagttgagtgaaagtattttatcaagcataactacattgggagaaaatgatttatactctgattttaattgtttgatatgctttcgcattcttcagcgtacaatggttgttaaggactgtttgcatagattttgtggagagtgcattgaaaaatgtgttcgaattggattaagagagtgtccccaatgtagattgcatattgcatccagaaggtcactaagaaatgactca

SEQ ID NO: 3606 - DNA, 1392 bp, Cryptosporidium hominis
atgaatgatgtaaataaaaaggaaacaaaatcaatggagtacagtgattctgtaacaggatctccgaacgatttttgcagggcagatttggatagagtagattataataacgagagtcctggattgggagtgaacattgggaattctagagaatttgtgaattctggaacatgcgaaggcttggaaatcaaagttgatggtgaaaaaaacaactcaagtagtagtacagataatcagcagacaaaaaatgttgcaccttataatcgatttttaatactattaaaggataaaacatgtagtgatatagttttttttattgcaaagtttattcaacattatccacgcttagatgaaggtttagtggatttaatatatggtgaaagtagagaaagattttatttggaaggaataattaatgggaatgaggatattggtactcaagttcttgcaaatattttacactcatttgttggattttgtgggaatttacttatagaaactaaagtttttaataaggttggtaatgaagaagaagaaaaaatatttataatagaaggcctggaaaagttggtaacaactaagttatataatgttttatttgatgcagtttcgtttgaaaatgatgatgcagaccattatttatttaggaagttgaaagttttaaagacttttgtaaagctagatcactttgatatttcaaagcattatgtagagacacttcaatctgacagtttatggttggatatctgcaagaacgagctttataagcttattagggtaaagtccccaaaagataaagttgtattaatagtgaatatatgcaaaatacttttgtcgtatatgaataatattaataaaatgaggcttgaaactgattcaaattctggagaagagagaatttcatctcctccagctgcagatgatttacttccattattgatattttgtattattcaaagcaatccaacaaaaattaaagctcatgtggaatttgtatctttattcagaaattctatattattagtttctgaggatttatattttttcactcatttttattcagcaatcacatttttggagaaattagatggaagacaaatacaacttaacatagataatgttatatttgaagagcaattcaaatcatcagaaaagaaattatttggaaataatttacttcatttattgactccttattcagagtctagattaagttttcaagaaaaacaaaataagttacaagaaattactaataaattatcatctttaaaattaacttttgaagattataattcgtcagatgaactaaaaattggtgaaatacctcaattatttcaggaatacaaacaattattgaatttatttaaggaattaaagcaaaattctggttga

SEQ ID NO: 3607 - DNA, 1551 bp, Cryptosporidium hominis
atgaaacttgatgatgtaaataacggtaatgtcaaccttgactttaataaacctatatataggttagactataaaacaagtaacgatgatgatacgagtagaaataacaatggcaatagcttaattctagcttcttatgaggttggaggtataatcccaacaaatattaggttaatttttaataataaaccatatatttatgaagaaaattataatgaagaagatataacgagtgaatttcaaaataatcagaattcattatatagtacgaaaatccattcagcagaatcagcaattccacaagattttaacttgaatgaaggatatttctttaaccaaatacaaattcctgttttaaataaagatgatgaatattgttctgctcattatatgattcaaataatttgttctgatgaatttctttataatagtgaatatcttaataataatgcaagaattaatacccaagaaaatattaaacttcttaataatgatttccaaaaatctaataataatagatgttgtcaaaaaagaataacattttcaaaatctcttccatgggtaatttttcaaaacaataaacatttttcaattggtgaatcatcaattagaaaaacaagagcttcaatagctgtatctgaacaatattatcatattccagttccaaacttatttcttagacaaccaatatcacaaatagtaaaatcaactcgaaaagtttttaaaaaaccatgtgaaattgaacttcttgttaatattgaaccaattaatccgtattatatcgaacaatatttaataaaatcaagaaaaatatactcagctgatccaagacttgttactgatttattgttgagtaatattaataattctttaattgataagtgtgttgagactattattcaagtaaaaatgaatagaattactgatttaataaacttccgaaaaaaacttagactaaaccttaaatatatccataatgcaactaaatcaaggtatttagtcaatttacttgcaaaaatcaattttgatcctgaaaaacagagtcataatgatttattaaactcactttgggaatgctatttttcaaaagaaaccgatgttaaatgggagcttttaggcttccaaagatgtgatcaaccatatagtgactttagaggagttggtatacttgcactcatttgccttttatatttcagtttagcacatccatttgaatcaaaattaattcatagagaatcaagtaattcaaaatattggtattcttttgcagtcacaggaatcaatattacatcttggctcagagattggttgaatcaaagggaccatagaattattccattcttttataagactgaaaatgatgtgaatatgctttttatattttgtgaactcttttcatttatttttctaaaattccattcattttggatggaaagaaaacccaagaatattcttgagtttcctattattgctcaaatatttaagcagaggattaaatttcccttgtctgacaagatgtaccacgaagacaataaggaattattgaattga

SEQ ID NO: 3608 - DNA, 480 bp, Cryptosporidium hominis
atgcatgcatcccgctcatttaaatacttgattactctcccaacaccagtatgtccattttcagaaacattattcatgcaaattggtttgggtgcaggtttctcaatgcttcttgttttggagtttagaattaatgaagttcttaattcattactttcatattttttctcatttgtattttttccaggagttccaaaatccctaacttctgattttctctttgttttttctattatcatattaacttttctatcttatgccataactcttaaagtttccactctttcttattattttatttgttttaatttttacttttctatgaccactttgcccgccatttattttctttgttttcccccacgaaatattaatttacatgcattcaatgtctctttgcctttccacttttcttttttttttctcctatttatattaatattaataaatatttatttttattctttgattgtgaaataa

SEQ ID NO: 3609 - DNA, 1423 bp, Cryptosporidium hominis
atgataatagaaaaaacaaagagaaaatcagaagttagggattttggaactcctggaaaaaatacaaatgagaaaaaatatgaaagtaatgaattaagaacttcattaattctaaactccaaaacaagaagcattgagaaacctgcacccaaaccaatttgcatgaataatgtttctgaaaatggacatactggtgttgggagagtaatcaagtatttaaatgagcgggatgcatgcatgcaaaatgacgtgtcaagaactatgcaaacatgcgaattaccggtcaagcatgcaaatgaagtatgtggactaatcaaattaataagaataatttttagtatatttacttattcagtatttattttatttattttattgactattttatctttaaatacattatttgaaaataagtattcaaaattggttgagatttctgaattaattacttcagtaacaataccttcagtggaagatatttactattttagtaaagagtcaaaagaatctgtgagggaagcatttagatatttgagtggaaataaggatgctgattcgttatttgtgaaacaaaataataagaaaaaagaaagaaaaaaaagttcaaagttattatcagaattacccaaaaatcaaaataaggtcaattcttcagagtttgggttttataaccaatctttttttgatttaagttatgatagattatcaattgagcattatgattcttctagtgctagtgcagatgctaactatgaaatttcttggagaagagagttcattaaagatcaaaacaagaatttaaatgataatttaaaatttataaatgaaattcaaggtaaaaatttgccaaaaagttcttcatttggttatcgtaaaaatgaacaagaacaaaaacaagaactggaaagtgttaataatcattctaatttaactaaattggttgagattattcttggacagagccaattaaagaaatatttcaagggtaagagtgtaagtatattggaattattatgctatcaaaatttcagctttcaagagggaatattatcaatgtattataaggaaaatgatcatggaataccttttaatgaatattttttagaatctgatcaaaatattcataaagagttaattaaaaaattacttaatagaacaattctggatttattgggaattgaaagaaactatgaattatatattattccaactattaattaccactatgataatcaattacaagtaaatactaatgataataaaaaaagtattattcaaaatcattttagagtaagcagaagagttattgtgtcttctgggtatggtaatgaagaaattcgtgatttttgtgaatatcaaaataactggatatgtacaaaatatgaaatgttagtattaaagttattacaagaatattataaag

SEQ ID NO: 3610 - DNA, 933 bp, Cryptosporidium hominis
atgagtacaaatatgagtaatactaatattggtgaattatatgatccttattgttataatggtaataatagtattcatagtaatagtaataataataatagggatgatgatcattattcatcttcacgagctggatctaatgtaagtgatggtttggatatggttaagaatgctgggatttcagaagaaagaattttagaagaaagtattaaaggattttcagagactaataacaacacaataaattcagtaaagctacctgttccaccatcttacaaaggggtaggaactagaaagaatccaataggtggagtaggaggaataaggagagttgaagctacaaaggaagttccaggattatcatctggacctgggaatgggaatagaatggtatggattactgatgagtcaatattgaatgcagctcaaaaattggctggagatagtattataatggaaggagggccaaataaagaggaagatttacaatggtcagattggaattcttttgttgcagcagaaacaacaataacaaatataagtggtaataaagagatagaaagagaggagaattatttaggtcaaagatctaggataattaataataatgataagagtaaagacaacatgtcatcatcaaatccattcgaatcggattgtttagaagttggagttggagttggagctggagttggagctggagttggaactcagacagagattgagagaagaaaaaagattatggacgagtccattttcggaagtgatttattggatttggattatacttgtggtaataatgttggaaaaggagaagaaagagtaggtgattttgactttggttttagaaatggatctcaacagcaggaaaatggaggagcttctgttggaaatagcaatcataaagtattgcatgtaccgtatggattttag

SEQ ID NO: 3611 - DNA, 534 bp, Cryptosporidium hominis
atggcaaattctgataatgttattagatgtggattaactccgaaatttaaggatgttcctactttaattaaagctgtaaactttcagtcaaataattataaaatcattccaaaccataaaatattctcatccccttcatcctcatcttcatcatcaccacatttaatcgactattttgtgaattctgttcaagaataccatgttcaaattctatcaatgaattttaacaattcttcgaattctctcacatatttaacctcaaaatcgtctccatacactctattactatgtttgagtggagattgtatcatttcattcaacgagaaaataaccaaagataattgtaataacttttcctcatcattatcccataataatgatcatttaactcaaaaagatcttgtttttatacaaggaaaagccattctaaccaagtgtaacactgaaatatacttccatcatctctcaaaacaggaagctaaatttgctatggttacactccctaatgttactcacgatgatagtaccttttga

SEQ ID NO: 3612 - DNA, 597 bp, Cryptosporidium hominis
atgataaaaaatgatatattttctgcttcaatagttcttcaagtaattcctttaatttttgaaaaggatatacttgtattattcccatctttttcagatactcatatgattcttgagattcaaaagatttgtgagaagattgtggaatctaaagattctagaagactatttatacaacaaattgattctaatttatcatgttattcttttggaaatttcattaaagaatcagatattgattccaaaattaaaagtaataatcaaatttcatcaaaagatattcttttttcacttatatcacttccttcaatacaatctttaagttcaaaatttcctgctattaagcttaaagctgaacaatttttagtatttttaataaagttaataattaaattaagagaagatgaagatcaacatatgattaacaaaaatgacaataataatggaataaatgatgaagaattttctcaatttgaattggtgatttctgatataattaatgttattgagaaaatttatcctggtcatttaaatcaaaaaaaagttaactttattaaagaatattctagaagagttttgtccaaagctattaattga

SEQ ID NO: 3613 - DNA, 387 bp, Cryptosporidium hominis
atgaattattgtaaagatgatgaaattaaggatatattacttccattattaatatttaataatcaaaatggttgtcaatttaatcatgataagaatatactcaatattttcaatagttgttgtgattttaatggttggattaaaatgtattcttcattgagtaatttggataaagatattatatctactttaggaatcgaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 3614 - DNA, 2250 bp, Cryptosporidium hominis
atggatttgacaacaaagttatcaagatttgtggtcaactatgaccctagttcgaatgatggagagcccctccctttggcttgcgactctcaacaggtggttttaaagccctttagagattattcttcagaattgaagttaaagtctgatcatgataaaagaccaatatgggtttttccagatggtttaattattattgagacttttcatcaaagtagtaaggctgcatgtgaatttttggtgactatttcagaacctcttagtaggcctgaacttatacatgaataccaattaaccatattttctctatatgcagcagtatcactaggaataacagttgactctataatagaaacacttggaaaatttagtaagaatgagattcctgatactttggttaatacaattagaggccattgcaagctttttggaaagttgaagattgttttattagaaggaagatactttgttgaagctacaagtagacaagagttatcctatttactttctgatgagagaattaagtctgctagaattattagaaaagttaataattctttaagtaattcatcaattaaagtattaaataactcagaatcaaagccagaagaagaagatgctaataaatcagattttaatattactcaggctccaagtttgaatccaaaagatcttgctttcaagattactgagaatcctgctaaagacaaggataatcatgaaagttctggaaatagcttattacaaacaaatccaaattctagttctaattcaaactcgaataatatgatttattcctttgaaatttctggtgataaggttgatattgttacaatggcatcatttgttagtcttcatagacctttgttatctgaatatgacttcagatctgacattaaaaatcctaatctagatatttcccttaaacatactactcaaattagatattatcaagaacaagctttaagaatgatgtttagtaatggacgtgctagatctggaattatagtattaccatgtggagcaggaaaaaccttaacaggtattactgcagcatgtactatgaggaagtctatattgatattaacaacaagtgcagtggcagtatcacaatggaaatttcaatttgagcaatatacaacagtggatccaaataaggtccattgcttaacaagtagtaataaagagccacttggccctacttcagaagctgttgttcttgttactacgtatactatgatggcatttacaggaaaaagaagtacttcttcttctcagattatttcacaaatacaagaaagagaatggggtttacttatatttgatgaagtacagtttgcaccagctccagcttttagaagaattaatggaattgtcaaagctcattgtaagttaggtttaacagctacacttgttagagaagatgatttgattcaagatcttcaatggttaattggtccaaagttgtatgaagcaaattggatggaattgcaagatagaggatatttagctaaagctctttgtagtgaagtatggtgtccaatgacagcaagctattatagagagtatttggattgttctcatgcaaagaaaagaaaactatgggtatgtaatccaaataaactaagagtttgtgagtttttgattcgttggcatgagcaaagaggagataagattttagttttcagtgactcactatttgcattaattaatattgcagtagctttgaagaaaccatttgtatgtggtagtgttgatactttagaacgaataaaaattcttcaacaattcaaagaaaatcccaactttaatactattttcctttccaaggttggtgataatgcaatagatattcctcttgcaaatgttgtaatacaaatatctttcaattttgcatcaagacgtcaagaagctcaacgtcttggtagaattctaagacctaaaccatattctggtatgaaatcagggaaagtaataaacaagacttcagatagtccaaatatctctgagcaaccatataatgctttcttttattcattactttcaaaagataccgaagaaatggaatatgctgataaaagacaacaatttatcattgatcaaggatatagctatagagtaattactatggactcttttccattgaataatgagaatttgcattatagtgatattgagacacaagaaaagatgcttgaattaattaaacagagtgatgatactttggatgatgacgaatttgggaataac

SEQ ID NO: 3615 - DNA, 645 bp, Cryptosporidium hominis
atgaatggacactccgtcaataggtacacaattgaatctaggaagctccataagtctgatcaaagagggcatttaactttaaagtatagaagagataacaatgaaactaaaaaaaatgagtcagtaattaggattgatagagatattaaacagtataacggttctaattttgcctctaatgaaaaaagtgattcttcaaattttgaagtaagtgatgataatcaaattgtaaaagaagcaactcacttaagccctacaaaagaggatcttctagagagcgagggtgaattagagcttgagctggagagtggaagcgaaaaagaagagttggatgatgatgaagagctactcaaggaattagaaaaaatcaagaaagaaagagtagagagagaaaaagaaaaaaagaacaatgatatcaaattaatgatgcaaaacaatccattactagaagaatataatgaaagtgatagggataaagttgatcatgatgaatctgatagagaagaatatattttaaagaaaaggtggacggaagatactgtttttagaaaccaaaatagagtttctcaacataaaaaaagatttattaatgacattttacatagtgatcaacatagagaatttatgagaaagtatattttatag

SEQ ID NO: 3616 - DNA, 1452 bp, Cryptosporidium hominis
atgagtattggagctcatagtactagagaagaagctattgaacttagaatcatttctaccgttattgaagctgtaagacagtttgggtttaagattgatattgaatatattaaagagtttattaacaattataagctcccaaacaattcagcatttccttctggaagaataattctggattatataatctcaaagttcccaaatacccttgggacagcaattaaaaaagctttccaggctaattcatcctcatccaattcacttccctactttattcaagctgaaagaatcatttcaaaaaccctagagtctcgaggatgctttattcagaacaaagaaactagtattgatggaaggagttttgaattgagtagagatatatcaatttctccaggaaataaaagtgtctcatactataataccattaattcatgtctttcttggaaaacttttggatattttaatctgatttcatgttattctgttctagtgaattctggaacttgtgaatcaaaagaggttatcttagaggctgtattcgaactggaaggattgaatgaatactctcaagttgagttatcaaatccaattgtaaatatggaatgcaaaagaagtcaaggagatccaatgcttgaaggacttgaacacataaatcatgaactagaatttatggaaaatagggaagcagccatggaaactttggatttcaagttagaaagccaaaatatagacaataatatattgaaagaagtagagctcgacgaagttttgactgaaaaagacaaaagtaacgaaaaacaaaatgacaatgatgaaagagatgtgacttctcctcaattaataacagaaggaaattgtgatgtatttgttgaaataatagctaaagaagatttggaaaatgctcaaactgataattattctggatttgagtcaatagaaaactttgagcttacaaggaaatcttctcaaatgtcacataatttgacgggaataattagttttgaagaaactaatgccaataatgaaactgaaatcatagaaaagcaaactgaaaccactaaccaagatgaaaataataatggttatcagccagacactgaacagatagaaattaatgttgatattgaagaattaaagcaaaacagccgagaaaagttgagtaaacttgataatgaaaaagatatttttgagctcgtaaaaaatatcaaaaacagtaaaaatgataaatgctctcctttctacgaaaaatctgaaacctacaatagcaataagtctatcagatcttcaccatatgaatctctccaaggaataaagaaaaaaagttttggagtatttgataaactaattagtttagcgcaaaatcggagcattgcaagacctatttctaaagatctatcgagggaaagcattcgagcaattgaaataattaaaaaatctagaaaacttaaatag

SEQ ID NO: 3617 - DNA, 855 bp, Cryptosporidium hominis
atggaatgcaaaagaagtcaaggagatccaatgcttgaaggacttgaacacataaatcatgaactagaatttatggaaaatagggaagcagccatggaaactttggatttcaagttagaaagccaaaatatagacaataatatattgaaagaagtagagctcgacgaagttttgactgaaaaagacaaaagtaacgaaaaacaaaatgacaatgatgaaagagatgtgacttctcctcaattaataacagaaggaaattgtgatgtatttgttgaaataatagctaaagaagatttggaaaatgctcaaactgataattattctggatttgagtcaatagaaaactttgagcttacaaggaaatcttctcaaatgtcacataatttgacgggaataattagttttgaagaaactaatgccaataatgaaactgaaatcatagaaaagcaaactgaaaccactaaccaagatgaaaataataatggttatcagccagacactgaacagatagaaattaatgttgatattgaagaattaaagcaaaacagccgagaaaagttgagtaaacttgataatgaaaaagatatttttgagctcgtaaaaaatatcaaaaacagtaaaaatgataaatgctctcctttctacgaaaaatctgaaacctacaatagcaataagtctatcagatcttcaccatatgaatctctccaaggaataaagaaaaaaagttttggagtatttgataaactaattagtttagcgcaaaatcggagcattgcaagacctatttctaaagatctatcgagggaaagcattcgagcaattgaaataattaaaaaatctagaaaacttaaatag

SEQ ID NO: 3618 - DNA, 1713 bp, Cryptosporidium hominis
atgacaggtgctgacgagtttatgtatggagataatacatgtaggttctcaaaaactcctcagaatatcctaataattaagagaccaaaatctccaaactcaacaatattagcagtggaactgtcagtatctttaactaaagtgtatgatgctgttgtatattgcgaagatgaagctataagtgacatgaaagctataaatcctgagctagaactaaattcaatatcccaaactaaagttgatttgggtgagatgattgatcttgcaatttcactaggtggggatggaacattgctttggttatcacacttatttcaaacatcagttcctcctgtaataagcattgcaatgggatctcttggttatatgtccttattccactactccaaggctaatgaaattattgatagaattatgaggaaacagacttttgcagtttccttaagatcaaggctaactctttatattcctcaagaaaatggagatacactacaaacttcttgtttaaatgagtgtgtgtttgaaagaggaagcagacattgtcttgcctctattgatgtttattgttctggaagctactttacaagagtatttgctgatggcttaattctagcaacaccctctggatctactgcatattcaatgtcagcaggtggaagtattgtgcatcccaaagtttctggaatactcttcactcctatttgcccccatacattatcttttagaccagtaatactaccaggttcaacagaacttttgattcatgttccagaatcatccagagatggcgtccaggtcgctttggatggaagaagagttgcagaacttaggattggtcagtttgctgcagttacaatgtgttcataccctcttcctttggtaatttgtccgcaagtttttgattatagagaaagcttaagtccaggattggaattaagaagtaaaagaataattgactccacctacacttatcaagatattcttcaaagtatacgggaagcaaaaactatgaactctttgggaactgatgagcattgtatttattcaaatgatagtcaaatttttgtatgtccatgctgtagaaaaccagatagttgtttttgtgggattgaaaaagattttaatattagtcaagaaaatgattttaaagaaaaaagacttttatacaaagaggactattggttggattgtttaaataattatttggactggaattctcagagagctgctcaaattcctatagacttacaggaaactgtttctggtaccaaatactcagagtttcagtcaaacctaagtaaaaaaagcaatggatatagtcctagaagccttactaatacagatagaaagattgcgcctcctgagactttaaagtttcttgagaaagtaagagtaatttggaagcatgataatgaatttaagcacgaatgtcttcctgactttaataattcagtgacatgcttaaactcaaaaatcaggtatccgtcacctcttacagcaaaaactccagataacttattatgttcaactacttgtagaaacaagatggaaaattcaatctccatgcaaataaatgcaacagattttgattcgtgtaattggagtcaaaagagtaataatacggattctacagccaagtctaataaaagtaaaactcccttctttactcctgtaaaaattccaggcgtaataatcttagatcgtaaactataa

SEQ ID NO: 3619 - DNA, 432 bp, Cryptosporidium hominis
atggcttgcgatttcagtcctaagggaaaccaaatagctttcaccgataaggattcatttctttactttactcaaattagtaaaaaattagaattcctaaactcttcccttaaatggaatggattgcccctaattaatttaaaatttgtgcatgaaaatctgttggccgccgtcggacatgactgcataccggtgttattcatgcaaacaaatggttgcatgtggacacatgcaaccacgctaaatggcgccatactgccaaattatttagacccagtatggcaattgaattttgacccaataaaacattatactcagaattcagtgcataagagaccgataatgaaggttttagttccaaacccatcaactttggtttgttatggttttgacggtaaatattctatatgggagttggagtcccatgaatag

SEQ ID NO: 3620 - DNA, 2892 bp, Cryptosporidium hominis
atgattgaaaacaatgaaagagagtttcaagagtttctggattttgataacccagatattgagaaaatcatggctatgcttaaaagtatgagagaggttgagaatgttcccacaaagcacctttacttatacctatcagagctattaaagttaaatggtttgggaggagaaattccgagaattgttatattagggcaacaaagcatgggaaagactacagtaattgattatttgataggtcatccattaggatactcaacaaacgatattggaacatgttgtccgattgtgtttcatatatctccttctgaagaaaaagatagagagagttgtttgtcttccaaattagtatctgactgtttattagggtcaggtattcttaatgaggaagagatcacagaatgtttaattggaggtgaaaaagtaaccttcgagacgcttcctgaaaagatcttggagaggatgaaggaaatcaaaatgcaaataagctctcaagagttgagaatagatatcagatccaaaggtgctatagaaatgattattgtagatttaccaggtttaaaagaagatacaaaagaagggtcaaagataacacaaaaaatagttcatgagtatgtgaagaaccacccaaatgacatttatattcttgtcaagagatcaattgatgatcctgctaattggtcttggaggcaaaaatcatttcttcttgaagaattgggattaggaaaagaacaagcaatagttgttggaacccgagctttggaatatctgcaggaagaagttaaagaaatatccaatggaaagcaactactggagagaattaaaaagagagagctcagttctggagatgagtctggagctccactgcctttgttcatgttggaattatttagtttaagtagggaagaaagagctattaaaaaaatgagttctagaaagaatgcaatggaaaggagaatttctgctggtgagaaagccataaaagagattataacccaactttgtgatcaagatcatgaaacagaagttaaagagaggctcctatcttacttctcaagagatttgtttgaaatggaattaagatctaaatttggtcgaatactcttaaaacaacttaattctctagaaaagttgtttaaaaataaatcatgttcttctatttatacttgtgaggaattaccaaaccaccaactatggagagaagatattatcttaattataagaaaatttgctgaaattgtctatgaaatagtaactggtaactttaaaatactagatttcaatggaagtcagtttttggataactttggtggaaacttatggatgaacttaaatgatgccaaagaaaccttaaatgacgaaaacctcatatatcgaaatcaaaataattcacttaataagcaaaaacaaaattatttaatgggatcttttaagctgaactcctcctccgaaagtatttatcttaggcagaaaagaagtccatacttaatcggaaagtttatctctttaaatttcgtttccgattcttctaaagaaaataactctgatctaatcaaggtcgaattccaatacaaaaagaaggatggactatctactggagatcatataaagtatcttagtaaaagtcaactagtaccagttaagaaggttcaagtatctaaagttgagcagaataagtgctactggcttgttggattcaaagaagaaagatggaagaaactaatcccggttcaagttttgtctaaaacaggaaataaaatcttttttaaacaaatagacgatattaaaacaatagcaaagaatataaatgaaaatgaaggcagtaataacaaagagaatactagattaggagagaattctggattatccaaagatacaaacagggatgtttactatttggaactttgtggagaatatgctctgtatattgattcaaactgggaccaaattgatattctcaatcaatctgttgatcaaagttcagatattctggaggaaaaaactagttatccaactcaagttacaaataaaagaattgaatttactcaagatattaataagtcaaatattaataatgacccaatgtatgatctactactactaaatgaaatgtcattcagactcatctttaaatggtttaaagagacctttaaatccctaaaactaaaaagtacttacaatgaacaaatattatgtcaaatgcttagaagtgtttcaaatgtaataagtacctcaaattgggaaccagctgttgttgatgtactacagatgaatgtaaaagagttggttattcctttagttaatttaacctcttttgcttgttctgaggctttaaagagaattatgaaagcagctttgaatgtactaaagaaagaatcagagcaagtaacaacttcaaatcttttgttcaaatcaacagaattttcttcagtatttaaaacaacaattgatcaattttgtctagagaaagcaagaatatgttcagaatccatgaaagagttgattatagaacaagccagtgcaattgtaatggatttgaattatgatgatctgtatacagactgggagaaagtacaccaagcttccaaaagtcattttgagaaactcaaagagagcctttcttcttctttatgtaccaagctatatcttagttttgttaatgacttcaaagaaataggaattaggcataaacaaaagcttaatatagagagttatctcaaagaatccatattagatggtttattatcagaagaagaagtcatccaaagatataaactagacaaagctatcaaagacaatgaaaaatttaaagaaaaacacaaaaatctaaaagagaactacttgtttattctaaagatcataaagatgttgaaatataatattcaaatttga

SEQ ID NO: 3621 - DNA, 2976 bp, Cryptosporidium hominis
atgaaaaagttagtggatagcagattaaaactgctattggaagaatgcagggagaagagagttagatgtatgtttatgatagttggtgataacagcaggtaccagatttgtaatttatattatatcttaagtaatattcattcaaagaagccttcagtattatggtgttacaagaaggaattgggatttagtagtcataaaaaggtaaggcagaagcaaagaaataagaaggcaaagcagggaaaaatagatgaacaattagaggatccatttgagctttttgttacaaatgcagaaattagatattgttattataaagacagtcatagtattttaggtagaacttttggaatgtgtatacttcaggattttgaggcaattactccaaatattttatgcagaacaattgaaacagtttctgggggaggtgtgatttgtattacccttcaaacaatgtcgtctttaaggaatttatatgaaaccgcaatggattttcatggaaagttaaaatgtaatgaagatttgtattcaggaagtattatttcaagatttattcccagatttattctttctttatcttcttgcaataactgcgttgtagttgatgatgagttgaatgtacttccaatttctagccatatcttggagatgaaaacatctaaaaagaaagaaattgattctgttggtgaaaaaagcaatggattcctgaaatcgataggtagtaatgcattattatgcaagaaaactccagaacacattcagttggaggaaaatattagggatactgagattggtaaagttatttctaattgtataacttttgatcaggctcaaacagttcttaaaatggctgacattataatccaaaaaaatatgaatgcaatcatttctttaacagctggaagaggaagaggaaagtccgcagcattaggactttctcttgcatgtgcagtttctcaaggattcagtaacatatttatcacagctccttcagctgaaaatgtattaacagtttttgaatttattgagattgggcttcaaagccttggataccttgaacataaacattttgaacttgttagatctaaaacaatagactccagagttggaggggatttctctcattcagtttccaggcttattcgagtaaatatatttaaggaccatagacaaactattcagtatattaaaccagaagattaccacctagtctcccaagctgagatagttgtaatggacgaagctgctgctataccacttccaattgttaaaaagttccttggaaatcatttgttcatcttttcatcaactattaatggatacgagggtaccggtagagctctttctcttaaacttattaatgatcttaaaaagaaatcactaaataataatggaaatttacccattagctctaacacagacaatcagtctgattattttgtgaattcattctctgagcttaatttagaagagcctataagatatggaagaaaagatcccattgagtcttggctacacaatcttctatgtttggactctacaaatcctcctctcttttctggggaagatatttctaaagatattgaatctccttctaaatctctctccaagactttggcacctccatctttatgcaccttatatcatgttgatagggatgcattattttcttatcattcagccagcgaaaaattccttcataatttaatgtccttatttgtttcttcacattataaaaataccccaaatgacttgatgcttctttcggatgctccaacacatagaatatttgtgttattgcctccatttgacccgaataccaaaagtatcccaccaattcttgttgcaattcaagttgctgttgaaggttcaataacgtctgaacatattaaagcctctctttctagaggattaagaccttctggagatcttattccgtggacattatgcaatcatcttgctagagatgattttggaaagttaaccgggcttagaattgtaaggatagctactcacccttcagctcaaagaatgggatatggtacttatgccattaaacaactcatcaacaagctggaaagtcttcgtgaaagtaatcaaggctcatattctgatcctattgaacatataaaaatgggagatttaccgaagtctcaagtaaagattagaaaggaaattgttccttctattagagaaaataataatcataattctttggatcttagaagcgaggtaatagaaaggtcaaaagaaattccacccttgttagaacctattgaagatatccaatatattcttaaagaaactgaacgtattgactatattggaacagcctttggtattacttctgaacttcttaaattctggtcaaaattgggattcttacctgtgtatattagacaacaagtcagtgaagtaactggagagcattctgctattttacttagatctattggagattgttggctatcttcatttgttcaggatttctcatcaagaactattcaatatgtatcatctcctcagttcaagcaaatgcctgttactcttgcactttctcttactatgtcttataagaatcttatttctaaaaaagacacaattccatcttctgagtcatgctctaatcaagatctcactcaattgaagcctattttgaatgaaagaaatttacattgctttttaactgataatgattgtgttcgtcttacaagatatgcaagacaaatggctgattattcttctatttctgacttagttccaatcataagtcagctttatttcgaaaataggatttcaaatgtgtctatctctttcttacaatcagcagttttgcttggacttggatctcaaagaaaaagtatcgatgagctttcttcagagctatccacaccttctactcaacttagtgcattattcaataaagccatatgcacgatagattcccatagttcatgttttatatttagcacatga

SEQ ID NO: 3622 - DNA, 873 bp, Cryptosporidium hominis
atgactactatatcttcagcctttcctccagaacttaagaatccagctaaatgcagtagagtccacgatgtttatcagggttggaaacatgaaaaccctacaaagaatccaattattgatttcagaagagtaattcctgaggatgttgctcaactcgaagagcttcataaggagctttttccaatagtttacgataaacaattttatgaaggcattgcttctggaataactcacggctgggtagctgtttggaggcttagagagagtttagaatccagttattttgaaagcgatgagttgattatcggatttgttacaacttctcaagattgtagaattattaaagataatgattataagcatgtgattaagagtatacctgaaccatttttattacaagagttacgtgagaaaattcaagatgaaagttttgaaattagtccatctccatttggggtgaatgtttacaaatatctagtttatattttaacaatgggagtagtcgaagagttcaggtttcttgggattgccaaacaacttttaaatactgtaataggatattatcagaaattcagcccaacagttaacgcattatttcttcatgttgttgattataattcaagcgcaatcaacttgtatagacgtcttaaatttgaagaaattctccattggaataacttttacaaaatcttggacggattttatggctcttatctcttttcctacaattatgatcgatcagattctacaaatttgtttgatagttacattgatattggttccaatttccaagctgatcaaaaaaggaaatatggcatttttaattatattaataagttcatttctaattcatccaaactccttaagaattag

SEQ ID NO: 3623 - DNA, 1167 bp, Cryptosporidium hominis
atgaatcaaataaagtttgagagcttgaatgttcctagggaagaattaagaatcacaaaatgtttaccagctggtcagtctttttcttggagaaaagtctcaaaagattcatttgttggaattcttggacatagagtattccagcttaaagagcttgaaaatgatacactttacaggtgcctttacgatggatgtagcaaaacaatcaaagatgaggagttgggtgattatgatgatcaagaaattgagaatattccattaaagaagaataaggtaataaaagatgaaaagaatatattaataccaaatatagacgatgatttatgtaagaaggagacttcaattaaattatcgatattttattgctgcaattcaactccaaatgaacatatcagacattatttgaaccttgatttcaactgggaaaatgaatccaaaatggcagaactagaacaaccaatacactcactttctgaagcttatatgaactggaatgaggctgattcttgtatatcatcttctcataaagggattagacttttaaatatcgatccaattgaagctctctttgttggagttattactgcaaataataatatatcaagaatcacttcaatagtcaaaaacatgagaaaaaatcttggaacatttttgtgtaacattagtgattctgaaatagtttcctgcaatgaaactgatgagagtgaattagatatagattaccattatttttcatttccaacatccttacagatcttcaataacgcttcagaagaaatgctcagagaaaagtgtggagtaggatatcgtgccaagagtattatctccatatcaaaagaattgaatcaaaaatttgaaagcgatagggtatttgttgactatattaagtctttggattattcgaatgcaacattatatcttcaaaagttccatggtatcggtcaaaaagttgcagattttgttcttttgtctggatttggtttttctgctgctgttcctgtagatactcacatcctcaaatatatttgtaaacacgtgaaatttcttaataatacttcacttagcaaaaacaaatacgtaatgggtgctcaattttttagagacaaatttcgtctgcttcctggatgggctcaacttgttttatttagttcctcagttttgaagtaa

SEQ ID NO: 3624 - DNA, 750 bp, Cryptosporidium hominis
atgagtgatgacatactaagttcactatttgatcctccttcgactccttcatcaggctctagatctacctcagcatcttttctatatgatatggaattgatgcctgaaaagagcgtagtgaatgagaagattattgaagcatctaatagtattatagaaaattcaaatgaaattgtggatttaacaatcagaaatgagagtataacacctgagattcagaatattattgcaagtgtgcatttgcagtgtgagttggatttaaggatgattgccattagtgctagaaatgcagagtataatcctaaaaaggtgaatgcagttgtaatgagattaagagaccctaaatgtacaggcttattatttagaagtgggagactaatgataactggagcaaggctagaaaatgatgctaaattaggtgggaagaaaatggctaaaatttgtcaaaagagtggatttccaaaggtaaagtttacaaatttcaagatggaaaacattatagcaacagcagattgtaagttcccaataaggttagaaggtttggcttatgaccacagagacttttgtaattatgaaccagaattatttcctggtttagtttatcgttaccacccagataactcaccaactaaagctgttttgctgttgtttgtttccggtaaagtaattgtgactggttgtaagaattatcaggaaatctgtaatgtttttgataatatctaccccgttctttgtcaatacagaaagtaa

SEQ ID NO: 3625 - DNA, 726 bp, Cryptosporidium hominis
atgaatgagaaaagaattaaattaaatgtgggaggaatattctatgagacaacaaatactactttactaagtgtaaatggcgattcaaattacttttctgcatatttatcaagaacagaaaacagttataatacaaatttacaaagtgaagaagttattgaattgtttattgatagaaatgggtttctatttcaatatattttagattatctaagaactggaacaattgtagctataccgaataaagaccatataattaggggtttattaattgaggcagatttttacctcttggagtccttatgttctattctttcaaataaactacttgaacaaagtatggaaaagttaaactcaaatattaatttgattgcaagccaaagccaaagccaaagtcaaagtcaaagtcaaagtcagaaccaaagccaatgccaaattcaaagccaattccaaagccaaagccaattccaaagccaaagccaattccaaagccaaagccaaagtcaaatatataaccaaagtcaaacaaatatgtccgatatttcagagtttaatgcgccaatgataaatgatatcgtgaaaaaagaatatttatataattcacattttataaataatatatattctcattattatgatacagagaataattctttaaaggaaaatgagaacaacacagaaaagaactatttaaaattcgaattttctttagatgaggatttttaa

SEQ ID NO: 3626 - DNA, 1023 bp, Cryptosporidium hominis
atgagtcgaaagaggaacctgaagaatattcaagatgatattgatgaagtggaagatttagaacatggtgattttattggaattaaaagcaaaaatttgaaaacaataacatcttttacaaatattgaacgtagagatttaaagttaggaactttattatttggagttatcgaccatgtcagcgaaaaggaacttattatttcattaccaggatctaacactgcaatcatatctatagagaatactctagaggattcaagaactattccaattgaattatttcaagaattgaagaagaaatctcttgaagataggttttctgtaggtcaatttgtaaatggagctattatttccaacaataagattaagaataatatcactttgaaaccttcaatattgaatgctggtttgaactcgaattcaaaatgcttaaatgtttttggttatgttatttctgccttaattatttcaaaggaaaatcatggatttaacctctatactggtattcaaggagtgaaaactgtttttatgaaagttgaagagtctgaatttagagaatatagatttggccagattcttcctgttagtatacatcaattcttcaaggaaaaatcattattgatttgtactccaatttacgatcagaatgagaattcaaaaattggtagaaaagaaattctgagtattcatgaaataaagcctggtcttatggttgaatgtctaattcatgcttatggtaatactaatcaaaaagaccaaatcagccaaacccaaagtcctaacaagaaaaagaaagtctctgacaaagtttcagtacaaccaaatacgaaagtattacaattaaagaaggttgacaaacaatatgttactgagcaggaattggaatcaattaaagattttcttcaaagtgagcattctcttcaagttagcttctgtatgggaactatgttgggaagaaaacaaatgaacattctattcatccattatcttgtttttaccctcaagaatttgaatcttctttga

SEQ ID NO: 3627 - DNA, 1506 bp, Cryptosporidium hominis
atgaatgattttaaaactgtagtaaattcactttcaaatattacactatttaactcacaaagtcaaaagaaatctcaaagtaaaatcaactttttgaccagaatttccgataaatggatctcaatttccaccaaccaattctctaaagattacgataaaatcgatcaaaccatcaaaacacaaccatttagagttatttcccattctagattagaaaactctttctttgtttcatttgatcaaaaagtagtacaagagaaatacttctcatcatatgatgcacttcctggtcaaattgttaaagccactgttactgaagttaacaattggggaatctctgttagactatcagaatatttctcagggagagtttatgcagaacatcttttcaatagttcaagttcaggatcaggatcaataacaggaacgaatttgagttctaatagctccaaaagtatgtccaaagaacagatggactacataaagaaacattatcaaattggaagaagctatcaattcaaagttttaagatatgaatatagtgataatagctggaatcctctacttcttcttacagctaaacatctattaatcaatgatcaattaccattagtaagatttatcgataaatccctaaaaattggacaaaaagttacgggatatattagtagaatatgcatacaaagtactcaaaagtctaattatgactcagatttgaaccaatctgaaaaaagtgactttattattattagattctatggagaagcttatggatccatgtcttacaaagaatatatcgactattatcaatttgataatattgatggtatttcaaaaaaaccaaccgttggagaggtaattactgctcaaattaagagtattgatttaaccaataaatctttaaaattaacttttagaatggaaaataatggaggagttgaagatccaaaaacaagctccaatactcccttaaatagacaattccttgctcaactgaagaaccttaagtactctttttatgatggaatctttgatgagactaatatcaataccaaagaatttactttattaggagttacaaatcagggtcttttattttcacaagatttaaaagatttagtatatgtacccaagttctctatatcagacaataaggaaaactctgaaaagatttattgtttattgggagaggtatatcgaaaatctaaatctgtctcagaccttaattccaagatttcaaagctcaaattagctccgagtactttaacagatactgtttcaagacaaactttggaaatgagtttaattggaagttctggatctagtattaatgttgagaataactctattaatttgaatttgaatgtcaagttcggatatctaaaacattctattttgaatggaaaacaaggagaagtaattatcaaaaacttgaagagtcttgcaaataataccttatgtctgggttatattaatcatattgatcattatggattactaatatga

SEQ ID NO: 3628 - DNA, 1233 bp, Cryptosporidium hominis
atggatattgaaagtgttgagacagtagagagtgaaaatgaggaggaactcaaagatgtggacatgacacttggattgaatgatgaaggactagagtaccgagaatctgatcatatgaatgatggtgaagaggatttcttaggaaataagaacttagaaatgatgaaagaagattcagaatatgagaaaagtcaagaatccaaatcaaagctggagactaagaacttgaacaggaaacaaaaagtacagagacaattggaacatgagcacagaatcagagaagaagaggaaaaaagaatgagatcacatcttaatccctcaacaattgatgattttgaaagacttttaataactcacagggatgtctcatcactttggataagatatatgtcatattacttagacttagaagacttagataaagctcgaatggttgcagaaaggtctttaaaacaaatctcagtaaaggaagagatggagaggtggaatatatggattgcttatattaatatggagatagcttatggtaagaatgagttacttacaagtaaaggagagaataatatttcttctctgggaggaaaggaagatggaattccaaagaacgttagacaaatcttagatcgcgctttaatgaatgttacagatcaaaagaagctttatatacaaatattcagttctttgagaagacattcaaaagaggagcaaggtttggctttacttgaggaaggactaaaaaaattccaaactagtagaaagctttgggtaacttatttaacttgtttatacgagagtgataaccaaaagaaagcaagggacgaggttattcaaaagtctttaaagagtgtatctaaggataaggtggtgcgtttgattacagacattgcgagattagaatttgagtatggtaatataaatagagggaggaccatttttgagaatttattagaggaaaactcaaagaggatggatttatggtctcaatattttgatatattaacaaaactttgtagtaaagacgatcctaaatccaactcttctatggcagatcacatagaaatggcaagatccatattcagctcatgcatagaaaagaactttaagccaaggagtatgaagatgatcttcaccagatggctatcttttgaaaaggagtttggatcattacagactcagaaacacgttcaggatcttgcaattaactatgtgaacaagtttgaatcaaatctttaa

SEQ ID NO: 3629 - DNA, 1302 bp, Cryptosporidium hominis
atgttaggtaaacaaaacgacagaaacaagttcttattaagactcacatgtgaattttatatgaaagcaatgagagaaattcaggattacttgagagatgaatatgaacagtatgattttaaaaagattcaagtagaatcaaaaatctatcacacttggaaaaagctttatttaaggtctccaagcgatgcaatgtggtacttatttaagcaaattattccaattagaggagatttaacggtatttggcctcagtaatggggatttacctcttttacccactaaagaaagaatgtctattcctgatattcctcctgatttctttgaatacacaacaatccctaagtcctgctctaataatttggttgctttatctctaaataatggctaccgaattcagcttggaattactaagactccaaaatacatccaatttggtaaattatataggtactttgagcattcactcactacatcctttacatccctcaatctatgtatgagaactatcaagttacagactttatatcaagcctattattaccaatctgtgaatgaatacagaccagatccgagcagctatttctattggcagactcccgattgggactcactttctggatatattagttaccttccatccaatagcaaagcacttttccccagcagaaatcaatttgtttggtgtctcctttggactactactgaatatactcgaacttttgccagatttagaatcaatccaataaagatcactgttaaggacattctacatatcccaatgaagatgcaaaaaattggaaacaggcctaatttagaggcatgctttatacttattagatacttttggcttgcaaaacttattaaaattaataaaagaaaatacagaccattgaagaccaactcacctagagatgtaattttagactactcttcaatctattatgtttgcattgcaattctcaagtgtagagccacttttcacagatcatatctcaagcattttagacaagaagatattaatccagctattgaaaaagtatttgatactcaagatcctcatggtgactataataacctaaataatagattcctaatcctcagtattcctaagttaaaatcactcaaaaaagttaaagctgtactatatggagtagtctctactgtattatttggagcaattactggaattactctcctcaacattctaactaataatcaaatttctagtgatcaaattatgaggtctggatatcataatcctttacaggatttcaatttgattcaagatttcaaattttga

SEQ ID NO: 3630 - DNA, 900 bp, Cryptosporidium hominis
atggaaaagaaacataaagatttgtttttaaatgcaaaacttgatttgttaaaaaagttaatttctgaggatgaacaaatgttaaagaatgatgtttctaaagaagagaaacaatcgaaagatggattattcttgctttattttcaaaaaagagcaaataaattaaaaaacaatgttgagaaggtaatagatcatttaaattcaatggaaaataatatctttaacaatacaaaactttatgaattcattgaccaagaaaatccatctcctaacgtattttctttaattccaataatatatttaaattccaaactttggaatgttcaaaaacttttatataaataccctgtttcagttaaagtaaacttaaaaatgcttgtaaatttatcagaaactcttaaaatcggtgagaaaaggcttggggatattaaagttggagatatctcaacctgtattaaagttaccaccattttttggaaaaatcagggtattaaaataaataatcgaaattttaggataattaacccagatgatatatccgaattatatgaaaaaagcaacgaattgtctgaaatttacatggattatgcaacattatacttactttgtgtaaaatcagtttcacaaagcttaatttattatagaagaattcttaaatattattttggagataactttgataattactggaaattcaacatgttattagatatgaataatgaagaaagctccaatagtttccaatatatcaataagaagaatatacatcttcattctctaccaaatgattttattatgccaaatttaacaaagggaatatatatttcaattttgagtgcttaccttctattgacagtgggagcagtttgtattcagtcattaattactataatactttaa

SEQ ID NO: 3631 - DNA, 1818 bp, Cryptosporidium hominis
atgttcccaaaagaaaagcaagaaatggaaatcttagatgaaaatcttaatgagttggatgcaactgttaaaaatcttgagaatgaattactcttgaagaaaaaacaatttgcttctccgggaagcctgagttccgtggataatagttctcatatctctagtattaataataaagaagattttaataactctccaatgaaagaaaccagaattgtaaataagaatgaattagatagcagaaactttgattctattaaagagaaacaagagatcaatgagaagcgtaataatgagaataattacatctctgagaggcatattgaaaataatgttgttttaagtagagttgtctcaactaatatttccccaaaacgatcaaaaaacttgataaatattgaacaaagtccagaatctagtatatcgtactctgatatttatggaacttctcctgagttgaatccaatccaggaaaaaggagttccactggatctccgaggttcagtcccaatccagattcatcagcctcctcaaatccctctatcgcagtcatatccacagcctcatcaaaatccaatgattgttcacccaattcaaatgccaccccatggacacggggctcaattacaaccaatcccaatgcataaacagccaaatgaatatgttcaaatcgctcctcaaattccagttttccactctattcatcagcaagaacattatcccccccaaatgcagttaaatggtagaatgcaatcattgccagcaacgattcaaactccaaatccatttccttatcaaccacaccatcaacttccaatgcctccagtacccccgcaaaatatgcaaattccagttcccatgcccatgcaaatgcctattccagcgcatttgccaactccaatgccaatgccaatgccagtgccaatgccgatgccgatgcaaatgccaatgccaatgccaatggtagctccaggcccaatacaaatccctaacatgaatatgaacccccctcacctcccaccacctccaaatatgcagatgcaattcgatccaacaaatattcacccaatgggtatgccactacccacaatggcaggcggccctcctccacatattcaagctccaatttctccagaaattgttgctggagtagctccagggataccaggtccctctggagttcaagcaccaaatgttccaaaccctcttggaatggactctcaaatgctcgctaaatacttactcacagcaatggcagaagaatgtctcactaaaaaaaagtcatctggaactgaagatggaaacggacctccgaaagatcaagcaggtatttctcaaggtggtcatacaaacatctcaactagcacacttttccaatctccaaatattcgtccacttatccaacctccaaaagttgaaattgacttttcttctcccgcatgtttttctcaagatgtattcaaaaagaaatgtaaaagaaggccaaaaatggcaaatccaaattacggtactccattgtctggtggtcaatgcccttttccagatcaggctccaattttagctaatcaaagccataatccagagttagaagccaacactgaccaacaatctcagatttcgcccccttcttccccaacatgtttttcatttaaagcttctgtaccagtaaatatacttggagaaaacccattttctgaatcaatcacgaaaattgttactaataaagcttctcagtctcatcctaatcaatacatgtctaatggtaattttaacattaaatctgggttgaatttgccgattcatccaccaatgcatcactag

SEQ ID NO: 3632 - DNA, 4476 bp, Cryptosporidium hominis
atgcaaagtaaagttaacgtatcaacaaaagaatatgtcacttttggtggaattaataattgtatagtatattcagtaatttctcagaataacaatgtagaaagtaaattccacgaagattcacataaatttgattatcctgtatacattactccaatttgtcgtagactttatcttgaaaaagtttacttgatatttcaaatatttacacttgggataatttcaattatttgccattggtttccaaacttttacagatggatgaactttaaagcttcaacaattagtgaatgtgactcttttttagtcattacaaaagaatcatattattctgttgttaatagaaataagttctttagtttaaataagaacttttcaaatgacgaattaaatcttttaagatttcttaatattcttccatcacaatataaatttagtgatttaaaaggacaaaagaatagtaacaacaatatatcaaatagccaccgtacaagtattataaattccagtaatactcaaatttgccatataaattctcaattatttattccagcaattgaattaacattttttacattctgtggttcaatttatgtttttgattcagtattaaacaaatttattattacaattccttcacttgataataatccatattcagtgattagaaatagatttggaaaacttgttggatcttttctaaataatgaaaatacagatgattcaaacaatatggactcgattgaatacattcaagaagattcaataaggcaaaatcttcagaaaatctttggtaaatgttcctgcgatattcctattgttccaattgcataccttattaagaatgaaattttacatcctttcttcatatttcaagtatgtgctgtatgtatttggttcagaaatagttatgttgaatatgccattttcattatattaattacaatagtttcattaattaattcaatatatgaaacaagatgcagtcatattaagatgaatgaaatatcaaaacttgaatataaagtttcaataatatcaagaaatccaacatctagagaaccatatgaacgaacaattaactcttcagatcttcttcctggtgatctaattatattaaaacctgggatggtgcttccatgtgacgcaataatattgacttcaaacgttattgtaaatgaagcagctctgactggagaatctgttcctgttctgaaatcaccaatacccaaatattccagtgaactttttgattttgaaaaagataataaacatattgtttactctagaacagttgtaatgggagttcaaggagcgaacaatgtccaaggagttggtcttgtaataagaattggattttcaactcttcaaggtagatttcttcaaacaatgtattgcgatgtaataaccaataggctacattatcagaacgataaactttatcaagattcgatgagatttgttaaattctgcttctttattggaataattggatcaattattactgcttctataggacttaccattggcatagaaccaatagttatcatactccgctcttttgatttattcacaattgttgctccaccagctctacctgccactattgctgcaggttcaactgtagcagtaaggaaacttaagaataagaaggtttcatgttctaatccaagttccgtaaatattgcaggtcaagtaaatactgtagtttttgataaaactggaactcttactactgatggattagacgccgtaggatgtatatcgtcagtacctggttcaataccttatctagatggattatgtacatcaggatcccaagcaacgcatcttttatctcaagctcttgcaacttgtcatactgtgagttatatagataatgagcacacacacagttttggtaatcaatataagaacgaaaataatggtgcagagcagtcgctaaattcgagaataattgttggtgaacctttagaaatgtgcatgttcgagtttagtggatgggtattatgtgatgattataatcgaaaccatattcaatgtatgaatgagaattatgagtgcaacgttgaatgtctgaataacaataataatggcaagaactttaaacctgatagatcatgttcaaaatcttcaatttctgactctactccaaatcaaatcaataagaatactgtgaaagattctttatctgcacaagtaaacaataattcaagtagcaactttgaaattgatatcagctttatgaaccctgaaaactttgatctttctgaacttccacctccaagaactgttagaagatactttgaacgtggggaaggaactcatatgtttggatcacaagaatttgaagaacttgagattcttaaggtatatgaattttgctcaaagctacgaagaatgactgtagtttgtagaaaccctattaaaccttatgaatttttggtcttttgtaaaggtagtcctgaacaattaaaatcaatttgccagccggaatctattccttcgaatttagatgaatccattattaactattcaagatgtggaatgcgtattcttgggtttgctgttggtcatattaactgtccaaacgaatatcctacatctttcttagaaaccttatcgagaaatgaagcagaggaaagacttaatttcatcggtttaatggtatttgcaaacaaacttcgtccaagtactattgatgttatttcaactcttaaagatgccaatattaactgtatcatgtcgactggagaccatatttttacttctgtagcggttgctcaagaatgtggaatattctcatcctatagttcaattggaggagggcaatctaataaaaagattgtaattggtgatattattggatctcaatctggagaagaatgtataagatggacaatgatgaactgtaattacaagaacatcaaagtttttaatagtattcaagaaatattggagaaatattcacttgaaaatattaattgggtaatcacaggacaatgtttaaggttacttcataaacttcacaatacatttgaacttgaatatttagacttatccaatgatcctgaaagacctccaaatcataataaccacactttctctttcttgaattacaataaaaaagctgagagattttatagacaaataagaaacaatcatcaaagtctaccatgttggatgactttaagatccaatacacgtgaatctagctcaaatcgtcttgaacgtataattattgatactgacgacggagaagagtttattaaatctgattacgttccataccatctcgactgcaccagacatcaaaggaaatctaatataattttggaaagctcaattggagttgctaatgaacttgagaaattaatgattcttaattttgttacaatggtgaacgatattcctttaacattacgtatatcagctttggaattcattattagatactgtcatgtatattcaagaatgacacctgaagataaagccatgcacattaacttacttcaaaagcttaagccagatccaatggttggtatgtgtggtgacggaaataatgatattcttgcaatccaatctgccaatattggaatagccatagctgatcacgaggcttctgttgctgcctcatttgtttcaaatgaaagaaacattgcagcagttccagacatcattgtcgagggtagagctgccctaacatcaacaattcaatcattccagttctttgtattatatatcttcatccaatttacctcagtactgtatttatatagtaagggtacaaacttcacagaccatcaatttatttggaacgatgttgttactttcctcccaatttctgtattggctacattaactaaaagcgctaaacgttttccatcagaaatacctgcttataaagatattctaagcagcaatgttattattggaattgtttctcaatgtgtaattcaactgaccttccttattataaacattatggtcgtttccaaacagccaggatttataccatatttatctggaagaagttatgctgataacaacgagaatgctaaacttcaaatgtgtgttgaaaacactgtaacctttcttgtttcctgtattcaatatgtggcaactggaattgcaatccacaaaactaaaccattcagactctcgctatttacaaacaagcttttcgttatccaaatattttttatcataatttcgactattgcaatcattttggtaccaacctctttactttccaaattccttaatattgtcccccttccgggttcttcaaactatattttaatcatttcatttaccttgaatattttcattagtatattcaccatgaactacattattaaagcagtatacctaaaagaattgcacagtaatggcccaacttattttcctcactttcatcctcttcgaatgccaaagagcaaactggaatggaaaattaatccgaactttatttaa

SEQ ID NO: 3633 - DNA, 312 bp, Cryptosporidium hominis
atgtcaaaaagagtggctgattttcaattaactattgaaaattatgatttagaggagagaaagttgtgtggattatcgtctaaagaaaatgacaagaatgaggaaggtataggaggagatgtaatagaaaataaggaagagataagtacaagaaagattgttagaataagaaaaaggtatgatgatttaggtgattctggaagtttacttattacacctgatactgccacaaattctgagtcgattccactagtttcacttttggaaagacttaaaaaaatgagaaatcaggtattaatgataacattatag

SEQ ID NO: 3634 - DNA, 222 bp, Cryptosporidium hominis
atggatactgaaagatttaagattgaaatgttggattattataatagttctcagggaatggtttatcgtataaatatatataataaaaagaataacgaatcatgggatatagaaagaagttttaaggattttgaacaagttgatcaattatttcaatatagatatccaaatattccaaaagtaagtaataattattttattctactacctatttctttataa

SEQ ID NO: 3635 - DNA, 246 bp, Cryptosporidium hominis
atggttttagcatattttttggatttaaatcttgtcgtctcagatgccggtactgctgcgaatacaagtattgaagagttagatgttgatgtattagaatatttcaaagctaaattattgaatatagctaatgcgaatgaaagatctttagcaccaatggaaagaaaagctagggaaaaacaatatcattcttttttaggaaatacccaatatttctcagaattttacgatatggaaatgatgtaa

SEQ ID NO: 3636 - DNA, 678 bp, Cryptosporidium hominis
atgtttgggttatttacgaggtttgttgtggttttctttggcctagttttgtcaagtgtttattctgaagaaaatgaattggttacttatggaagtacagtatcagtattacatcaaaatacaaaatgtcatttatatacgacaaagataacatgggcaaatggtaaccaggctgtcacttgtagcaaagatttggattcagaaggacatttttacattagagaagctgatgctgagtataagggtgcaggctttcctgtattatgtggggagtctattcgtttactacattcagctactgagaagtttgtacaatctaataagtcttcaaaatcaatgataagtagacaaattgagatttttggtggttctggtgaatctagtggctattttagagttgaatgtgaaaagaagaatacagggcaaactattgatgttaaagataaggttcgactttataatattgaagctaaagggtatctaacagttagtaaaagacacatatttgacaacagaaattgtccaagatgtccaattgttggtcaatatgaagtaaccatagttagcaagagcagtagtgataatttatggagtttcaactctatcatgatgcttttgcattcttctagaaataatcaaggagaaaatagcgaccaagagtcaaaggatgagctttag

SEQ ID NO: 3637 - DNA, 276 bp, Cryptosporidium hominis
atgacatggcggtggaatgaaatattaggaaaagaaataataagtaatgattatagcaagtttttggctaagaattatattattaaaggtgttttgaaacgtgtagaaagtataaaaaagaagcagttaaaagtagcaagtggtggtttatttttttttgaatttctttatagaaatactcggatatatattaaaagatcagggaagtggcgccaagtgtcggtaccacctttaaaagaagaaattaaagagggaagagaaaaaaaagggaattaa

SEQ ID NO: 3638 - DNA, 1545 bp, Cryptosporidium hominis
atgaatatggaggacgaaaaaatggaagacacaacaattaatagtgattcagatgatcagagtgagagcagtatgactatgtttaatagtgcaaaagagctgaaagatgctggaaatgagagttataagggtggaaattactcagatgcaagagaaaaatatgaaaaaggtttagaattattggagaaaatagatcaaaaagatgatgaaaaggaaggatttggagaggatgaaatgtcagaattacgtcaaagcttacagttgaatttagcaatgatatatgtgaagattcaggaatggtcaaaagctattcaagtaacaggacaagtattaaagaagaattcaaagaatgtcaaggctttatataggagaggattagctaggctaggctttggaatgtacgaggagagtaaggaggatttccaaaatgtattaaagttggatccaagcaatgccgatgctcacagacaattgaaggttttacgccaaaagattcaggaagataatgagaagaataagagtgggtttagtagaatgttccatggaggtttgtactcagataagcagcaggatgttgagaaaaagaagaaagaagagagagagagaagaattgaaaagtatagtcaatatcttgcacaaataaaatcaaagaattctgaaattggctcagatgatgaagaggaggaggctatgccttttgaagaatgggaaaagaaggagatagaaagggagaaggaggaggagagggagaagacaagagcaaatgaaaggaatgcaaaggagcttagtgaaaaaaagccagcaaccattatttccaagaagaataatgtaagtaatgatgatgtagatttggatgaagaggatctaaagattctacaagaaactaagaaaatggggtattgctactttaagagagagttaacagaacaagagaaagaattgaacaggcaattcactccaactctgattaacaataaagattcttattcttgcgatgcatctcagcaaaatgacttgagctctgcagatattgacaaatcaagagttggaataagctcttggaactctaaaggtacaacttttgaggataaagatgtttctgaaaccgctaggtccaccttaaagaggatacttttagaaggggatggaaggcattttactggaaaagttagtgaaagaggagatttaaatgtttcaatctcaattgaaagtgttgataatttatctggagaagcctcagttgcaatgattcgtggaactagaagatttctctttgacttctctgtcacattgaaatgcgactacactcttgataataacgagaatgaaaagtattcatttagtataaacattccatctctaacttccatgtgtaatgaagacgacgtttttggtattaaagattgtagtatcaactttacaggcaaacacaagcataatcacgatctaactcttatcaaggattttgttttcaacagctattgccttatacatttaaaggaatgtattaatttacttactaacgagattaactcacaatactag

SEQ ID NO: 3639 - DNA, 459 bp, Cryptosporidium hominis
atgagagataataaaggtagagaagaaaactatccagtagttccaactgatagaatattgaggaattttaagcagttatcccatcataatgattcaatttctcaaatggcatcttggctttctttctatagaagttcaggagaacaactttgttctcttttcggagaagcttttgtagataaaagtttgagagaggaggaaagattggcaatattttatgtatttcatgaaatggttactagagcaattacaaatgatgatgaatcgaggaagttttttttaataggatatgaacaatttcttttaacagctgctcccattattagtagactaacttttgaacaaagatctccatacttacaggtagtaagactctggcaatctcaccaaagatttcctcaaaatgtatgtgagagattaagattattatttaattctcagtctggtaagttaatttaa

SEQ ID NO: 3640 - DNA, 789 bp, Cryptosporidium hominis
atgtttgaagctagattatcaaacggagggattttgaggaaggtttttgaagctatcacaaatttggtcagtgatgtaaatcttgaatgtaacgaaagcggagtaactatccaagcaatggacaatagccatgtttctttagttggcttgtacttgaaggatactgcttttgagagatatagatgcgataagaatagaactttgggattaaatactcaaaatgtagtgaaactactaaagttatgttcaaatgatgatcaagttttacttagacatgatgatgaatctgagagtctgattttcatattcgaaacgccaaatggagatcgagtttcagagtttgaactaacattgatttctattgatcaagatagtcttcaaatcccagaaacaagcttttcatctgtagtaactatgccatctaatgaattccaaaggctatgtagagatatggcacaattctcagattctctctccattgatgtaactagcaaaaacgtcagattctcaactaaagggtctttaggttctggtagtatcattttaagaccaaaagaaggagcagattctgaagctgttgcgcttgatgtttcagagccatgccaattagtattttcacttagatatctaaataactttgccaaggctactcctttgagcagtagtgtaaaactcagtatgagtgagaatcaacctcttgaactcgaataccccttagaaggcagtggttctggtcatcttagattctacctcgctagaaagattactgaagacgatgaacaagagtaa

SEQ ID NO: 3641 - DNA, 1326 bp, Cryptosporidium hominis
atgaacaaaataagatatttgtttaatgaagctaatacttggagcaaaattaccaacttcatttcgttaaaccatcgaaatgtgaattctcgaagttcattaaagagtttcgtcaaggatttaggggttgcaagcaatgatggtcatataaagtcatctaccgaaaagatatcatcaaaaattgaatcttcatttttaaatgcagatggaactcaatcctctaaattcttttcgagcacattttcagtattatcagaatgcttggtgaaaataactgacaatttagctgataatgaacttcctagaaacatattaacacagaaaacaaactcaatacagatgttcacacgaaagatgattgttttattcttgtttgctggttttttaggattatttccgggtagtttttttcacaatcaaacaccaggacttgattttacagggttttttagtagtagccgtgcatcctcaaatcaactaagtagctttttaagctactttaatatcatgggacataaaatatctcaacgagatccaatggttagtgagtatgtagttattcaaagacatcatagaccaccgttacaagaatatatactaacaagttcatctttaagtcttaaaccaacgcagataattagtgggttcatggagagtcataatccaggagggcatgtggtagaggcaatcttcgctaataagatatatggcagtgcaacattacataactgcatgaatcaggaagagatagtgatgacagttgtccccgaaactttgattggacgccttttcttagaagatttacatgatgaggattcagttaccataaggggagtaatgaaatattcgaattacaggggatttggtacgaatcaatttacctttcaatcaattaaagagccggaaatgtacatgtcaataccaagagtctatgctgtagttgacgctttatccagaggttctagatttagagaatttacattggaatatgctttaagagaaataaacaaacttacatcagcattatgtgatgatttctatggggagtccgaggaaagggatcgcagtccatttgttacaggatattggggtggaggagtttttgggggagatattcaatataaattttttttacaattaatagcagcttgtatctgcaataggaaattggtatattcagacgggtcacaaaaattggatattaaacaaattaggcagattgaaagtaaatatacaacttgtggccaactctctgatgcattctttaaaaaacataaaactagtggttttagtaaagagaatgctctcaaagtgatgttaacgtag

SEQ ID NO: 3642 - DNA, 414 bp, Cryptosporidium hominis
atgtctggaaaagtaacgagttcaggtggaagaggtggaggaaagaagactacccgtaaaactatgtcaaactctgctaaggcaggattacaattcccagttggtagagttgcaagatacttaaagaagggaagatatgcaaagagaattggtgctgctgctccagtctatctcgctgccgtcttggagtatttatgtgctgagcttcttgaactcgctggtaatgctgccagagatgccaagaagacacgtatcaccccaagacaaatccaattggctgttagaaatgacgaagaactcagcaagttcttgggtaatgttactattgccagcggtggtgtattaccaaacattccaactgtcttgttgccaaagaaatctaaatccaaacaaggaaactcacaagaattctaa

SEQ ID NO: 3643 - DNA, 1602 bp, Cryptosporidium hominis
atggataaatattatgtaactaatcaaataggagagggaggatttggtgaatgctatttgatagagacaaaaaaaggagaactaatgcaagaaaaattggtggccaaagtagttaatatgagtagaatgactgaaattgaaaagaataattccattcaagaaattaaaatacttaatattataaatcatataaatttggtaaaattggtcgaatcttatactactaagaatctactttgtataattatggaacttggtgaatatggaagcttagatggtgaaattgaagcaagaagaaaagaaggacaagataatatttactttactgaagatgaagtattatttatttttttccaaatacttcttggagttaaatatttacatgataataatattgttcattgcgatattaaatctaataataccattttattctccaacggaatggttaaactttctgattttggtatttccaatattttatcatctaataaggatgaattaaataagtctgaaactttttcaaatcctcttgtacaaggctctatttattatttagcacctgaaatatatacaaatatgcaacacgataaaaaaagtgattgttggagtattggttgtttattattggaactatgctctttagaaaaagttttcagaaagtattcaatgcaagaaatgttaatattttctattagaaataaagatcaatttaaaaaggaaattaataatcatattgaaacttatggtgtaaataagagatattctcaagaactagtcaatataattaaagatttacttaatcctaatcctcaagaaagaccaaatattcaagaaatctttcaatctaatatatatatcttgaattttattaattcatttctaaatacatgtaatcataaacattggagtcaatttaatagtatttgtaaagagttaagtacttttaattacaattctgttaataaaaaaaatcatattaatatatcaagaattcctttctggattaaacaagatgtggatactgagaacaaaagctccaagttttttttaaaacaaagtttagatgaatggtttaaaagtcaggagatatttacttgtaatagttattcaaagagtaagagcttaatgattaagaatcaaagttcaaatgaacaaaattgtgaagcaggccaaggtaagtaccaagaaattattgattatttcagcaataaagagaagaacaagcaaaataagagaccactttctagaaaggaaatattattacaacttgaaactactgttgaattctttgtcacacaacttagtgctattaatagtaaaaaagttacaactgaagaaatgattaagagaaatctcgcaaataaacttcgggatagtaatagtactaaaaaatcaactaatacaaaaaactcttgtaaacagccaaagatctcacaaaaactcccatctacaattaacagaacaaatagtaatgcaagcttgagaaagaacctaaaaattaaatatgataaggaaagggaacaattaagagagatcatgagaaaaggaagagctgaagccaaatttaaaggaaatatggaaataaatgatacaagttaa

SEQ ID NO: 3644 - DNA, 429 bp, Cryptosporidium hominis
atggacgaattacatccacttttcaggaataatgttccttctactagtgagttgaagtctaatgaaatttattcagctcttgttgagatttctgctcaaaaagttcaggatacttcaacaaataagaatagatcccaattatcaaaagtagataagaattcatctaagatctctgtattatcaaaaggtattaataaaacacataattctgaaagatatataaaaggcaggtatcaacgtcatctagacaaaataaaagctacaaaatcaagaatggaacaagaaaagagccaagattatcttgataatattactagtaaaaaccatcaagttactgatgatcatcaccatgatcaacaagttaaggagcttgcagaaatggaactttgcatgtctatttggtctaacaaaaacatattttctgaatga

SEQ ID NO: 3645 - DNA, 1272 bp, Cryptosporidium hominis
atgagtggaaaggagacatttattggcggagatgatgtgggagcaattattgtagatgtaggtagttatatgacgaagatagggtatggtggggaagattgtccaagacaagtttggccttcagtagttggagttaaggaaagcggtgataaaaggtttccgttaaatttcttgagttatttggaagatgtatcggtggagccttgtttaaagtatgtggatggtgatttgattttgaatggtgatgtatttgaggagattattagaacaacttcagggaaaattggactttcaacagatttaagggagcatccaatattattaacggaaccgtccaagcataatagacagattagagaaaaggaggttgaaataatgtttgaaaaatttgatgtaccagcagtttatacggcaaagaaggcaattttgagtgctttttctgtaggtagatcatcaggtctagtcgtagatattggagcaacagcaacttcaattgttccaatattggatggatatacccttcaaaaaccactatgtgagtatccaataggaggagattttctggatgaccaaattgccagacatttactaaaagaaaagaatttgagtatttcccctaatttctcctttaaaaagataattcacaaggataaaccattaagttatgaaagtgttaacttagagaaagtgacaagttcatatattgaatatggcaaaagagaggttttaaggaatataaaggaatcgatttgtcgttgcgttgagcacgaagaggttgctaaaacatcatcagcacttgcaacatctacttatgagttgcctgatggtacattaatagactctgaacctattggtattcgtgttcctgaatgtttattaaatcctgagatgattatcaacgattctgaatttcctccagtgaacactaatggattcccaggactatgttctgcaatttctaatactatcatagcttgtgatattgatatcagaaaagacttaataggagcagtgattttaactggtggtacatccataattccaggtttggctgaccgtgtttcaaaatccctggctgaagatgacaaattatcaggcgggggacctaaattgaagattatatccccaaattctacagtagaaagaagattttcaagctggataggtggtagtattttggcatctttaggttccttccagcaaatgtggttcagtaaggaggaatataccgaacatggagccaaattggttgagagaaagtgttctaactaa

SEQ ID NO: 3646 - DNA, 1257 bp, Cryptosporidium hominis
atgtattctaatgttcaaaatcagaatacaaagaatgaatatttgataacaacatcagattatttgctggatttaagccgtccagtgagtaaaaagacaacagtttctgtatataaaggtattaataatatagaaacaattcatacattgggaaagaagaaaataatacaagtgagctcaggattgaatcatgtgttgtttttaacatctgaatttgaaatttattcatatggaacaggattatttggacaacttggacatggagaatcaatacagaaattaaaggagccaaaaaagatacaagaagacattgagggagtaataaagatcacagcaggtacttatagttccatagctttaacaagtaaaggggagatatataggtggggattgtatgatttaaagagtccaatagtatttaaaccaaaattggagacattttttggagggaagaataaaattgtagaagtggaatcatataaggaaaagacatgtatagctttagataatggtgagatatatgcttgggattttcataatcctaggatggaattaatttgtaggcttaatgatacaatagttaaacaaatttcaattggtgcttattttactctagttttagattcagattcacagttgtttgtttggggtgataatacatttggtgaatttagtgagaatgatatgtatatttatgatccagactttccaaattttagtagattaaaaatagaagcttggggtctttccacaaagaattcaaacttgaaatacataaaagaggatgaattaccaaataatatatgtaaagatacgaaaattgaggagggtttgggaggtaattctagggaaatatatatagaaaagattacatgtggtgaaaaacattgtttaatattaacttcaataaattctattttatgcatgggagataatacatatggacagtgtggtatacttgatgataaaaaaagcatttatcctccagtaacattgaaaaagtttagtgagttggatcttttaaagccatttatttcatgtggaagtagatcatcagcaattatttctccaacaggtaaactatttttatgtggccagttatttagtaattctaaaaataataaaaagattggagtttctagatatgctgataaaattgaagattttaacagactttacacagaatattcaatcattcacagaaactcttctgtaattgacttcaatgataaaacttttattgtaatttcaaactag

SEQ ID NO: 3647 - DNA, 1185 bp, Cryptosporidium hominis
atgtggtggaatgtttacttatcgaagtcatgcccagtttggataccaccatggtggacagcttttagaataggtggatggaattggcaatactcattagaggttgaattatcttggtttagtccaacagaatcatcaattaataagttatcaagtacagaattggaaaatatggaaaatgaatgtaagaaagaaaataaagattccacaatagattgttcaagaataaggcataaagaatcaggaattcagacttctgtacatacattaaattcatcgtctccatcattctatgatccaaattttggagcttcagtacaggtaataagttcaggaccgccgtttgggagtgctaatgcaaaggatttgaatggttattacatgttacaaccaacattttcaccaaaagggatgcctgctagtattgcaattcctcctttaagaagtgggtgtggaaaagcttcaaaaaaccaaacagaagaggaaatgaatgattgtttaaagccaacattaattattcctccagaaaatgcagactttacaggagtttcatgtgataagataggaacaagtgttcatacttggagttctgtgaatggtagattttgctatcatccacctgggacttgtcaaagagctcagatagctcacttttataagaaagttatagaagatcattcacttggaaagatttcacaatattcagtgagagcacaaaattctggttctccacagttgattttggattcattgggagaaattggtcatgaagaggtggatcaaaatgatatggaaaatataactaatatacaatcacgtagattctttttgggatataattttgattcaatctttgacacagaaataatgttctcagtcgaagcttcttctgtgtcttgggtagcaacatcttctcctggaattattacatatatagaaccaccacctttggaggcttgcacagcaatgagtagttttggctgtcctctaaaggtttatattaagaatagtggtaagtttgaatatatatatacatttcgaattgaattaaaaataacttatcaaaaatattctataggggatattgattcaggttttgtagttcaaataccttattgtacaaagtcaggagtacaaacaagtgaggtaggtttatatttaactcattcaaatttatataattaa

SEQ ID NO: 3648 - DNA, 375 bp, Cryptosporidium hominis
atggaaacttcaaatttgatttcaaaaagatcctctgaaaattgcaaaatttgtgtattggattttgttagagaaaaagccttatatatgtcggatgttccttgtttatctaaagaagaaattatcaaaaattacccaaaagctgatatatcatttcttcctgacaccaactttaaagattatattgtacttccagaagatcatgaacaagtggatcaaagaattcaacaatttattaattttatcaagaattatcaagatcttgaaaataatgaaattgtattggtatcccattattacttcttgaaaaggcttttaaaaggtatttttattgaaattctgattatttcaactttaattaaattaatcaattaa

SEQ ID NO: 3649 - DNA, 219 bp, Cryptosporidium hominis
atgcttcaagttaaaacaatcttgaaaaaatttgttttccaaagaaataacaaaaacttggactttaaaaaaatagtcattcctctatttgggaaaattacaaataaccaaacaaaatgcgagaaaatcgaattcctgcagcccgggggatccactagttctagagcggccgccaccgcggtggagctccagcttgtgttccctttagtgaggagataa

SEQ ID NO: 3650 - DNA, 516 bp, Cryptosporidium hominis
atgggagtcccgacattttatagatggttatgtaataggtatccattgatagtgaaggagttgaaggatgctattgatgaggagacgtgtttaaatgacttagacttaactgagccaaatattaatggagaatttgattgtttatatttagatatgaatggtataatacatccatgttgtaatccaagtggaggagataaaccaaaagatgaggctgagatgttcacgagagtatgtgattatattgatagattatatgcaatggtgaaaccaagaaggttgatttatatggcaatagatggcgtagcaccaagagcaaaaatgaatcaacaaagaagtagaaggtataaaacagctttagaaatggattataataggagagcttatgaaatagctcaggaagaattttataaaataggttacaaatgtcctgaatatgttgagaaatgggatagtaatgtaattacaccaggaactccatttatggaaagattaacaatgtgtttacatgcataa

SEQ ID NO: 3651 - DNA, 2205 bp, Cryptosporidium hominis
atggagtcatattttcaagaacatttatcaaagttgatcaagtatttatcagaagttgaagattataatgaagaaaatatattaatggataataatcaatcttctaatttgaataatagtgataatcttgttaataacaataataatagtaatattgatcaaggaagagtcttattaagcattgacaatccaattaatatattaaaatacagattaagttattataatagaaagttcaatgctcaaattaattatattgatgaaaatgttcaacatgaagaaatagaaatatgtgaaagaaaagaatacaatgaagctaaatctaagttaaatgaaatctctgatcaagtatgtatacattatttaagaggattatcatgggtacttggttattattatcatggagtacctagttgggattggtattatccttatcattatgctccttatgtaatggatattgtcgaattattaagtgatgttaaaaatgaaaacaaaattaaagagtctctaattggtgaatttaatcttggaaaaccatttactcaatttgaacaattaatgtcagtattacctccaaaatctggaaaaatatgtttacctaaagagttttataatatgatgatcgataaaaataatcctttaagtgaattttatccaagtaaatttaaacaagatcctaatggtaataaacaaagatggaaatgggttgctttacttccatttattgatcagaaagtattattagaaactgttataccattagaaaatgaaatggatgttttatctaaatatagaaataaacttggatgtgatattttatattcattcaaattctctccattaaagaatattattattgaaaatcaacaaaaaaaagaaaaagaacattcacattctgattctaattctaattctaataatcaatttaatattataaaaataatagatatgcctatttttggatatttccaaaattattataataattcagatctaaaaattcatcatgatcaaaaaaatgaagatcttattaattttgaacaggtaacggtaccaattattgaaacatgtgaaaatatacaacaaggtaaagaaattattacaagaatgttgaatgatgataaaaataaaagaaattggaaaagtatattagaaagttcatttaattataaaataaatcatccaaattatattattggatattttaaacttgaaaaaatggaaaaaaatgttatatggaaagatccaactaatgagaattttcaaatgtttaaagttggttttggttcaaaaatgttgccaaatactcgtccattttctaattctatttcagaatttgatttaaataatcaagaaagaaagtataaaggatttaaagcaaatcaaagtcagaagattcttttcaaattatttaattattggaatcttaatattgattttaaacaatcatcattctttcaaggaaatcaaagtaaccacaataataataataataataaaagatttatggatcaattcaatgatcatcattattcttctacttctttatcttcccatcactctaattattacctccaacaaggatatgatactaacaactatcatagtaacatcttttcatcttcatcaaagcgagcctttattgttcctccaactacaacttcagcttcaatttctgctcatccatacagccgtttcaataccccaaatcacccatcagggaatcatctatatgatcatgagtacttttcgaggaataaggacagaatctttggcagccgaaatggagaagggagaggtggatttggaggaggaggaagggatggatttggaggagggagagatggattcggaggagggagaggaggaagaggtggattcggaggagatggacttacaggaggaaggggaaggacaggagactacagaggagatccaggccaccatcaatattataatagtaatggtggcaatgacaacagtaacaactacaataattataattcaaacagatatcctccccctccttcacttccatactcatcaacatcatgtgatggtgaacgctcacaaaatcataatatacaatccggtatgagagtcacaccacgtcctaattgttatgactattataatcgggatcctaaatctcaccatttttcccataattattcaaaaaatgaagaaaaaaagaacatataa

SEQ ID NO: 3652 - DNA, 3117 bp, Cryptosporidium hominis
atgtttaagcaaattctaattgtgacttatttaacagtactcctacttggaacagtattatttttttttggatttaatggtgaaaaaactaatttagaacgaaatggttcgcttaatcaagatttcaaattatcggaaattgagtattttgaaattgaacctatatatgataaagtagtttactttattattgatgccttaagaattgattatttaaatattgaaactaaaaatcctaataatcaaattcataataaatttaagtatttaaacgaattgatgagaaatgatgaattaaaaaatcatattcgtttctttaatttcaaagcagatttcccaaccttaacaacctttagagtcaaatctcttatgtcaggagaaaatcctggagtatttgatcttatttctgcattaagacctaaaaataacgcagaaactccaactattttaaaaaatctattcttaaaaaataaaaaatctgtagtcattggagatgatacatgggatctattatataatgaattaattcattataatcacaaatttgaatcattagatatcagagattttgataatttggataaatttgttgaagataaaattaattttttcttaaatcacacaaataatcattatgaaaaatacaatgattggaagtttatggtaaatcattttattggagttgatcatattgggcattattctggtgtttataacgatgacatgaagaataaactctcccaaatggatcaaacagctgtcaaaactttacaactacttctcaaaattaacaataaaaatgatcgtctcactcctaaagaatttactcaacaaatccaaaattttattaaaaaaaataataaatctgaaaaaatcttatttttattattcggagatcacggtcagaatgaaaatggcggccacggaggctcctgcattaccgaaacaaacgcgggcttttttgcattctctacaattccttttattacttctatggaaaaaataccagaatgggatttgccagtaaacaataaaatttccgagcaagtatctttaaatgaaagaattaaaaacattaaagttcttaatcaaattgatactattccaattatatcctcatcattaggaattccaataccagaaaataatttaggtatatttagagaagattttaagatccatctaaaaagcggtaccgaacatgatgatcatcatgatcaagatcatcatcaacaatttttacaagaaattaattacgcgaaagtgatgcataataatgcttttcaaatctttaacagactcctaaatagcttaggaagtcaaatcagattacgggacggtcatattaaatccaagtattatgaattctataaaagttatcaattagttaaaaatgctgaattattaaggattcaaaataaccctgaaagtaatcaaaaaaataattatgaaactttgatcagtatatgtaagaaacattatcaactatcatatgaatttgctttgcttattcaaaataagctatttaaagacaaatccaagtttgattgggtatcaattattcaaggatttctaatcattttttcattatttgtatttgtatcagttattattattccaagctttaatttaagtatgtcaagattcatgtttaatcaaaaaaaaggattcttatctttatcttcatcttcagaatctaatgaagcatcattaaaacaacaattatctatatataatacgattcaattaaaatctggtcaattatttactatttatttaattattattttaatatcatccatttttaatctaattggaatatatctactttctcaaaatttaattgttaccgaagattttatgtattattgtaatttttttacatttacgattatcacgcttattatgatgcacatattgataagataccggtatgagatacattcattttattgtaatatatttaaattgagtttgaataataaagaattgagatggaatttttattggtgtataatgactttattatgtttaatacatttttctagttattcagcatcatttgcaaaaaatgaagggaaagttgtgagatttttattaatatcttatcagattatattattattttctggatcaaaaaataatttaagacaaatgttattaccatttatacaattaatattgatacgttttacatttatatttgattatgaaattcaacaaattctaaattttggattttttaatattcagttattattaaaatctaaaattactatattattaatattaatattttatttatttttattattaataatttataagaatatattaaatagatggaatatattaattatgagtattgcaccagtatatgtttggtttaattggattaacaataatagtattgtacgtattttggctttaatacaattaacaaagactatatataatttatttataaaaagatatcgattaaaattatctaaagaattggataaaagtgcaatagaaacaaagaatattgtagattatagattaataatcaatcaatggcttaatcatcatttaattttaatatttttattaaagaatgaattaataataccatattcaatttctagtataatacaattaatttcaatagagaatttaagattggacggaaaaagttataattcaaaagaaagtaataataataataataatagattaatttcggtacctattaaaggtatcgaaaatattatattattatatttattatcattgaataatttttttaatttaggtaataaattaaagttggaaacgataccagaatatgttggattgataggattggatggttttcatttgataatatctcaattattggtaatatattttttgacatcacatttactttctttatcaattatgcttaagcttccatcattgggattaaggaatccaaagatttggatgatggggataatattatcaaaatacttatttacagttttgggaataattatattaagagagaatataatgatttggcagattttatttccaaagttgatttatgaattcttcttttgtttttctttttctatatattttctattttaa

SEQ ID NO: 3653 - DNA, 2679 bp, Cryptosporidium hominis
atgcaattcaattatgatgatctgtataataaaaaaatagatggttttgttgagtttgagtcagaattagcgaaattaaggaaagaaacaagtttgttatacaagaatgaatatgtgaaggattttttagagaattatcatttggagataaatgaagcaaaggaaaatagtaaagggcgatggaacaataaaggtgagaatcttcaaacgagaagaaattttaagtcaacaaaaaacgatataaatgttggcacatatcagccatacagttatgaagttgagtacaagaccgagcatgaaagtgatgattattccacgaggaagaatgtaaaaagtttgaaggaaagaaaaaaggagaaaactggaaaaaaaaaagggaagaagaatttggttgatggaggaatgattaataataataataataataataataatggatttgctgtattttcaagaaaatatggtactgaagatgttataaatggaaaagggtatttaacaatggatttgagtgagataaaaggagatattgtaaagtcaccaaaaaaaaaaacatctcagattcatggggaatctaaaactaataagaagaaagggaatttaagctcagctagcaagaatcttaagaagaatgatttgaaagactcaaaaaagcaaacaattctatatcataataaaaagctctctaatccagattccaagttagaggtaatttctcaatcatattcaatattctcttcttcttcatcttcttcctcggaagaatcagaaaatgaatatagagatcaaataaaaaagtacaagaaacgtcactattctaagggagatgaaaaaatcaagtattacttggatcaatcttcttcattggaagatgacaatgaaggtggagacgaagatgagggtattcagaaggagtttgaagaccaaacaaatggtctagctgtgagtaatagcttcttatctagattgccaaataatagtcaggctcaagcattgttggcatcccaacagtatgagcaaaacgaaagagaccttttaatgaagagaattcagtctttagaagtaattgaatcttctcaaaaaatgttaattttggaaactcaaaataaagagcaacagtatagaatcagaagtgaagaattacagaaacaggttgagtacaaagatacgaagcttttattgttgaatcaagattatgaaatcttaaaaaaggattttgcactacttaaagatgaaaaggaaatgttaaagaataagtatacggaaatggaagctcattggaatcaagagtatggaaatttatacaaatataaagtagattatgagatcttgagtaaacaaaatgaaactttaatgattgagaaaaattcctttattaatttgattgaggaagataaagaaagatatagaaaaatggaactaaataatactagtttaatgttgaatgttgacaatttagagaaaagaaatcatgaaattgttgaaagatgttcaaagttacaagaagatcatgattctttatctagagaatataataaactttatcagaaatatactgctctactttcagagtatactgcatctaaaaagaatgaagaaaatttaaatgcatctttggtagagctacaggatattaacaagaagcttgatattgaaggaagagatatgaaagaaaaatataagactttatcagctacagagagagttttagagcagcttcaagaatctaatgctgaattaattggtgagatttctgcattaaaagaagaaagagatatattatcagcggactataagatattagaaaagaagtataaaacttcagaagagtctatgcatgaaataaaaaatcagttattagattttactctggaaaatcaaaaattcaaaaagctaattaagcaaacaattatccccttaatacctaatgctgaatataattctactattggacatatactaatggtaatgaatgctaaagaaaattccaggatgagtactaaagtattagaagaggaatatttaaataatattaataataatggtaaaggtaaaaataaggatgaattacaattagaggtttcaaaagtttggaaaggtattgaaagtccattttctccaaaaaaaatctcttatatgatgaatggattatctatagatcatcaaagtagtactatgtcgagattattatctccaaaatctgtctctaagactacaaatcttgagaaaaagtccttaaattctccttcaaattcatcatctccaaagagtttaaaaaataaatttaataatatgaataaaaatggtcaatctccaaagtctgttaaatataattccaatttgaataaatttgaaaagttatcaccaaaaggtcatcaacttaataaggatgaattaactactaaatcaatgccaattcttgatgggggaggtcatataaatgagaaagttgttgttcctaaattatttaattcaactcctgatttatatcatgccgataagaatgaaaatggaaagactttaaatcaaaatcaagaagaaaagaatcatgatagttttaaaaaaggagtgcaaatagtaactccaagacctttagtgattgatgatgatgaccattcaataccagtaatattaccaaaaagacttgaaggaaagattaaagatgtattagaaaatgaa

SEQ ID NO: 3654 - DNA, 864 bp, Cryptosporidium hominis
atgtactatcaaagacctaaacacccatttggaggatttagcaaatattatttggcaactgccacttttcttgtcgtggttctatggatatcatcactttttagtgctaattggcaaaattacgtatatgaaactaaaaatatgggatatattagttttaacctttctcttagagggtttactattaaatcaagatgtaatcgaactaattatatgtggtcaccagctatggatcaatattctcgaaataatagatcaaaaaatttcatttcaccaattagtttagaagagtttgtatgcagtcgatttaactattttaatggtaaaacttttggagaagctactgctgctgtatgttccattgataaataccaatttccaaatgctcaaaatgcgtgttataactttagaatgcttaatattggatcattaacaatgatagcgggaattattggttgtcttgtatgtgtaatctttggatttattacattcatcctttcttataagaatttatctattccgctcacatatgcttatactaccttatttggatgctcaaatcttattgcaatgattactttaccagtatattatgtaaatgctggaggatcttggattgctattaattcattttttagtttggtacattttggatatcctcaatttacattcaaatcaccatctgtatctgatattcaattcttttggggatattcacttgctattcttgcttttctaacttccattttattgccactatttggatgctattttgcctcaatagcaagtgcttataatgaacaacttgataaagaatctaaagaatatcagaaatttattcaaaaatataacaatatttactga

SEQ ID NO: 3655 - DNA, 792 bp, Cryptosporidium hominis
atggttgaagttgaagaatttggaattaggtgtagtaatatggaatgtaacctaattcagtttttaccatttgagtgtatcaaatgtaggaaaaaattctgcatagaacatgtaaattctggaaagcatatgtgcgaaagtaaaggcgattatttagaactagataatggttttaagagaaaatttgaggaaaaagaaaaagctccggtaaattgctcaatgaatgattgttcaaatgtagggataatatgtagaaagtgcaataaaatgttatgctcggagcacatttatgaatctgagcacgaatgtatgggaaagaatagagttataattagtaagactgcacttgatttgaaaagaaggtattcaggaggagaaatgttaagaggatcaaagcttcctgaagaaagtaaatcaagtaaaatgttgaggaaaataatgataaaatcaaaaagtattggagattcaagtattccagctaggaatagaattgcagtggctttatatgtaagtagtggtgtggaatgcttaaaatttgtaaataaggacttaccaatatgcatttggttaaatggggagaagacagttggatggaacttggactacatttcagagaaattaagagtattacatggaaataataaggcaaagtttttaggattggttttatttaaaaataaggatatccaagggaatgaaattccagaaaagaagattctagagatgagcgtagaattgagaaagtgcgtttcagatggggagtctttgctacttgattatgggtttgcttaa

SEQ ID NO: 3656 - DNA, 852 bp, Cryptosporidium hominis
atgaaggaggaagagttagaagaaatggattctattgtaagtttaggagaaagatcagatatagaatttgcaagaaataggaaatcaatgtttgaagttactagcaatatgaaagcaattaatgtttctaaagatacaacaggtgatggctctcaaatagggaaagaacttgaaattggtactataagttcaacattaaataccgggaatgaattggaagatttaaatgaagaacaaatcactccagaggaaatagaatatagaagggaatcattaaatgatgctattttacaagcttgtgatatggctatgaaaattccagaatatgaggcttacatatcccttccgtcacagactactttcccagactattaccagatcatttcaaaacctgtttgcttgcaacatattcgacagtttgcaaaaaagagagaattcacctctttacacaaattggaaaagtatttagaacgacttgcatcaaatgccaagacttataatggatttagccattttctatattattcagctcttcatttaacaaatactattatgatggaggttagaaagagagttgctgttgcattctatacatataaacttcctgaaggtcatattagggatcacgaagctaagcaactttgggagggtctaaatgccgtttcagagacagatttgaatagaaagcatatgttagttccagacgtgggcgacgaaaaggaagaagaggaggaggaggaagaaaatgatggcgaggaagaagaggaagatgaggaagagaatgatgatgatgatgacggcgataataataataagaataatcgaagtgaaaagaaaactgggaaaaaataa

SEQ ID NO: 3657 - DNA, 459 bp, Cryptosporidium hominis
atgtttgaaacagttgtattggtggcaatatttacaatagtttttactggactaattatggcaggttatattcaatattatgagaatgcgcctatagaagatattagaaagcttcttaaagaatcctatatgattttagccttaatggaattattgtttggattatttggaattattagctttaaagtagaaatagttttacaatttttagattggtggttattttatcaagcaagtaataaatatccatatatatttagtatggattcattttttccagtaaaagtgattattgttacattaattaaagcaataataagtataagaacttccttcaatattccttttaggtctctcatatttccatatataatgtctacagtctgtatattgccattactatttgctttttcatatccatatgaagactcagtaagttttaaattatggttaatttaa

SEQ ID NO: 3658 - DNA, 2190 bp, Cryptosporidium hominis
atgacaattagtaagagggagttgagatcattatttgggaacttgcaccctctaaatgtggggttagttttcaaagtatataaagaactcaactatcatgatattcagtttgataagttatccgtaagaaggaataagtatacaacaaagagtacaggtttgatcaataattatactaaaagccaaaaaagtaataaaattcgagttaaatattccgaatttattaaatatttggcagaaaacctctttgaaatgaatattaaagatcttggatatcttcagagcttagaattattggaaatttttcaatatattaaggaaaatgagccatcaattaataaaatgcataactcacataagctagaaaaattaatattttcaatattgaagattcatattatatatattttggaattgtccattttattatctgaaataagtgaaataaaggctctaattgaagatttttcaaagttactgttatgctttgagataaatgttgaagatcttttttataatattaatgatgatgagcttattcaaatatttaatttaatttgttatttcttagatttgaaagaagaaattattttagataagaatctggataatatccttattaaaattttgaatatttctatgaacaaaataaaaaagcactttaatattctcttacatcatccattaaaaatgagtgaaataattaatcagccaaataaatccaaatggatcagtttactcgattctaaagatattgtaatttcaaatgaagatttgatattatactttatattgaagaattttaatggttattgcgataacttaatacaagttatgaaaattatccgtttcaatttcctctcagattctgccaaaaatgtttataatagagtccagagccccgttttaaactcaacaaacataaccaggaataaatattttgtaaataatgcattaagctttccaaattctacaattaaacctaaatttatgattttaaacaacttatcggattggtctcaaattcccgctattaataaacactttgttatagaaaataaccttaatactgatggttgtttttcatatgaggtacagattatgaatcaaggtaaattcagatttcctgggaatttcaatgatttagtcaagacttggcatcttttcctaggaatttctatcaaagttgatgaaaaatttcagccttttatattcaatctattttcactactttgtgaaaactctaacaaaaatcacacagacaaatttttccgttgccgttcgatcttaaagtcatccaaatatgactttaaaacaggaaatatatcaaagaatataatggcgccggcgccaaattctctttataaagaaaagaattgcatgcaaaatgaagtggttatacaagaggatggattagtattggcagatagcagcggaaatgaaatttggagggatgaaaacaaagtgatctttgtagtaaatttgagagagaagtttattttagttgagattggaggattattttctgtttatattgaaattcttgatagtttgtttgaatatagtggattacaaacaaaaaacaatctcatttttccattaataagctacaataatgaatattttaatatagaattgaattattactcttgtaatttgagtatgaaggaggaacagacaaatctgaaggaaatacaaaatcaagaatacaagaatagattaatcgggtccaaaactagaagaaaattactcattgaggttagtaagaaacagtcaggagcaccaaaaagagtaaccagacttagaccatctgggtctactaatgttgtgattcctttttctatggattccttaaattcttctttattttctgttacttctccaacaggtaggagaggaagaccaaagaaaaatattaaccaagcatacattagagagttggcatatatgaataacatgaaggaatactgttcttcatcgttagcgaaggcttcaaagaagaatggaagtaggcaaattccagaatctactgaagttcgagatccaggctcacttgtaataaagaagatcaaaaagaaagtaaaagccgctactactaataatcatcgttattttaattcctttttagggaaattttttactaaaggtctcgaaaagctacttagtttctttcgtggccgtctgctatag

SEQ ID NO: 3659 - DNA, 504 bp, Cryptosporidium hominis
atgtgtaaaggaagaaatgcctggatgttgaaaagttcgacttcactcatattggcgatatgtctggtattattcctagttctggaaaatgttggttgtgaagacgtcccaataagactgaagacttcgaataatttaagaggtgggcctagtactaatagagagtcaaatatactcgtcccagcatttgagccaagtaaagagtacgttgataaatacttttcctatgttgaagcttttctcaaaaatgtcaattatttatcaactttgagtgtttcccttgaggtatttagctccatatgctttgtattgtgtctgagagggttgtccactcaagaaactgcgaaaagaggaaattctttgggaatcgttgggataatatgtgcaatagcagcaactttcttagcaccgacttttacaatgaattggattatgttcattgtaccatttgctctagcaattatcattggaattcctatatcccattgcgtttcaatgggttaa

SEQ ID NO: 3660 - DNA, 384 bp, Cryptosporidium hominis
atgcctttatctggagtttgcaagtggtttgattcgactaaggggttcggattcattacccccgacgacggatctgaggatatctttgtgcaccagcagaacattaaggttgaaggattcagatccttggcacaagatgagagagtagaatatgaaattgaaaccgacgacaagggccgtcgtaaggctgtcaatgtctctggtccaaatggtgccccagttaagggtgatagacgtagaggtagaggtagaggaagaggtagaggaatgagaggacgtggccgtggaggtagaggccgtggattctaccagaatcagaatcaatctcagccacaatcccagcaacaaccagtttcaactcagtcccagccagttgctcactga

SEQ ID NO: 3661 - DNA, 909 bp, Cryptosporidium hominis
atgtcggtgttaattgaaactactttaggggacttggtgattgatttaaatgtggatctttgtccaaagacgtgtgaaaactttctaaagctctgtaagcttaaattctataataattgtgaattttataagatagagaaagattttattgccagaactggcagatctaagcaatatgggaattcctcactttatcagttattaaataatcagaaaaaggatagcatatctttggaacttgaaactacaccaaaacttaagcataaaagaatgggggttctaggaatggtcaatcatatttccaagaattctttgggttcagagttttattttacactgaaagatgaattaagtcatttggatggtaatcatgtaatttttgctcaagttgaggaagggattcctattttgtctaaactcaaccaagttattacagatgaaaattctatacctttacaaaaagttatgattctacatacctatatattggatgacccttttgaagactctctacagcttctggaaatcattccacctaattcacccccagaagaaactgatccattggctcaaacgtatgatcaggatgaagttaaagctctaaattctattagtgaaagagaagctaaatctagagctataaccttagagattcttggagatattcctgatgctgatatgaaacctccagaaaacgtcctttttgtttgtaagctcaatccagttactcaagacgatgacttagagcttatattctcgagatttggtgaagtaaaatcttgtaacattattagagactacaagactggagactctcttcaatatgcattcattgagtttgaaactaaacaacagtgtgaaatggcatttttgaaaatgcaaaacgctgtaattgacgatagaaggtaa

SEQ ID NO: 3662 - DNA, 192 bp, Cryptosporidium hominis
cctcctgctacaaaattggcatcttcattgtttgaaattatatctccaattaacttgaaaacttcctcatcatttccaagagtcgttgaccctatcttaagccctaaatcttttattctatcaggaaatgcctttaacactatatccaaaatcgggttgcacattccaaatattttctttcccctcatttct

SEQ ID NO: 3663 - DNA, 2121 bp, Cryptosporidium hominis
atgccggctattccagcagtggattttgtttcacagtattacctcccatttgttgaaaaggtccaaatcagtaatagagaggattctaataaagtttttccaaaagtttggatattttcttcaaatgatgtggattctctttgtactagcactatacttattaatcaattctttaagcatgatgagatacagtgtatgctaaattgtgttacccactataacgagatttctaagattctacaagaatacaaaaattactcaaaacaaagagaacttgtgaatatatgtatattgattaatttaggagccatggtaaatattctacactctcttaggctttggcttggagaagatttggaaatttggatttttgattttcataggcctgccattgatgagttaatgctttcaattggaggaaattataacaataacaatatattgatcctttctattcaagaatacaatttcttggtaaatagtaaatctggtagaaagaaatcacgcaagaatagctcaaatccaagtgatggacaaactaacgaatctagttcaacattttcttcaaataatccttttgcttcattatctcagactattgatgatttggatatattaatgggtacttcaaatggagaatcccaaagctataatgagcaaattgaggatgagacagatgaactttttggggagtattgtggggatccaagtagtcttgtgattgtccaaacattagataattcaataacttcagaaagaatagatggaaatgtattatggtactcttcagtcggaattagctggtgttatattaataggtatattgaactactagattatgaaatgtattttgacttactcaatggaatcctttcaaaatacacaggtgatatgagcaatataagttcaaaaaaaactagtaataaaaaatattggccaaagtacataaagaatgacctttcaatcccgctttatcgtcattggaatctaatggattcagtatatcatagtgaatatctatattcaacaatgggtttatggaagacagaaaatagcagggatacaataatgaatagaagagtggcctctgggatttcattgaaagattttacaaccaaattttatcttcttgaaaaagaagtatcgaaaaaagttgttcaggactttccaaaaggattttcagggtttgagagtggatcagaaactgcatcacagtctctacaaatcccagtatttctgaagtatttaccatctatagtattagactcagagttacatccacacttatcatctcttgatatggctcaaatccttcatgctctgctgacaaacgactgtagactggcagatagtggcgaaagcttcatggatgcaatagtttcgtcaggagctttaaatagaatggaactaaaaaataatacaatgtcagaaaaattactgaatgaggagaaaaataacgaaaatgatagttctaaactcaaccaaattcttggtaaagaccaaaaaatacagcttctattcagggattgtttcagggtagggctacaactcctagatctatcgggagctgattttaaccaaattaatgtatttcaagaccattcctggaaacagctaaaatgctacattgaagaggcaaagcttctgctttcactaaaattaaaatatgtaaaaatgctgctatcatcatctataaatggaggaactttgataaaacacaactatttcactcttgctgagcttaatgatatagaaatttcacaccctttaaatctaagaattgttggttactctattatagacataatatcaagaaatcgtgatctccaagataagcttgtgataatctcaaaaaatagtaccaacaaggttgccacaatagttggaattactccaggctacgatagcaattctccaaatttatttggagcaattttctctaaagtaatagacattattctagaggaaggccaaggccttctaggagaggagcacttctttgttcaagatgagtttgacttttctattctaagaattcatgcaaattttcttgaacaatttacttcaaatcttttcaaatatattgaaagcagcaaacatatattgactaattcaatataa

SEQ ID NO: 3664 - DNA, 1851 bp, Cryptosporidium hominis
atggaaaaggagcaatctgaaggtaaattaaatcaaaactcaaagaatgaaaatagtattgttcagaatgaaaccgataaatgtgaactttgcggtgaaaatacaaatatttcgaatttcagagagtatattggaaaccccttagcatttatttatttattttataacaagctaagtggagggaacattgaaacatactttacaaaaaatcttaaagaaatagttttagatgttgatggtatagttacacatatgaattttgtggatatgatctcagattttgagtcaggaataaatcgggtcaagaattcattaaaaatgacaaataaagatatttgcattattggaattgggggggatgggagttttagtacactggtgaataaattcttggaaagtattccagaaaacaaaaatcgccttatttttgctgttttaccttttggaactgggaatgactgggcaaaaagttttggatggagtagctatgggaatatgaagtttatgaaagatgatttctctcctttaatagatcttgcaagaggaatttttacctcaaatttaatcaactttgatacttggatgattgaggttgaaatttttgatagtgaggattccagttttcaaagagttaatccaatttctcaagagctcgagagagttaataataatgatgatgaaggcaaaaagctactcatattgaagaggagatgtattaactacttcagttttggagaggagtctagggttggaatcacctttgatacttatagaaagaggaatgttcttttgaatagagcattatatggtttagcaggttccatgtttactgtcaatatgaataataagcatcaaagtaatactcctctttctcatagtacaagaaaaatttatttagaagatcctgatcatccaaataaggagactaataatctagaatgtgctttatgtccaaatggtacaattcattcttctgaagattctcaagagaattctacctgtccaactttacttagcagtgtttcactggttttcctcaatattgaaacttttggaggaggcgtcaaattatggaagaactcaaagaatgtaggaccatccatttccaaaacatcgtccaatcttaattttggtgaaatggttggcaatcttagttcttttttggttaatcctatttccttagattttgatacttttaaacaaataaaaaatcctaaatcaggagatgatgccgaatcaagctcaggatctgaatctgacccaaattatgatttagagtcagagtctgatgtcaatcttgattctgataaatctattctagatctaaaggagtctaatattaacagactaaatgaagagcaaaacgaccaggatattgactcaataaaagaggatcaattaaacaaaactgctaaggataatattttaaatattgtaccagattcttgtgataaaaagcttgaaattatgagcttttcaggattaatagattttagctctatatttgtaccatatatgagtacagcaaaaagagtgggacaattttcgccttttcaaactgattcacaacctcattttgaagaggaattatcttcaaaaataagtgaattagaaatccaaaattcagaaaataattccaaaagttataaaaaatcaggaaacactctaaagatggacttcttcaataaagacaactctgaatgtaactctggttttattgaagtttatttccaaatcgatggagaatactacttggcaaaagaaccaaagcaatgctctgttaaatatgaccagcaaattaaagttctaagatgtattattccatatagcccattcaaaaatatccattaa

SEQ ID NO: 3665 - DNA, 750 bp, Cryptosporidium hominis
atgtttaatatttttatatgttgtacccatggaaattcaaataattcttcaaccgaagataaagaagaattaatttttgaacttgataaagaaaaggattcccaaggaaaaagttttagtgagacctttcaaaactctattagagagttaaagaaagcagaaacagaggctctgaaaattgttgagaaggcaaagaagaataaaaaggattatttacttcaagcagagattgcagctgaagaaattgttaagccttactatgaacttgcaaatcaggagtataaagaaattgaagattcattaaacaaagagttccacatcaagtctttagaaaatatcttggaaatacaagaaaattctgataatattgaagaaattgatctaaaggagagaaagaagcagactatagagtatatatattccaaaatttcagatgtgaagcttattttagaaaatccaaagtatataaaaagccagttagagaagcacaaagttagtaaagttcatcaaaagagacatccaattaagagtagacttttgtcttggagaagtaaagattacacagaaaaggagaaagagtcaaaaaagaagcataaacaaaccaataaagaaaaagcgatatctttctctgttgaaaagaaggattcatcaatgtcaaccattgaattagatgaagattactcaaggatagataatttatatggagcatctcgagttgttaattctttcaatacaatacatttgaattag

SEQ ID NO: 3666 - DNA, 2448 bp, Cryptosporidium hominis
atgagacaaattattgactacgactgcaacttcaaagaagaagtgggagaagttcttaaagatatatcaactagtcaaaatacactgggatttaatgtgattagtattttgggatgtcaaagcactgggaagagtactttactgaatgctctctttgacactcattttaaggttctagataaacttacatctggatactgccagacaactaaaggattatggcttggatgtggaacagagagttttaactctcctattttaatttgggatgttgaaggtactgatagtttagagaggggtgaagacagagctacttttgaaaatagagctgctctattttctcttgcagtttctgactgtatgatcttaaatattccattgatgaatctaactacctatagttcttctaactttggtcttttaaaaactatcctaaattcttggtttagtcttaaacttgaccaaaatggaataactagaggaaatatcagaaagactaccttactatttgccgttagagatattactattaatgataacgatgaaatgcttggaaggaaggttgttcagattcttgatttactttggagacaagtcgctgagtcgcagaattctcttggaaatcaaattcctgcttccttctctgatatctttgaagtcaaagtatatggaattccatctttaccaaatgattatgatggatttaagcaagttgttgctgcaatcaggtatgatctaactacatccattcttccaaaggattataccagacgtattcccttagaagggcttgagatgtattgtaaaactgtctggaagtgtattgtggactgccaagagctaaatataccgtctcaaatcaaacttgtttcaagatttagatgtgaacaggcaaaagatgatatcttagatgggtataaaaagtctattaaggacctacagaaaaagatggagaaacgagaatttggatttaatgaattctctgattgcactttattagtacttgaaaattcattagcagcatactttgaagttgcttctaaatatgaccatgaaatgtccactaattcctccatctcattattggtatttatattccatgaattccaaaatgctgtcaattctaggatgtctctggagagacaagatctgagacaatacactaacattcttgattactataagaaaggaattgaagaccatcaagtacaatatgataaagaaaacaatgaagaaagccactatgtgtcctttgattcatcttcttgggtaaataaagaacttcttaaatttgactccttatctttaaaatggaaaactgaattcccaagtgtgatatctaggcaacatcttatctctcctattaaagaaaaatgtattcctgatattctgaatgaaatctctctaagctctcaaggaaaagaagttttcttagctacatataatactcaggaacaaagaaagttactaagtgagactttagagatccactccaagaagatttatgaaaagcttgttgaagagttctttgagagtttaattaaggatattctgaaagagatctctcctcttcttggcgatcattttctttctgatccaaaactcaaattagatgatttttgggagctaactggctcctctatagtcaatatccatagacttcttgtttccaaatatgaacaacaatggattactctatttaagaattctaatatgaatgaattcacttcttctggcttagaagaagaaattgctcttcaacttgtattaaagttcatacaactaatccaacagcagtcaaagtatttccatattaatattgtagatagatttaaaaacgaatttgagcttgatcaggatggagtacccagacaatggataggagaggatgctaagacaatgaaggaactctttattaaagctaaaaataactctcttcaaattactaatgttttctacccaagaaaagaccaactaattccactttctggtagattctccaatctgtttgataagattatcgaaaattctgaggatctttcaggaataattgcattgaataaaggtcatggaaatggtaaatttttagattcggtacctttgatatcggaaagtaatcttaaagaaattgaatctaaagcatcacaagaaattacaagtatattttcaaaagctcagttaatacaatcaacaggaagacaaccacaaaacattccctggtggatttatttgctaataataatcttgggattcgatgagattacttatgtattaacatctccagtcctagttaccctacttttacttcttgcttcatttatatactcatatttaactggtaacttctcctcattttgcaattactcacagcaatttgtcattatttctacaaaaatcttacattatatttctggagcaatccatagctctttagataataggaaatag

SEQ ID NO: 3667 - DNA, 561 bp, Cryptosporidium hominis
atgaatacaccagataaaccagataaaatttcaatgtacccttcccaaattcatacattagttagaaaagggagctttgtaaccgatgatattagacgtagaattcaagagaaaactaagaagtcatctaccattgaggatactaagagaatcgttggagcaatgtacgaatcaaactctcaacctttcatttattatgatattaagtctgaccagatgtcagacgagcccagaaatagctcgcttagctcaatatataggaagaagccgaccacatcaagtagtcaatcttctgctaatatagaaggtaataattattcttcaggattaagctcgagtgcaaacaatttaaatagtagttcattagaaagtttaaaggagaatattttcaaaatattcgaagaaaaaggaagcgaaggagtttcactcaaggaaattgaggataaaacaatgaaacccaaacatattctcaagaaaattgttgaagaaattgcagttcaagcaggtagaggcggaagaaggcatatatggtatttgaaaccacaatttattggtaaataa

SEQ ID NO: 3668 - DNA, 1977 bp, Cryptosporidium hominis
atgagaagagtatttggatttttccaagcctactttaatggtttttttgatctaatgaaggatgattttggaacaaatgagataaatcacaataattttaataatgcaattaattgggtaggtaataaaacaatattagagacagaaattgaagaattagaagaagaaaaagaagaggaaggtgaagaaggatcgcctaatgagaatgttttcctttattcaaattgtgatgcctatgcaggagaatttcaaatgtccaaaagaaatggttggggtgtttacttgaaatatacaggccaaaaattcgagggactatggaaagataatgtaaggaatggatttggaatgcaaacaattggaaattcaatcaaatttgttggacaatttaaaaataatgaatgtgacggacaaggaataatatttcatcaaagtggattaatgtattcaagtaactggtcaaagggtgagttagttaacagaaaattattatttgagaattggaaggatgaactattggagttattccctgaaaattcgaaagaagaggtaaatgaaaaatctgctcaagttacttcaaataatattgtggatgagagtaatggaatattaaggaaaaaaattaaggatgaacttgaaaatctgcaaaataaaagtaacttcaggccatataatttagaggagaagtcagaagttactgcaaaatctgtaaataatgttaattttactgaaaatattattggagaaggtcgtattcaaactataagttcaaaaattaataattacaatgcaataaaaactttatctaatgaaattgaaagtaaaacattaagtttttataatacagataattctgcagaatgctgtttaagctggaacatgtaccaagttgcatattttattaaatgtattggattgtcaaagtacgttaaaaactttattttgaatgaaattgatggttgtacattaccttatattggatttgaagaattaaaagaaatgggaattacagaaatcactcatataaagtacattcgtatgtcactttctttgttactaaagctaagacttaaatgcattagaaaacagactttcactccacagaaattgattgatgatgaatatcttaaaagttttgaaattcctgcaaatgaacttaatttaaaatgtaggattggagaaggaggatatggaaaagtatacaaagcaatttggacaactagaggaatcacagttgcagtaaaagcatttagaagaagagataagcatgctttggctagggagttttactcggagttatcaataatttctaggattaggcatccaaatgtgactttatttttaggggttgtaatgtccccactgtattgcttagttacagaattggttcctaatggatcattatttgacctactccatacaaagaattcatatttgacgtccacccaattattgaaaatatctagggatatttgttgtggtatggcatatttacatgaaaatggagtcttacattgcgatttaaagagcagcaatatacttttatctgggaactttaatgtaaagattggtgattttggtttatctactcttatggagtcacctttagaaacaagaaaaatgttgggatgtatcggaacacatcactggatggctccagaaattttaagaggtgaaggatttaccaagtatgctgatgtatatagctttggaatcattctttgggagatgattacaaagaaaattcctcatgaagatcttaatataaaccacattgttgcatctgtgggatatggccacaaggaattaattatcccagagaacattccatcgacaataaagactgtaataaagaagacatggagcaggaacgtaagaaataggccaaatttcaagcaattaacaaatatatttgatcagctttatcagagtagtattttggatattgaagaaaatctattagcattttttggccagtag

SEQ ID NO: 3669 - DNA, 2745 bp, Cryptosporidium hominis
atgttttcttctttgatttcaaagctattcaacgatttgccaagtaactttggttatactataggcgaaaaagtaaaaggggaggactatagtatttggacccattatagaggttacaggaagaataaaccagagcaaacttgtagtgtttttgtttttgacaaaactcaaaattctggtaatgaaaatgtacttgggtttattccatttgaaacagcaaaaaagcttgcaaaaaaccaatttcaaaaatgcaagagcctaatacatccttgtattctgaaggtatatgacactttagaagttccaaactcttattatattataactgagccatgtgtgtcgctttataacctttcagtaaatattaatcattcttttgttacgtatgatgataattcaaaggaatcagaatatgaaattggttttccaaaggactgtatttcaggattatatgagatcattaaagggctaaagttcttgcacaatgatggaaaacttttgcatgggaatattagtcctttgacaatttatttaaattttgagggttcttggaaacttggtggatttgaaaacgctatatttctgagtgatacaagtagttattatatggatgatatttcaaaacaaagtactgcttataatataatgggatggaaatttgctagagtatcgagaaatcctaagagccttgatctttggaatcttggatgcctgatttattggtcatatcaagtatcttctaatttgaacccatcagatatatacagtaatattgctaaccaatcaaaaattatgcaaagaaaaggctttattgagtcattgaagttaccttatatgaatggagatgttcttactattgaaaacgatttgattccacgttggcttcatgactggttaagtgaattgttaacttgtatgaatacaaatagagaaattgatatagaaaatggtctaagtttaattaataataactcaccttttgtagagcttatgaaccaattaaatgattttatgttgaagtctccagaagacaaacaaatcttttgtactcagtaccttccacatttacttactagtattaaggcgcatggagatagctctaccaacattattattatccaaaggattcttgaaaagcttttaataaactttagtcagtgcaccccgagcgtattccctttagtattaaccttgatggagccttttaaagatgctacaacatgcccgaaatttattttgaagtcattctacacagtaacaaaatttcttctctgtcaaaatgatagatctattagatatactttacttaaaaatatttcaaaatatgaaaggtttcttttgaaagagattttccagagctgcattgagtccatcttagttgggtttcaagatactactaatgtgataagagaaacaactcttcaaagcatgattgtaattattcctattcttcttaaggaagatactgagaaaagctgttctattgaggatgatggccaaatcttgaaaaaccaaaactccaagtcaaatacatccaatgattttatgtactccataaaggagggttggaagaagaatagtgctgccctattaaatgcttttggaggaaatagtggatctcaaatagctgttgataagcttgtgtgtgcaatgtttgttctttcaaaagaccccgaagtcattattagaagcaacactgttatttgctttgctaaattaatgaatgtcttgccagagcaataccatgcgacaatcttaaataaggtatacctttcaacgattaaggaccctttccccatttgcagaaaggctgctattcaggctcttctatctaccattcacttctactctccaactataattactcaacaaattctcccaagtgtttctgctaatggctttatggaaggtcaacccgaaattatggaaatatctttgactctgattaaaaatgtgaccaatattttagctccatacattgaagaacaaatcagacttaaacaggagcaagatagaattagattagaagaagagaaactggcatcccaaaaagaaccaaaaccaaatactggaattaatagcaataataataataataataataataatattacccagtcatcaagtaatgtatttgatcaacaatctgctaaccttcaaaataaacatatttctaactctaactttactcttgaaaaaaataacttgccaaaaactaaagaaactcccgccattaataatagttacgtgtcagccaataacaaaatgcatgcacatgcacaaaacttgcaatcaaaatctgcttacaacaccggtatgggaattggaataccggcagctggcgggaactctaatgataagaaagatgtagattggaatgactttgaaagcgatttatttgattttagtatttcaaatgatcataataatggcaataagtcagtttcttctaatcctaatgtaattgagagtgacaattctagagtgaaatctaactttggttcattgaatttgggtagtaattctcggaataatattttgcaccagagcgaacctaccggcgtcactaacttgccaagttatagtgccagtaatgatagaaagaaggaaataatggacaatctgccattaattactgatcaattttctactagcaggaattcaaaagtagaaagaatacctgggaaaaagttatctactaaattagacttagacagtgatgatttttggaaggaatttgagtaa

SEQ ID NO: 3670 - DNA, 3165 bp, Cryptosporidium hominis
atgattacaagcttggtgagcagaatacttggaggttctggaaatggatcgagctctggaattactactggagatgattcatctttgaaaatttctgaagaacactcaatatactgtgcagcatctttaacaactttctatcggccaaaaaggctgaagattgctatattagaccatattccatgcgatttagatagtttaagtatcgagttctttacgattcaaaagtcaggaaatttcaaagaatttatcatgtcacacattcatgacactaaaaaaattaaaattcctcgacaaactttgataatgaatggatattcattttacagcgtaatatcatcctcaaaaactgaaaattgtcaagaatgtggtaataatatttgttcgtctttggttgtggattttactcgaaatgcagataatggtgaatctacttatttgatttttcaaggtgagatcattttaaggatttatgatagaaagaatcggctcaatatttattcacttgcaagaggagggaatattgatgacgttattcatattactaaggatgatattatactttcaatccctagttcatttgttccatctcagtgttttaagctggatcttatcatgtattcagctattggttgggctaggcatggtgaaataaatcaaaaccattctacaaatgttgattactcttcaacaaagaaagaaaatgtcattttaaataaacaattttctgtatcattatctcaaaatttatctatttgtaataatgaagaaagtccaaaaagaaattctagcataagcaaagaagtgaactctaatattggaaagcccttggactttgccgtttcaacagaaattgattatgatacaaataaggcaagtagcaataaagaaagcaaaattcatccaattgccaaagctctgagctccttaaaatctgcagaaattaatgagcaggatgattccaaaaataaacctgcgtctatagaagaaccggattctgcaaatgagaaaacgtcagattctaaaccagaaacttctccacttgctgcattgctaagagcaaaggctcctccattaccattacatatgaaatctggaatgaagtcaaagtcatgccctttcaagggaattgggaaggattcacaaggtaaatctattggtgacaaaaagaaggttcttccattaggcagaagaattcactggaaaccattaactgaagagatggctcagaaaacaatatttcgtgaaatcttatatacctctctaagttctcatccccagtctcctccagtatccccttcagactccagtaatttgagttctccattaacttcatctgttgaagatttttacccaggttttgtagatgattcgaagataggaactacttctcctatgtcagattctgtttcgcctattgcaataacagatattcatatggcaaatactctagttcatatggaaactttatctagagtattcacaaagcctggaagtaccatgggaggtaagggaaaagctttggaaagtttaaattctagagaatctagtggtgagcctaataaaattacagtaaaaggaagctcggatgatccaaattcattgaatcatgatcaatgtttgacctcttctgaacaaatcaatggatcttgcgggaataatcatggtaagagtgccaaatcaccaaaggatgaccaaaataaccaatccaataattcttcatctcaaaaacagctacctctgacatttttatcacaaaagagagcacaaaatatggcgatagttttagccagattgtctgtgcctactgactatattatagagatattaaactctttcaatatttcaagcctaactctcgaagattatgaaagaatcgaacaagttttgccaacagagatggaattagagaaaattaacagtaatccaaagaaagaacttcatcaattagaacaatttctaagcaggttctctcatatttcaaatccaatgacgagacttcgtttccttaagtttgagcatattcttgatgcatcggagtttgatattcaaaggaacttaaatactctttattcagcttcagttcaaattagaaattctaacaaattgagattaattctaaaagccttcttgttactgggaaattacgtaaatcatggaatcaacttttctacaatgagtaatatatcttcaatttcccacgttgctaataatggctctattaactggtctctacttgaaactaaagggttctcactatcatcactattaagattggttgaatttaagacaactattgatccttcatttactgctcttcattacatcatagccaatttatctctaacaaatccaaatcttaatttaaaccagtttccttcagaccttcatgcagtttcagaagcatccaagatttcagttgaagctttattcacttgtattaatgatatgagaaaagagcttgctattttggaagtagagaagcaaaaatttacaaatgacagagttgagaatctttttgaatcatattcaaggcgtctggatgcttttgttgaaggatatcatagaattgttgaaaaagttgttgataccgcattatattttggtcagagcttaccagaaggaaacagagcatccataattcaaccattttttgaaaccatgaatatttttatcttgcaattttcatcatgttgcaaagaaatccgagaaaagccatcaagattctctcctttgcttgttgattcttctttggttttcccaaatgataagagtttaagctcttcaacctcaagtttaatgtgtgtcccatcaaagatcaattccgcaagtactaattcaacatcatccacaaatttggctgaaaactctccaaacacatcattaatcaaaatcccagatatccccgattcaaattccctggagaaattagataatgatgctttagataaaagagaaattcagcctcaattagagttagtttcaaagaactaccaatctaaggaaccattctcttctaacattatgaataataagaagaaaaaggaaactggtagtcttatttttatccaatcctcaagaaataataatgctataaaactacctactaggcttccaccacctccaccacctatttccccgtcgcctcctacctataaggattaa

SEQ ID NO: 3671 - DNA, 1230 bp, Cryptosporidium hominis
atgaacggaaattaccatcaagaaaggagtcgtttgattcaacaacataaggaggagattaaatcaatagagaaggaaattaagtcaaagagggggactttaaaggagcaataccaaagacagttagaggaggcacagaaaagacatgaggatgaaatgaaagaatttgaatcaaaatatggtaacagtgaagaaaagacaaaaaagggagccaagccagcttcttcgtcattttctttagggggaggagagaaatgtaattctgaaaaaacaatcctatatgaggaaagacaatggaacagtttaagtaagtcagagctagaggcagaatgtaagctgaggggcttgaattcaaagggtagtaaggaggatttggtgactagacttttcatatttactgcagatcagaaatcaaagctgagcaagatatctcaaaatgatcaagatagtattcaaatggttgaatctagagggaaaacaagtggtcaattggagtcatcttcaacaaaaaaattcacaatggtctcaagtgcaaacaaatttactccacctgaaattaactactcagaggcaggaggaactggcagaagaaagggaagatctcagaacagaaaggttgatcatagaaagaatgcaaaaccaggacaaaattcctgggcagctttctgtgctagaaatgatataccgagaaagaagaatgctgatttgaatattcatgaaaattctaattctgagagctctgatggtgaggagaatgagaaagaaaaacaatcttcttcggaaggaaatcattctgaaggcgaaagttctgttgaaaacggcgaaagtgaatcatcggaatcagactctgattctgaagatattgatgaggaggagcttgcaaagagaaataaaagaagagcagttatggttaaggtactagagaagatgttttcaagcatcacaattaatgaaaagaaaaatggtttaaaactttcggaaatacaaggacaattaactagacttaatgttaagaattttaagccagagcttcttgggtataaatctgtggaagattgggtgtcttctcaaccaaagtctgttttaacttatgatgaaggcaaccagcttattttccctcctggatacaaaattccagctttaagtaaaagcaaaaaagaagacccgtactacgtagattccttaagtgaaaaagagggagaaaaaagtgatgatgatttcttcatgtag

SEQ ID NO: 3672 - DNA, 1785 bp, Cryptosporidium hominis
atgtttctttcaacaattaacaggctaagggaggagcaggaaaaaagcaattctttaagaacttatagtagagctgatgcggcaaaattgacattacttaatattggagaggaagaagagggaggaagaagtagcggtgagaaaggtagtaagcgtgtgattagatcttcaaaagagtcaaatagaggaaagaataagttttctagtgctaataatgacgaacaacaaaatttctcagatattcctaaaaggaaaggtccaaataaagttgtaagcgatggtaaaaagatttcatcctttcaacaaattctaaatattgcaatgacttccaataatgttttaaagagttcaaatcggaagaaaacagtaaatagagaaatccattcaaataagctcattcctccaagttcttactatgattccattgagagttctccaaattccagctataatagtgacgaacagagaagccaagaaggaagtaaagagacttgtgaagatactgaagatgagaaaaactctcctaagattaattttgttcgagtaatttgtaacgggaaagggagtgataataacaaaagtactataagtagaacaacctctagtatggagaaaaatgagaagaaagagaaggaaaatagcagaatgagttctaaaccaaatagaagattaaaaagaagtgatttagataatgttacaaatttagaatctgcctccaagccttctaaggtcaagaagattactaagaaagatgctggacagtcgctgaaagaatgcgagcaagtattggataacaacgaggaaagtaagagtaaagataaaagcaaagctgaggaaagtcctggaaaaagaaagacgattgattctaagattaaaaagacagtaactaatactcctaaacatgtaaagaagcgtgagaagctagatacaaatccaggagctgttattcagaactcagaagagaagcctgaaacttacaaacaaaatattttgactttgaaagccaaaaataacttaattaaaaagagatttaaggagcaaattgatgatgacttctttagtaatattctggttttaacacccagtagctcaagctctagaaagcctagaaagagcttgaactttgagcagagtcccagtctaactatttttagtcctgatactttggatgctaggctattaaagacaggccttacccctgtgaataataaggaattatctagctctggaatggccaataataaagtttccaaacgcaaagaactcgcaaagaaaggtttagaatcattgcacttatcacctttaagttcatgtttaaaggaaattgcaagtggagaagacacaaatcgaaactcatcatattcaaagagctctgcatcaaagtcaattggcgatatactcggtggtttagaaagtacgactgggtccaaagttggaagacttggaaggctttgttgtgagaaacaaaacaaatttgtaatgcaaatacatgagaaattaacgtgcggaaactttggtgatgaaaataagtcagagcagaatccctctttacaaagcaagaagagtagaacaagtactgataagttcaaagtacccaaaggttctttggatctaaaaatgaatcttgactctgtattggatcaagaaatggaaaatgacactagaattgctgatcaagaaaagcagcaggaacttttgtggagtattacagaagattcttctattcaaaatgaagacagaaaccttcttgtggaagaactgattgctcataccagcaatcaataa

SEQ ID NO: 3673 - DNA, 744 bp, Cryptosporidium hominis
atgtgtagttttggatcgtcggggtttatattcagttccttctttcgagaaatgtcgaaaatatgcaggcagctcaagttcctattgataattgaatttatgacccttataatattgtttgttttggttccaacaggcggaactgtctgggttttattacaggttttctctataattttggcatatatttcagttaaggatgctaatgcatatagacctccaatattgcaaatgtatatatttatatcggctttaggaactcttttctgtactatttactttgcagtttcactttctattgctgggtcacctttaagtatagcagcttgtactctttttgcagtcaatgctttggttctagcagcttgcactcgaatttcttggcaattatttaaagaacttatgttatgctctccgcttattactggtactacaggagcttatatatttggtacagcaacttctaatgcaaataatggtccttcaagtcactcaaatgtgaataatggaccaattgagatgacaaacggtagagcaagcatgtcaaatccattcactggatcgaacattggctcttctggaggatttgttccatttggaggtgaaggatacaagctttctggaagcaagaattctgcatcaaacgagaaacctgttacgttgggatctagctccaaatccataggagggaactctacagacaacaatgtcagtaataataatgagattaagtctctagtctaa

SEQ ID NO: 3674 - DNA, 1740 bp, Cryptosporidium hominis
atgaaaggaaaagtaattttattgtgctttgtaattgggctattagctgtgttagtatctggtggatcattgggatcagtggatgttgcactcattgctggagcaggtgtgacattgtttggaagcttagcaggtactattggagagaatatttatctctccatgacaacaatgaagagaggaacggtaccacaagtattatcaagcttgttctacccacttaatccagaggatccaaactatacaaatggagtaccaacaagtactagcatagatttaacaggagcagatggagagacaattacaatgacttcaatcatgctttatttcttctctttgtctagtatgagaaactttaatggacaaccaaaagatctggatagccagccattatttccttggggtccactatattcatatcaacatcctgtagtaacagtttctcaaataagatcttggattacaagacaggaaagtaaagttctaaatattccattggataaagtcgcattatatgatttatatccattggctgttattagaaaatatatcgagtttagaggaaaacgtaaaggttatagtggaaaaaataccttatcagcttttcagaagaagtattactgtccaaattgtgaaattaagccatttttgagagacttctttcaaggaagatgtttttctaaagaaagatgtaaaggtattggaaatcccaatgttgtttactgtgaacctggatggaaaatacattcagaaagtacgactttaccaccagaggaaagcaataatgagaatgctgtaaatctggagagaattccttcttcaattgagtatcttggaaatatttatgaacatattgagttacaaaagtatgaactttcatctgaagctctagagaaactttcacccaatttattactttctcctgaaggactttttggtctctcagtaattctctatgaaaggcaattacaatatcttcttggtaatgtagaaagatcaaattacaaggagaatggtattaagaaatggtttagagatttaaagcagaaaatcttccgctttctagattttgggaaacaaacatatggaggagaaaaaaagaagaaaccaatgactagggcagcatggaagcagtatccagactcactttggaagaaatctcctttaaagacttgggttcattctgttgaaaaaaccagatactgtactttaacaaatatcaagtataatacaagaaagtggaacgaaatggactatgttattgccgctgtttactattacttcattagatggcaaggaattcctcaagtttatggccaatttgtaattgaaaagagcaatctagaaaagttatcaaaggcaacccagagactagtgaattctactgttgttaaaacaaatattgagccttctattacttcaactgaaacacaaagtcctaatgaagcttttattactcaaaatactgaatatgaatcagagcatttacctactactgcatttgatactctaaaattcactgctaaagttgaatcaaatgtaccttctaaagaaagaaaatctttaaaaggtattacctcgaacaactctcaagaaggtaaatttatttttgatgatgatgaagaaactgaagaatctgaagcacccggagatgatagggtagaaagtagaggtagaaggtatattgctgttaaagaaaatggtaggaatgatattcgaactgttggaactgctgaataa

SEQ ID NO: 3675 - DNA, 1668 bp, Cryptosporidium hominis
atgaagttgcaggccttattaatattacaaattctatttggatggttttctttttccaatggttttgcctcggttactgtttccacaacattaggacttttaggaggaacagctgtatattacatgcttacccaaacagatagaggaactcttggacaaattttagcaagtaaaaggtgtcctgtactcgaaaatggaacggatgaaaggctattatatattgatgcaaataattgggatggagaaacaagaactacagttgctgggttaatgtacttttactcattacttgtttcagagtttgcatctaaagctccaaattctaatgttgaaacttcaatgcttccatggggtgctttcaaaatagaaaacaatccaattaaagaagttgagaaaatcagggactatctgacatcgataggcggaggatttatacgcttaaacataactgaggctgattcttggaatatttatccaattggagtagcaagattcatttcagaaaatagagataaaactattaatgttgtggaagaatccatttccaatacaatcaacaaagcatcaaatgcggtaggaagttcgaagaaggataaaaaaaagcaaaaagaaccaaaggaagaggaggagaaggagaagaagaaggagaaggagaaggtgaaagagaaaaaaaaaaataccattgaaggaggtctttctgatatgactagtgtgtcacatcgtagagcgatttcatcaagatctccagtacatgcaaaaaaaggcagcaataaagttcattatgaagaaactccttggaccccatcagatgacacatcatggggggagcttactgctatatatgattacttggagagagtaatggaaaataagtatgtagtctcaaaagaaaatgttacatacaaaaataggaagatagaacaacttgctcttgctttaatactttactggagagaaaggcaatatgatatttcgtcaattgatccaattaactatgatgcaagcaagttcagaaagtctcttggagtatttgagagatcttatgcagcagttactgatattgcttccttaggacatggaaaacgtaatggaattagaattgcaccttggaaaatgattccagactctatgtggaaacacagtccattccaatcatttgaaagagttgtttatgcagtatattctgatgaaattaagaaaagtaagtataattcacttaattggaatgtgtatgactattcaatcggagtagtacttaacacattttcaagagatctcggagttcctgtagtatttggacaataccaggagaaagtttccaaatttagcaaattgtacagttttaaccctctaaaaatcaaaaagtattcacaagaagacggatcttttgttgaaaacaagaaaggctctaaaaaagagtctaaagctatagatagtacagaaactgctgaagaggctctccaatcaaattctgaatctgatgtaaacaaaaccaacattaaagacgatggtgaaaagacgaaagaatcatccgaacaattagaattagaacaaaatgatgataaaaaaaagaacaaaggtaaaaaaagaaagttagacgagaaaaaaagcgaagacaaaggaaagaataaaaaaaagaaacttgcaaaaaataaaaaaaacaattga

SEQ ID NO: 3676 - DNA, 1551 bp, Cryptosporidium hominis
atgaattttttgaagtcactgtttatttttttaatttgcgtttatacccttaatcttaatgtagctgagggattttatagtgcatctgcatctccatcagtcagcactagtttgacagcctattccgtggcatcctcgactgtctctctatattacatgctatctcagaccaggaggggcccaattggaaagattttggcgagcatttatttgcccattcaaaaagatagaactggcgactacacctttagcatacggactgataaatgggatggagatacaattatggtatcatcgtgtatgctatattattttagcttagcagtaaaccccaatttaaatgataagtattcaatgtactctagtagaattatgcctgcattaccttggggtgaagttaatttggatgaagaccctcttcaagctatgaccaggatttacgactatttagtttcacttaaaggtggatatatcagaatacccctaaataatgtggatatttggcaattgtatcctttggctgttatacaaaaatactcctctatgcgaaatgggaaatttaaatttaaggcaaaatatccaaaattgaaaaaagattccaaaaacaaatccaaaactaacaataaagagcaagatacctctggaaatattaagttgccacttatagagaatgaatcatctgtagaaatgaagaggaatagaaccaattttgaagaagtaaaagaaaataactcaacatattctgctgtgattgggcagagatccactttagattcatattttcaaacaaaagaactgaaatcttcctcatctgtcatttctgatttcaagataaggaggaagcattgtattggaggactttcagtagtttgcaagaacaaattaaatcctaaggttagttatatttcagttccttggattccagatgaaagaacagcaattgaagagttgaaagttatacacgaatatacaaatactttggaggaaagttctctaaatgagatttgtcaaaagaacaaactgaatgaaaagctggttaacttcaccttagctttaattttatatctaagagagagacaatacgatattaatcacatcgatgctgttaattttaaaaaatgctcgtttgccaagtttaaagataaagttttaaggtttactttatgcttttttgatatttttggcttggctcacggaaagaatcgtgtcaatgtggcaccttggaaacgtattctagaagaacactggaaattaaatccctcaaagactttagaatacctcattatcggatctcatcaacaagaagttcgttccgatatttacagttcgtctgaatggtcggaatttgattttgcaattgcagcagttgttcacttcttttcaatcatacttggagttcctatactctatgggcaatatgttagtaaagtaagcagaaaacacttcctcttagaaagagaagctttaaatctacagaaatataatgtaccggttccgcattcagttagatacgaggcagaaatagttattactcaaaacacttatttataa

SEQ ID NO: 3677 - DNA, 3843 bp, Cryptosporidium hominis
atggaaagggaagaaagatcatttgattattcgcctcagactcaaaagaaagccagagtcgacagcaaaaatgatgataatttagaggaattggttgatgaaaatgagaatatcgttgctaatcacacgagattcgatgagagcatgaaagttgaacatattgtatatgagtcagggacgaattgcgtacatgaatgtattaggccatgcggttatgttgctccaacagattctaagcttagagttcagtatgatgagaatggaaaaaaaattcctgcaaaggaatactcatttaaactagatacttttcaggctgtatctataggttgtttggaaataggagaaagtgtattaatttcagcacatacttcagcagggaaaacttgtgtagcagagtatgctattgcaatggctctaaagagtaatcagagggttgtatatacatctcctattaaggccttgagtaatcaaaagtacagagatttaagaactacgtttggtgataataatgtgggacttcttactggagatgtcacagtaaatccacttgggtcaattatggtaatgactactgaaattcttagatctatgctttatagaggaagcgaattagtaagagaaatagcctgggtaatttttgatgaaatccattatatgagagataaagaaagaggcgttgtttgggaagagtctattattcttttgccagatactgtaagactagtgtttttgtccgctaccattccaaatcatttagagtttgcggagtggatttgtaggacaaaacatcaaccttgtcacgttgtatacacagattacagacctgttcctctacaacattttatattcccggcaggaggtaatggagtttatttagttatggatgaaaataaggttttcaaacaagataactatatgaaggcgttgtcagctctgaaaattgccgctgagagtaatagctctcagaaagaacagaaaaaacatgcaggtaaagctcagctaagagttgaccttgaaagcattgtgaatatgtgccaggaaaggagttatcttccgatcattgttttctccttctcaaagaaagattgcgagttaaatgcattatcgctgaaaaacattgatttatccactgaagaagaaaaggaaagtattgacttcatttttaatagtgctttggcaactctcgcggaggaagatagaaatattcctcaggttgttggaatgcttccattattgagaaggggtatcggaattcatcatggaggtttacttcctgttgtaaaggaaatagttgagcttctttttggagagtcatttattaaagtactattctctacagagactttttctatgggaattaacatgcctgcaaaaacggttatctttacttcacttagaaaatttgatggaaaggagtacagaattgttaactctggagagttcattcaaatgagtggtagagcaggaagaagaggccttgatgatagaggtatcacaattactatgattgatgaacttgctgatccatgggctatcaagtcaatgcttactggacaacctttaagaattgatagccaattttatattggatataatatgcttttaaaccttttaagattagaaggggctgatcctgaatatatgattaaccgatcattttcacaattcttaaagaggaaaaagactgtatctttacacgaagaaattaataggattcagagcattttggataattacaaagtttcagagccaattattaaagtcattgactcgaatcaagaacaaaatcattcagaaagtcctactaaaaaaagtagaactagcttgaataaaagcaactcccaaggaaatcaatttgtagttatgagtagaaaagttgaaggagtggatgatatctatggttctttcaaggaaagcttgatattgccagaattctcaaatttttctgaacttttaactgcttatgcatattttttacatttttcaggatataaagttatttgtaaaaatgaaaacctatttgattcaaaggacttttattcaaagaatccatgcccttcaaacttattagaagttgagttaccctctgaaaaagaatttttgagggataaagcctcaatacatagtaaaattagtaattttatcgatctttgtaaagagagttgtagttttgagactcaagtaaaccaagcggatatcgacattattatgaatgagaaagctactgggtatcatatagagtcagaaaaggcattgattcgaattggagacactcttttcaatcattttacagaaatgattgagcttaataaatatataaaaaagttcattatcaattctaggataatccacagattccttaatccaggaagactagtatatattagattaccatatttagaacaagaagaagcaaattcactgaatttacagaatttagagtctcaaaatgaaaatgggactttagaaccaggtttaaaagatccaaaatatatattttatatgaatgttttaaatgggtttagccaaaaccagtacttagatttaggttggggagttttgcttagcaatccaaaccccaggaacaaaaaggttgatactggatttttaattgagccaaataagaacaaaaatcttgagaatcaaagtgaatatggcaacaatcagcaggaaggtgagacacaaaattcaaactctaactcgacaggtatggaagattctgaaaaattctatgttagggttctgttaaacaagaagcgtttcccaaaactagtatacgataagattgttaaagagttagagaagaatgttgaagactctattaatgagaacactgattattgtgtttttaattgcactgtttcgtcaatacaagaaattagtactgttcgattaaatattcctcagaatagaagtaatattaccaataaaaatactccaggcttgatgtcattagagatttcattaaataaggtactcgaacatcttggcaaggataagattccactaatagactactatggtgatgaaattatcaacattggaaatgcatcatcagattctcaaatttgcgataaactagataaattcaaagaactacaaaagaagatacaacaagagtctattttaataaacaaatgtccatttttagctttgttattgttatatattagctctcataaacgtcacttgaaagagagagtagatgaaatacaaaaagatttgagggaacacgaatacgatactattatgcagaaggaattgcttggaatgagaaaggtcttaaagaatttagattatactgatgaaaatagtattgtacaattgaaagggagaatagcttgtgaaatttcaacatcagatgaacttttaatcactgaattactgttcaacaatgtctttttccaagaattaaaaattgaatatattgttgctattttatcatccttattatatgacgagaaatgtcctgatataaagttggaagattctactctagcagtgggatatgataatattctggacgttgccaaaatgattgtaaagatttcattagaatcgggtttaaacattgattcaacacaatatatgagtaaatttagaccccaaattatgcccataattcttaagtggagtaaaggagagagttttgcatctattcttgaaaatacaagcttttacgaaggaagcgtaatcaggtgtctgaggaggctggaagagctactcagacaagttgcaagcgcaacaaaatctattggaaatgatgaccttgagaaaaagcttaaagaaggtattgcacttatcaggaggggcatcgtttttactccaagtttgtatctttag

SEQ ID NO: 3678 - DNA, 2919 bp, Cryptosporidium hominis
atgatttccaaaatcaaattctgttttatttttatttgtatatttttagtattttgcaaacttccatatatttcaagatgtgaacaattggaatctgaagaaattcctactggggaggatgaatttggagaggttgatactggaatcgtatcacaaaaggagtttagaaagataatgtcatctaagccaaatgatgaacaggcaaaagaacaatcgagctcaaaatctggggaaagtaaacccgaagagtcgaatcctgataaaacaaaacccaaagagcctaaacctgatgaaaacaaacccgaagagtctaagtctggtgaagcaaaacccagagaatctaactctgatgaagcaaaaccagaagaatctaagtctgatgaatcaaaacccgaagagactaaacctgatgaaaccaaaccagaggaggccaaatctgaggaagccaagcctgaagagagtaaacctgatgaaaacaagcccaaagagtctaagcctgatgaaacaaaacctgaagaaacgaaacctgaagaaactaaacatgatgaagaaaattctggcaaaggtaattctactgagccaaaatcgcttgaatctgttgaaagttcaaaggatgatttgaaaaaggaagataaatctgaagataatagtgcaaaagaatcaacggaagagaattcagccaagagctcagattctgaagctgatgccaataaagatttttctagctcagaagttgctcaggaagaagacttggcatctgaatctactgataatctgaacgatcagacaggaaatagcgatggagcagaaaatactagtgaagaaaaatctagtgaagagaatgatgaaaagtcaatgaaaacagatactaacgatcaatctaatagtgatgtaaaaaatgatgaagttaaaaacgaggattcaaaaaatgatgcatcattatctgatgcttcaaaagatacttctaaagaaagcagcaataattcagaaatcaaagcaaatggcgatgataagttagaagataatgtcgagaagacaatacaagaaatgaaggataaattgggtgttaaaccagaagatgagactattaaaagagttgatgaccagtttattgttattgttaagaaattaaaacagaagagtaatgaagttccaacagatactaaagatgtagaagtgaaatcccacgatacaactgacaaaaatccttctgaaaaaaataacgaggaaaaatcactatcaagtgaaaatcaaacagaaccaaccaaggaagaaaataaagatgaaaaaaaagaatctgaaactgaaactgaaaaccacgaacaaaaatctaatgaagaattaatagaaaagttaaaatcattatctaataatgataaaaatgaagcagctgacgaaaaaattaaaaagatcaataacttattagaggttagtgaaagtgatgagaagatggagaagctaattcaagaaaagaaggattatgatgctaagaaggaagaaaaagaaaaacttccactccagaagaagaaaaaatggtatgagaaaagagatccaattacaggagaattacttttcgatgcagaagcactatctagaaatattacatcaactattacagcaaaaagaagaaaaggagtattcagtaagtgtgtcgagtttcatggccaaaaagaaaactgtgaatcttcaaaaaattgtttctatgattcagtctatgaaatgtgcttatttgactgtactttactaaataaaaaagatgcttgcgaagaatatttagaatgtagatttgattttgttgttccaagaaaagcgtgcgtaaacgattgtttccaaagtaggaactttgcaaaacaagaattaaatgggataatgagaggctgtatgtggtgcacgcaagaagttatgtgtaatacactttccagtttgcaaaggaaaaagttcccagatgcatcccaaagagaattcgactgtaactggcaaatacaaaatggtttagaaaataatgatgaaaatgttgaaaattcactttgtgtcgatagaaatttgggaagatcaatgactgataaggatttgattgcagcaacatatatttcaacccaaactaaattagtacatgaagcagcagaaagaatcaaggtacaaatggttaatagtggtgaaactgaagagagtgcaaatttgcatgttcaaaacattaacttacttaaaatgaatatttgttatcctccaaatattccttactcccaagtaaagcctgaaaaaaaatactatttgaatgatgaagttattgaagtagattgtgatgatggatacaaaattactggagcaaacaatcaactacgttgcgaaaatggaatattttcaccaaaagtatattgtattgctatgagagaaattgagaggcaaaaaagttctataagcaaacattttaataagatccttaatttgttaatcaactcaattacaggaggtggtgaatggattaatgttggtattgaaaagatgaatgaatctaaagatcaagaaagaggcgaatttccagatgctttaatggatgaaagtgaagaaaaaactaatgatgagaataaaaacacaaaatctgaagaagaaatagataaagcatcttccaatgatactactaccactactagtactactacttccacctccactgcttctatcagtgataaggataccgaaagtactacaaaagaggaattaggtaaagaatcagataataaagaagaagagaaaggaataaaagttaaagatacagatgaagaaaagaaaaataacgaaactgacaatgagaaggatagtttaaaattattagaagtttcatctgaatctggtgcaacaggaaagaatattttattggatagggttacaggagctccaattttagtaaaaaacgactaa

SEQ ID NO: 3679 - DNA, 798 bp, Cryptosporidium hominis
atggatggtaattcatcatcgacaaaactaagtggatcgggactccctcccatgtccttttctcctgagattcaaggttttattgtcacaaaatttgatcctctgctttcaatagttaaagaattaaatgaccatttgcaatcttcagataaggaaagattaaggcttgaatacagagtttcaaggattgaacggactttagaaagtttaattaagattgtaacagatttaggatataaacttccagaagaggatgaatttgaaaaaaatattccagaattaaaaaatgagctcagccttttactttcaggagaagaaagtgttacagctccatggttgttctctgtccagtcaggaactcctatttcatcgcttcaggttcttttggaattttcacaatcaaatactgaagtgttacttgctgatacttggagaagagaagaagatatgtggattggattcctggatgatcttcctgatgaattctctacaagaagacctgaaagtctctctctggtcgatcttagaagagcagcaaggagggctttacttgaagtaatacgcggagaattacttcttgtaattagaaatgtacctggaaagcaagaagttccacataatccactaccagtaacattggtcgctattcttgctgcagccttctctgaagcctgggaaagagttgaatcttctgatccaaattctctaggaaggcttgctttagttctagaaggtgataatattggtagtagactccgtgctggtaagaaaaaatttgcaatagaagctttaaattga

SEQ ID NO: 3680 - DNA, 204 bp, Cryptosporidium hominis
atgctcgatccattgggaatcgggaaaataatcaatgataagtttgctcaaattggggaaaatgtgttaggaacagttattgatcaaattgtggacaattcaagtgctcacttaagcagtttgaatgatttccagtcggtaagtttgtgtgcgattcatcgaaatagcaaaatttattattttatacttagtcctcaattatga

SEQ ID NO: 3681 - DNA, 3960 bp, Cryptosporidium hominis
atgaagcttgtacgtaaagttgcagggtcaaagtttttaaacaagcagccaatagttgaagttgagccaaatatttatgcagtaagggacgaacaatcgggtatatataaatctgttcgtgactctaggagtttgggagttctaacagtctctattgggagagcaattatctcacctatgggatttgatcgtaatattcggaactttattactaaagaaaatgcagaatgggtttttgaattggctttgcaaggccaaatgcttgtaagccaacctgtaagcactaaagattttatattggagattccagttaatagtcctatgcttttatccccaactaagagctacgggaatacttctttagcttttctggatgaaaagcatgaatcaaggccaagttttggagttgaaagtaggaactcaagcgcagagagagaaaaggaaaaggtttctggagtaggtgccagagaggttttctttaatttcaaagaatctttccaagtcactgatatctcttctgatatgaatttagatctgatttgtagagttccaatacaatgtaaacttactataaatcaaacatttaacgaagaaattgtggatgaagattgctactactctaaaaattctggatctatttttgtgaatgaatgtgatgaggattcttttcttgcatcagaaaacattactgctactagctcagccaatgcggattctaattcaaatttgggttccaaccctccaacaaatttaaaccattctgttagtttccgaattaaccaagaacagaacaattcatctgggacatcttttaagcagtataagattattagaattgaaagaaataaaccaaactgcaaagaaatatttgataagccggatggcgacaatcgaccagcttctcaggaaatcccctctcaagatcaagaatgggaagtcttatatgaatgtatccatttcggtaaggttactattccaatttcctccgtttttcaaaacaaaatttctgaactacccgtcttggactattcattctacaaaaattcaacgttttataaggcaaatgagaatctagtttctgtgttttggaaatcaagaaacaccaattgtactcaaggccatgagagtaatctttcgaaaagcaatactgtggaagaatggaccgtgattcatggcaaaaaggcggactcctgtgattcaattgttgttaataggccaaatgattcaaacttagaagatagccgaggatttctaaaaggtatagataatgaaagagagccaaaattaaggtccagattcaaaagtgagagtagaatgaatgacgggttaatctcttctgggaatgaaaaagatgaaagcaatttttgtgaagaatatcaaaatagagtttatagtgatgaaagctctcaatttgaggtcggatcgaatttcaagcatttaaattggtaccatttatacccaagaactagtgaaatggttaaatatgtcaggccagtgccaggaatcacagaatacggactttcaaatccaataaaaactttaggatttattcagatcggactaaattttgagacggagtgctgttctaagattagccttttaactagctcgtatttgagtatggtgactgagaagcctattacaaggtggatccttccttcagggtttgagccacagtattttcagatgtatgctgaaagtttaaaaatgctactagagcattatccgagatggatacccaaattcttcttcttactaaacttcagaattcctagatctaggtttgatatggtaatgatttccttattttgggcaataattacgtttggagctttcaaggctaacagttttttctttttttcatggatttttatggttatcctcccattattaatctctttaacatatagatttgggtcgcagattgcttctagaatccatcaagacttccttaccagaattaatattgaagaacaaaagagaaagagtataacaagtgctctctcgcaaaaagataatgctaatattaaacagaaaagtaatattagtcaaaataataagacgatgaatctgataaactctacatctggaaatatctggaagatgttccagcctatactaaatattaaatatcactcatcattaatgataggcgatggagattttattggggagaatatagatgtaaaatcattaaataatggcacaggaaaagaaaagaaggattcttcctttaccaaaattgtggatgaaatctgtgaaaaggacttttctaaactcattcctaaagaagtctactttggtgataaagtaacaagtagagaatactgtacacaatacgatctatctaatggggacggatatatatgtttggctagaacattaaataactcattgttggggaataaggagaaaggtagagaggaagaactaagaagattgaatttatcgaacaatgatgcatcaaatttctctccacagcttgaaaagcaaaagtgggaaagagcccaagaacataaagaagatttgaaaacagaaaaatcaatggaagacaaaaataatgatgagacaaggtttcgacaaaacctacaaggaagtggaggaattgtagagaccccatttggagagctaagattgggtctcaaaattccttatgataataaggttgtatctattttctttgatgatcaagatttggagcctattcaaactcagctttctaacctattggcaatagtagaacttgttcaacaatcatttgcaagcttttccacgcttctgatgaagcttaagaactcccttaatttcgaggatcctctacttccttttttaactttgtcaattcttgttattcttaccactatactgaatctgggtctctatttatttaatcttatcattgggaaccagaaaacggcattcctattaagaggatttcttcttattaagtttattcgttgggttataacgaaggatccattcaataatgttcaactggagatattcaataagaaacaaagaatcgatccagacatttttggtcaaaatcgtgttattaagcctctttttaacagatacttcaagctaataagttctgaagaccaaaacatgctaattcttttaagcagtttgaaaatatacgactactacccagatagatttgtatatagacaaggaaatctatgcaagcctgatgattcaacagaaagaaacaaagagaaaagacgaggaattactgaacccatccgaattttatccattaatatcgaagagtatttatttttctacgtagtaaagtttacatgtatttttgtgctcttactgggttccttcattaatactctacagtatatttttactagtaaattttcggccatttttgcgagaatattacttctttggtggtattctattccagatattagagaaattcagcatcgttgcatcgcatctacccagctgataggaaatcttgatgatttactcaacgataatgaagaaaatccaatacactttaaagtcataaacggaaatagttacggtattggagagaacaaaaaggccgaagaaagcagacctgaggcttctggaaccaaagcagatctctttttgaaacaattctattttggaaagaattctaattatatcaagaagagcactatcacgacaagttcgataagccaaggagaaaaactggatcaagaatctagtgcactaagtagatcattgggaagcttacctagtaaaagcaaatattctgaaacaggtacaccatcagcaacctcgagcaaaaaaagcctaattgaatatatactcccaattaacaaagagcaaaattcaaatgtgaggcaggaatccgattcaaagggtgagaagaacaacacgcaatctagctatgaggtacttgagagcttgttagaaggaatctacccaattaataagtctaaaaaacaagattaa

SEQ ID NO: 3682 - DNA, 258 bp, Cryptosporidium hominis
atgagttcacaactcaaacttaaaggaaccattccagtatatagtaaattttgggtggcagtggcttacataataacttgtgtaatctatatatctttgcttttccttttggcatatgaagaagaaaaacagaaatggtatttttcaggtctttttatagctctaataattgtattttgttattttatttactggaggtggatttcaaaatcaattttttcttctaatttggcatataatcaaaaaatttgtaatgat

SEQ ID NO: 3683 - DNA, 1884 bp, Cryptosporidium hominis
atgtctcctattacattgaagcaatatgttttgcttagtttcgggctacttttggggctttttgtacatttattaagtgtatacgatttttacttttaccacataatcatgcacataactataaccaaagcgtccaccatgataattacaaatgcaggtttattgactttatactttttgggtaaggttattttgaatatgtttgtgggaagattaagagatattgaactggaagaaatcattgatcaagggcgaatgtttttattagatacaatcttttttttgttatttagtagcccaacaatagataatatagaagttggagcaatggttctttcaagatacattactcttattttggttttaaagcttttacatttaatttcccatattcgaattaaccacatgtttgaattagacagaccaaaaactactgcaattgttagaatggcagctttacttaatattctcctgattattgacataagtttagttttcaagtattatggcctattgtcaaaagattctactctgaggttgtgggtatttttcgagagtgtttctttgcttgtttcatgtagcacttctattggtaaatacctcgttcatgttgtagatttgaagctccaagccattcaattattaatgagacaagaggaggatggaacccctgaacaaggaaatactcattcttcgggaatgcaagctcataactttgtatggtcaaataagaatgctatattattttatttggaggtatttggcgatatatgctctttaattacttatcttctcttcattattctcttccttgtgttaaatccttccagaattccattatatattatgggagatatcttccacgtcttaaaagctttgtacagcaagctatcatcattcaggagatatagaaagctcacaaaaaatattgaaaccagacttcaggaagcttcacttgaagagattgagagaattgatacttgtattgtttgtagggacactttgtatattggctcaaaaaagattccttgtggtcatgtattccatctggattgtctcaaatcttggtttattcaacagcaaacttgtccaatatgtagggctcccataactatccgagatgaagagcctgaacattcagctactactgcagaagaagataacaactctccgcaaataccagaggaccaggatgagactaatgatattaaagatttcacttcagaccaagcgaaacctaacatcaattcagagcctactagtgcgcaatcatcttcagcatttaattcaaatgaatccgggagctcaactgatgctagctctgacagttttaagaaaatcttgaagaactggatagtaagtgagcataaagctaaacctattgaagaaccaacatcaacaagaacggcgaaggacttgaaagaaaccaaatttcagatatcaaaacaccctttgtttaaaagcaagcgtgatgacttatatacaaaggtttcaaaagctgcaaatagaggggatcatataaatagccttcctcctcagttactttcactacaacctcaaattttactagaattaaataaaaatttggaacagagaacatttggaagtgaatatggaagtcaagagttttctgaaatgatgagcaaaatgtataagaaaaatgcagatatttggttgaatatggttagcgagctcatcaaagctaaagaacaaaattgtatccaacattcggtaccaattgaacgaaaaagcggtattcacatacaaggagaaagtttatctaatatgtatgaaagtagttctagggcagaccccttgagaaatctaatggatgctgtcaataatcagcttaacgaaacacaaaatattaataaggccgcttga

SEQ ID NO: 3684 - DNA, 1218 bp, Cryptosporidium hominis
atgtcgattttaatagtttttgatattgattttaatagtgagcactccattctgcgtctggagaattttaaagattcattgaaacggttgtttctagatgatgagtttaatagggaatactctgagtgtttgatttctgtttattttgtcttggatgaaatgaagagggagttagtttttgctaaccatagatttaaggaggtgagctggtatccaattggcagctgctcattagtaccgtcgctcacgattatagatatgttgatggagcaaataacaagtaccaatatagagcttaagactgaacaggactcttttacaattaagtcagaggtgcaaaataatattaatcaacaagaaataaggccaattccagattgttttagtgatttcctcaaagaaggtgctattattgaaagatctgaattacagagtggaattgataacagttttggtgctccaggaccaaataatataaattggacagaagagcaccaaaacattgggaaggaaagacagttacttgtaatctggctcatggattcttctagttgcctcaaaaggctagataatggcggatttccaagatttcaagatataagtgaaagtagtttaacccctaacgtagaagttaaatactttcttctaaattatggaggtgatcatcaagatcaaaaccaattatccaaagtctacctctcggaggctcaggttgaggtggtttcactccttccactatgctctgccgacaaaattctcaaggattttatatgtaatgaaataaatagtttttactattcagaaaagtacgtgagcattttttctccagattcacctccaacagatttagaatgctttaatgatctgtctgtaattggatttaatctatatccaagtttagctaagtttcctctttttattcaagatactcttaaggtgctaaccttaccgtactcttccacatttattggaataatttcaatcgcaaaatatcagccactaccagtacttacaagaagacttattgagcttaataactcttcaaaagggaaagagatggcaatgcaagcacttatccttgctctacataaagaaaagttcgcaatggctcttgagctaaaccctaattggtttgccctattggtctcaatagtaatcggaagtaatatccatcttgcaatggatatacttccccccggttacgttataactatatag

SEQ ID NO: 3685 - DNA, 1317 bp, Cryptosporidium hominis
atgaatacaacaattgaatctgatcaagagttattcaatattattaataaggaaaaagatttccagaattctcatttaaacttacaccccaaggaaaatgttatgattaatgctgcgagaaaagtccttgggagtatccttacaaacaaatattcagagggttttcctggaacaaggtattatggtggaacccacgttattgataagatagaaacactctgcgcaagtagattgaaacaatttctaaaattagacaaaaaaagcaatgacgaatggctatttaatattcagtgttacagtggaagccatgcggagttagccatctgtatgggattactgaataagggggatagaattttgaggattaggggtgattctgacactatattggaaaattattaccaagttgaatattataatttggataaaaaaggtagggggtttgatatagctgacctgagggagaaatgtaagatattaaagccaaagttgttacttgttccatccgatgtattaacattattcatagactacagactacttagtgagatttgcagtgaatttaaaatctttttagtcgctgatattagcgaaatcgcactgctgatatcatttgataggtatggaaaggagaaaaacaatccatacagatattgcgacatcatttattctaacacccaaagcagtttgggtggccctaaaggaggtttcttgatgttgaacaacagcaaaaatcctggattatttcagaaagttaactctgcagtatttccaggcctccaaggaggccctcataatcatcaaattgggtcatttgctgtccaaattcaaggaatgttaacttctcgaactagtgagtttgtagcagcagcacttgataactctgctgttctagctcagacaatgcttgactcaggaattcctctacttggagatggaacagatacacatcttgtttcagttgattgcgaaaggcttggaataccgtgcgagttgatttctaaaattttaacagaatgcaagatcaggcacacatacagaaagtttggagaaaacagatcctccttaatgtttgggacccttgtctatacatttagagaaggttctgtatcacagatggcaattttaggcaatttgatctcagattgtattaatgtgggcgtagagattttcaacaaagttgggaagttagatattcccattgaggctagggaaaacatctttcacgaagaaataagtaaaagtaataagctaaagctgatatttgatagggtttcgggaataatcagtgagctggagactatttattttgattaa

SEQ ID NO: 3686 - DNA, 831 bp, Cryptosporidium hominis
atgaattatggtaattgtttgtcattgaaaagtgactttgaaaatttcaaaagtagtctaattaaagaaggaatggacgaaatcgtttgcaaatgttttaagcaggttaaggaaaatatagattacttgaaagaattaaactttggagaaaatattaactcattaaacaatgaaagttgttatattgagagagatctcaaaattaaagaaactcaacatctttttaagtactgcattatgctattggaaaaggaaaacaatataaatcctcattataaactgttatttgagaatctattatttcattttcagaatattttctccttagaaagatatgaagttgataattgtttaagaaaccaattagaaaagagttctttatcaaatacctctgtctcttctgtctcttctttcgtccctacctctcaatatatgcctttaccagattttaaagaattggaaaaacaactattatttgaacaaaaccaaggtaagttacattattctacgaagaggtttggttttattttacttatttattgcccaatattaatcaatcattattttgcagagttaattaaattaaaggagtccacgaaagagttgatgagtattcagaatattctattaaatgagattgcctgtgaacaagttactattgatacttttcaagataaaattaaggaaatagaaattaatacagacaattttcacctactacacgaggttaatgtgatttctgaaagagatcgaaggaaaagaattgctaaaatagttctttatttaactacttttctaatattagtaattatttttagaatcattttctaa

SEQ ID NO: 3687 - DNA, 420 bp, Cryptosporidium hominis
atggaaataatgcaaaattgggaaattatagacgactacgatattgagaaggaaaatgaaaaggttaaaaatagtgatatcttatcagatttactaggtgattatgaatttgacaacagctttatgagaaaggatattaatcagcagcttgaggaaattaatatattgattaaagaagttaatcaagaaaaggtagaattattgaattcatttccatcttgttcattagcaattattaagagtttaaccaaaggtgatgaaattgatgaagaaaatatggagattgatcagatgtcactctcaagtagcgagatcaactctagcaatgattcgcctttgtttgaaacacgagtaaatatcgacctgcatcagagtcttacagactccccaggaagcatgaatatatcagactttctttag

SEQ ID NO: 3688 - DNA, 1338 bp, Cryptosporidium hominis
atggtatttttacaggaaaaatcattaaaagagctggatcccattatgtatgagctaatcaatgaagaatatgataggcagattaatggactagaaatgatagcatccgaaaacttcgtatcaaggggagtcttggacagcttgtcaagtacattctcaatgtttaataatgataaaaatatggaattaaactcaacttctacacaagaactattagagctcacaaatgaaagagccttaaaagcatatggactagatcctgaagtatggggtgctaatgtgaagcctcatagtggttctcctgcaaattttgcagtattaaatgcagtattaaaacctaatgatagaataatgggattgtcattacaacatggaggccacctgactcacggacactatacaaatttgaagagagttaactgttcatctcactatttcgagtcactcccttatgtaactgatttagaaggagtgatagattacgataagttggaagaaaatgcaatactatttagaccaaagatgataatagcaggagctagtgggtatcctagaatgatcaactttaagaggtttagggatatctgcgacaaagtgaaggcctacctgatggtagatatcgctcactactctggtttggtggttgcagggaagtacccctcacccaaagattacgcagatttcattacaacaacgtctcacaagacattaagagggccaaggtcagcaataatattttacagaaaggaagtagagtccaagatcagagttaagattgatgaatcagtttctaaggaaattcaatctagtattcatttcaatcaagttgcagccctttgtttccaactgaaacaagtggtttctgcttcttgggttaaatatgcaagtagagtgctagaaagctctcaattgctttgcaaattgctcgaggagtctggaattaagattcttacaaatggaactgattcccacaagattctaatagacacaagatcattgaacatttctggggctaaagctgagaaagcactagaagtatgcgagatttcaacaagtagaagttctttaccttgtgatgggagaactatgaattgcagtggcgtcagacttggaactgcagcccttgcgagcagagggatggagttggatgatttcaaattcgtttcaaggataattgtagaagttttaactactgctcgggatattcaaaaggatggagagactcttgcagagtttgtttctaatattaaggcctctccagcaatagagaatatcaggcaaacagtgcgaaagtttgcctcatcgtttgaatttgtttctatcgtagataagtattag

SEQ ID NO: 3689 - DNA, 2259 bp, Cryptosporidium hominis
atggttcttgtgggaagattgattaaaaaagtatctgcttttaaagtgaacaacagcatattgattgtgatagtaatgactgattcagatatattcttgctctcaaactttcaatacagttcttttgaggctatttgccagataaatgaatctcaaaattcgatggaaaaccataagatcaatgaaacagactttaaattaaggtattacaaacaagtagcacctgattttgatggggagctaggagaatgctgtgttacatcactaggaagattctatttttcatgcttcaatgaaattttcaaactagaatttccacaaggagacaaagaacgaatctctgattttcaattaaaacaggtatatatattagatatcgatgaagaacgaagcaataaatcccttaatttatcgataaataacttggtatcttatgaaacattaattaatggcgatcagttcgagttgatatatataatacaggatgatgaaaagcattttggtttgaaaaacttatctttgctaaaagttaagattgattcaagagcttgcgaatatcactttgataaattatcaacaattgggaatgctggtaaattctgtcatattctatcatgcaaagtatttgaaaatggacagttaggggttatttgggaatcaaacaatcagatttatgtcaatgtttttaataattttttcaacggttttcaaaagtcttttttaaactatagtagtcatttaagcgatgatagctacggtaaaaagttttctaacaagacaaattatagagatttggcatccttactttatggagatgctccattaatatatattgacgaatctgagttcagctcttcaagtcaaagaactaatgagattctgaagatacatagtagaatattttcagattcacttaaagtaagagatattgagaaggaagaacaactgatcaaaaatattgtagactcaatatttttgaatgaaaaaatttgttctaaaacagtattgaaatgtaaaaaagaaagtaatttggcttcaaataacttcattttaaggaatatggaccaattcatcttttttggtctcccctttttttttcctccagtacttgggattaaacctaacgaaaatataacaaatttaccagatgattggtatagctgtatgtctttcacaattaaaacatttacttgcgactctaatggaaaccagaatatcgttaaagtaaattacacttgttggtatgagggagtgtttaattaccttagtaataatttacaatcaattttgaaaactcctcaaatgcaccttcatgtattaaagaggctcactttattgcctcctgagtcaaagtttacaaaacctacttctctatggattgcattgaattcgattaaaactattcaggactttcagagtttggatagaaatgatataaatttgtttttcaacattattgatatctataccaaaaatggaattgaaaaacgactatttgaatttgctaaaaacaacttaaaaaacttctcaaatgtattatattcatggtctgttcaccaatcagtagaggttatttctattcttagaaaagcaattatgaaaagcaagtcagattcataccataagatttttagatttaaagagaataatgaatacttagaaattctgcttggattgtcatttcttggcaatgacgtaaagctactttcagcctttgtttccagtaacattaggccaatgaaatctgcactaaacattatggagtttgtattagatagtggaaacccaaatatagaagcagatgagagtttaacaggttttaggcgtcttatttactctttaatagaatggaggagcgtttttgggttggtttgctcttttaaatctttcatagagtcagataactttcaaggcgagcgagaaagtgttcgtttccccacttctggtcttattaaacttgcaattgagaacattaatgaattatctgtttttgatcaagaaattttagaagatatattaaacaaaaacaatcttacttgggaaaatcttttgactctttcactattgctagagatttttattgctagtaaatttcaacaaagaaatctactattcaatttatgcggcaaacaactgaacttggtttctaagttggatgtatttctggctagcttattccatgttcagagttcttgccacattttttcgaggttagcttcaaattcaattaatcaacacgatttaattgatttctattag

SEQ ID NO: 3690 - DNA, 729 bp, Cryptosporidium hominis
atgcaatctataacgcatagattagcagaccaattcagaagtgtggtgggaaactttatcccaattgactgttccaactccaaatttgaatctgatggatttctaactcctaaagaatttgttgattctggggactatttgattcttcaattcccaaactggttttggagaagcgcttctgaagaatatattgtgagatggcttcctcaaaataagcaatatctgcatgtagataacgtaccatgtagaaagagacttgactcttctaaactttgtatttcaaaaaacagttttgatattacatcagataataaaggagatgaatggattttacccacaaacgaaaatgtagaaaagctcggtagcatcaatataaatgatgatgtcagatattatgacattagcgttacatatgacaaattctttcaaaccccaagaatatggctttttggatacaataaggagggatatcctttaagtactgaggaaatggttgaagatatcattagcgattacgcaactaaaacaatcacactagatccccatccatttacgggaatattatgtgtgtctattcacccttgtaaccactcaagcttgcttaaaaaaatggccaagaatcatccgccgcacctttcaatagttatattactgaaattcattactactgttattccatcaattgagttagacaatacaatagatatcgatattaagtttgatacatag

SEQ ID NO: 3691 - DNA, 615 bp, Cryptosporidium hominis
atggacgatattcttaggaattatttgaatagcttgaatgggctttcaataaaatacgattcattatctgagaaatataagctgggtgaaaacttgagtcaagatgaaagaaaaaaattatatgagttatttgtaagctttgaaaaaatgaagttgtggaccaaaagtgttttatatggagaaaatgatcagcaatttgagaattttaattctccgagtgcggagtttgaatatttcaaggaaatgttgatggcacgattagagttaacatgtaatacacgaagaaataaagaaaaagaccaggtttctgtagtatcaagaaaaattcttcctaaagtatgttgcttgactagagatgttttcaaagaccctgtatcacacagatatgacacatcagaaaaggttgagaatatgtgcaaaaatcatatttacgagaaagacgcccttcttaagtatttgggtagtagcaaaaaaaaaatctgtccgattgcaggatgcaactttctggtagttaagaagtttttaaaaagagaccaagaagttcttgatcagattcaatgtgattctgcagttaagtctgaatttcaagaaagtatacagaatttattagactag

SEQ ID NO: 3692 - DNA, 10473 bp, Cryptosporidium hominis
atggattcagcggaaattttgttctgcttgttggactcgttggataactgtgatttagtgaccgaagcttctgtttattcgactgttgtggactttgcaaaaagtactacagcttcatctaattgtgtggggttggtctcgaatgcgattacatcttttctacaagttagccacacttcagtaaatcatcaactaagtttacttagacttctatctttgatcatttctagctacgcaatatccggtgatgctgttctaaatcaggcagaaggagatgtggaagggattgggataataaatgctacaaattttagtattaacagtgatatttcagcagaagatattgagttttttgagggtcttaccaggtttgtgctgaacgaatacatatttttgaagaataatgatccaagaagagttgcacttctacaggtaattgttagcttggtatttttaattccagacaaactaattgagatccttcttattgttgctgaagagtcacgtacaaattgttcaagcggtggggtatcttcggctcttgttgcgatttctgcaatttctaagattttcccagaattagtttgtagaaaaggccatgatataatagttgagttactttcacttttacacaaagctgctagtggggattctggatctaagaacacatctgtcaattttatttcaaaggtagaacttgttcgttgtttagcagatgttgcagacgcacttagaagcagtagcatagagagggcagcgcttgctgggttaattggaacggcctttgatgcacttctaaatgattgggttccagcaatacaaaaagacaaagaagctttttttctttcatttccaactttggagactcttggccaccttgctcaagtaattgatgatgagcagttaaaacaacatgctccaaagcttctttcagtctatcttcaaattttgaattctttattgagtaagaaaagcaaatattttccaacttttgttagcgtgttttcagaacctctcaaggaaaataataaatgtgaagatctactacaaaacaacatttatactgttaggtggagacagtaccatgcagttgcggcttcagctctcacaccacttttaaatagtaaatctgaaacaattgcagtatcactacattattccattctttcaggatttaagctttttctagatagatgccactgcatctttagtaacgtcttccaagatcaagatacgatcagctcgctattaaatgtgcttactcaatattgcgctattttccatagactttatgctcctgcaatattacctgggcacacagcttataccgatacttcaaatgaaggagttgtaattgaaaaagagctttttgaatcaaagaatggacttaagtacttttgttgggatatacaagcagtaagagaaattattactgctcattatgaactaattttgtgttggaagtctctaattaaacaagacaatactcgcgaagcagtaattaggtttttatttgaaaatattgacataaagtcagctaatcgtctatcgacaatgttcatattaagtaatgttattgaagatattccatttgaaaaagtttctagaatcggtgaatctgagattacagttgcagaaaactctaattcgccttttggatgccttatgtttcgacttgccagaaccactcttgaacagggattggattattcgatagcatttatattatgcaaaataatttgcgagctatcccaacacggatttttgcatattggtgcaacttcagaatgttccattgttgaagatttaggaaaaggaggttcaaagactgagcaaggagcgaatgaatcagaagagcaagaaggtattcatttaacaagtaaaggtggaaataaagatatttggattttaccatccccttcttcagcagaaatgttaacatattttctaagattgcttgcagtccctgaacaaaaagctaagaatgaacacttaagacatttacaaagacaaaaggcagattaccttaagacaattcaggggtttgagggaactaaaatacctgtgatttatcctccgagcctttgggatctcaggtgcaatgcgcagttaattttatctgaagagttaacagcattggttccagatttgctgtggccattattaattgacgctgttaatcacttaaagcttggatctgctatgcctactgtttgcgaatcactgtctaaatcctgtcagaacctgtatcgaaagacaacaccggaggtgtttatcagagcatttaaatttcaaagtacaaaatatttaacagttagcgatccattcaaaatttttatttggctttgcatgtatgcacatgatcctcatatttataatggcgtacttgcatattggtcgctccaatgccttcaatggatatctccaatggtagtttccactccaagctgtatttgggcttgtattccttcccagagacttcaatcacttatagagatagctgacacaataatatctcccgcaaaagttaaagattctcaaaattgcgtgtctgttcaaacattctcaaattcattacatgaaacaaatgaaatatttaacctctcgtcaaaaattgatattgactgttggtttccacttgttgatgagtgcatttcctatatattttcagggatttctggtggtggagtttcatccagtccaataaatcaagttgaaaggcaagacttgctaacaaaaaagacggattcatctactggagaagctgagaaggaacataaaaccggaattaaaagctctgatattgttaacgatacattgaccaatctgttattagctttgttttctgcctgcaaagatattaggtctgataaattacaaaaaagttctgaaactcctacagagcttcagagagcaggaatgtattctctattagggcttttattaagagaaattagctcacatgaattttcagattctgaaaagccggaggaaaaaaatctaaacttcttgagaggaactcttatttcaaatattcttgatggactactaactcctgatattattaattcaaatgaatctaatgtggctaatgttgcagctgcatctggagggggtttggctggatcacagggtagaagcggcggtgaactaagcaaagatttattaagttcaaatgagattcaaatattcaaagatctttctaagcgattttctgatcttcaacatttcttccatgccattggaatcaactcaactatattgcaaagaagctgtggaaggggtattgggtatgcaagtagtcaccagaaccatttcgttcatatatctgagtatctattggatttaattaggtcagatgcagcaaacaagcgctctggagcttttagctttttcggaaaatcattagcggttgtacaagcagaacaactcagatcgacactaatcctttcacttggtcattctataggagaagtaccaattctattattcaattctgccacagaaactgtaagaaaaatacttcaagtactagaaactgctgtaaaggaggagaaagaattacaattacaatgctccgcattgaaagcaatccaagtagcttttcaggcattgtcctcttctgagagtaatcaagagcttactttgtcatctcgaattaattcagttctcagtagattccattctggagaaggaaataccaaactcaaaaagggtatttatgggcttgactgtggagacatttccttagaactattcagctcttttagagatcgtatattcccatatttgctcaccattattgtattttcagctagtatcgaactcccacctgctcccttaaactctatgttattgctcaaggctgcatctggaatgccatacagcacatctagttcaatctcttctcaaaggattcacacagatccctctggttcctatattagaagcatggtgaagtatagagatatttccataggtagttttgaaagtctggagtattcacatgaagatttgggaactattaacacaataaatgattttgacgctccttgtggagaaattccatcttcagaaaagctaggacgtggctctaatcaatattcagagagtgaagatgcaaagtttggtccttttaatttgactctttctgtattatcggttctaagtgaaaacccacatatgatttcagattctggaaatgttaatttttcagacgttttctgctcatctttagatatgtctcccaacctaggcagcagcactatctctgcaaaccctgccttaaagaatgtgatttcaaacctcagctatatgaaaaataagaatagcttggggattaacagcaggaatggttcttttggagatagctgttcttctattgaaatctcaccaggcggagctaaaataggattggccagataccattacaacggaattcagagtggtaattctctgtcgaaaagttcttatgatggaaataagagactttctgatacatttaaacaaactaactctttttcgggtagtggctccactgaaataagcggacttacttctgtcgattcaaagattaattcgaatatatcatcttcaactcaacagccttctggaatatccaatactttccccaatagtcttggaacttctggtcaaaccaagaacttgagtaatattaaccttaatacatcaaacaacacagctactggtagtgctaatataggccctgctaacacaacgaattccggaaacaattcaaatgtcaatacaacaagtggaaatacaacagggaataatacaacaactggaactagtggtggaggtctaatctctagttcaggtaatttatcaaatagcaacaataattccgctactggaaatacaaacagccaggcaaattcggttgtctttaataagcttctgctagatgcattggatgcttctatatcactaatatcattcccttctccgcttttaccacaacatatccctttggttcttagctcttgtctgactattttggtaactgtatcatctaggattcagttcagatgtttaacaagagaggatttctcgatattttacaaaaggaatattgatacactcaatcttccaactccttcattgaatattattgatggaggatacaggttggaagagatgatgaatattattgaagactcttctgtcccatctagtagctctgaggtttcggtattcaaaatacttgaatctcttgataggctatatctgagtatatataagtcgcacatgccttcttgggcaggactaactcatcttcttgagggcctacttggacttgcagctacatcaacttcttcagtattaaggtgcatttgcatccatgttgtgtattgcttgctgtgtgaggcccctcttgttgaaatcttccagcaatcccaaatcatccaaaagcctgaaaataatgattctaacttgtttaataatagaaactctgaaggagttccaccaaaaggaacatgggtttcttggatgcattgtatagctctagttttgggtagaacatgtgattcctgcctatatgtacgcttaatagcctttgaatgtattaaagaatgtatgaagagatgtatatggactcagaaaattgatttatcacaaataatggtgattgattttggaacagatgatagccttaagtattcaaataacagaatgtcttgggcttcattttctaataacttggaaattgactccgaaaacgatcaaaaaagaataaatggcgagctaccgggggaccaacaaaaaatactttcagacatccaatctctgattcttccacccacttatctggacttattgtataatttggcgagctgcattccagcgtactgtttaagaccattgtgccaacatatccttccatcattccacgatgcagataagataactgctcattccagcgtagagactgttagagttcttttttccataaacaagaatatattagaaagtgaatcatttgcttgcaaaattgtctcatctttatttgaagaaatatcatccataagagattctgaacttcaacactttgtctatttgctcataagaaatgttgtttctttcaaattccaggcagctatatcagagatatttaggaaatgtatccaacctcaaaagtatatcaatcatattgttgctaatgactctttgagcggagatttcattggagatgccttgacaaataacagtggagttctgagcagcgaatggacaacagtggaaattccattggaaaatggaaaatcgaatacgaatactttagaaggttcagcaaacccagcgatggtaagaggcctaacaaatgtgataaatgtaatttgcatagtagatcctatctactcaaaagccatttcttatattggtaaggacaaatcccttttgttagagtctttccgatatcttacggacgtgctaaataacactgagcaaaagtacttggatataattatgatgaatgagaaattgtgcattaaaatactttcgtcttcaaatattaatatttcaagcactaactctagtactcaagcacctttaaacactgcaatgtctcctacgcataattctgttacaaatcttattggaactggaatagtagttggtggcactttctctatggggattgctgctagtgctggcggcgttacttcagcaggttccttctctttggcaaataagtctttactctttccattttcaatattttcaatattatctagtgaacatattaatgttcggtctagtactcttgctttggatatccttcttcagacaaatgattcagcaattaaaattcttgcaaagcgacattttccagagcttatttcaaccattcttttaagatgctgttcaacattgggatacatcaatatgggagctctggaaagcagcaacgctttgagatcattgttccttgctttaaatgattcggacgcaattctaacattctttgacgcaaaccaacttaagttatcattaataaagccaaacgaatttgattatgctattggaaagcttttgtgctatttattcattcataacccagacatcacaacatccatgatctcttttattaagcctttcttaaaaagagtgaattcaatttacagtatgagtgcattaattctacttgccccaactcctttaggcatttactataaggacttcatgaaatacataaagccttatgagaaagctactgaagagtcgaactctgaaatccatgtctcttttgacgagaataatcctgataatgtttataatttggatttcttagattgcattttgaatattatcaagacttcaaacaacccatattcaaaaaagagtgggtttatatttttccaatggtacttttggtattgcttagaatcaagaagatacccgagcaaagactttctactcaagtttgtaaatatttgctttacaaacgtgataggaagtttactgtttagaagagaaacaaataaaactactaggggaaatctaaatctgagaggttttagattgaaagaaaaaaattaccaagaacttaacgaaagccgagaagaatttaatggctctagaggttttgatacctttgaggaatataaatctagacatggaactgatgatgaagataatgcagattttagaaacagaattaaactaggagtcagcgaacatgaaaaagaaaattcggatgaatcaatgaataaggatactgatgaaaatgattccatgtcaaattcatttacagatttaagcgggggagaaagctcaaatgaaattgatccggaagagttgggaagaagaaaatcgagtttggataaatttgatttaacagaaactccaattattacaagaaatagattagtatttgcagattatttgaaggaatgccttgtttgtcttagatacttggtttgcttaatttcaaaaataagtataggattttctcttcaatttattccagagcatcctacaatatatgttaagtatgctcaagaagaaagagtcccaactggtacagaagaaggggattctttttacatagaattcattgaactactatttttatctcaaggagaatcttatgatggccaggtacaagttgaaagcttccaaactgctgtatttgaatctgaagaactctctaaagctctgacatggaagaataaaattccggaaatatttgttgatttcatcacaaatagtgacatggatgtgaatataactagtcaaaaaatgtacctcttgctagatattttgattttaataaagcagaattgggagaagatgaagccatctctggaagaaattgaacaattaagatctagcataaaaaagcttttgattcctctcttagttaggctagaagggcctactctagagctgagtaggtcagtttggaggtcagtgcaactcattttgtcgataattttggatgaacatgagtggtcaaaagtcgttaacgaaatccataggaagatgattcttgatgatctgattgttcagaactcttcctcattgtctttaatggggtatcaaaattcaataggttcgccaatctccacgaatttgagccccacatcaatgaacaagttcaggatctcgaaaagcctttctggaataaatacagaaaagttatctagtagtgactcattgagaagaattgatagtaggtttcaaactgatgaaaggccgaatgcagataatattcaggtaattaatgttgatagcattgccttatcttatgagttatttggcgatgatatgtatcaatatattttaccaagtaaatatagtaagatctccaaaacaataattaaagatggagttagcacaataatggacatattccataacggaatcactgatacgaatttaagtagtgaagccaatccttcaaacaagtttatccaaattaagtattcaggtgaatgcgaagtattgaataactacttgctgcctattcttaatccagtagaaacaaatagttatcagcaatttttgaactgcataattcctttcattatttattcagagattttgagggatggatccttgaaattgaagccagaataccaaaggtctgaccaaaactttagaaggggaagtgggaaaaatatgattgtttctgtttcggatcgccatgataggaacgagaaagatttcacaagatttggaacaaaactaagcaaattaactctaaaggaactaggaagaaaaatagatgattgccatatgtatttgaataaatgccgttattatttcccaaaggaagtttgggaaataacagaaacagctttttcaacaattccaaaggagctggatagaataagaaaggaagcagaaactcagcatttactgtttaataggaacatttttggcgagatggtaaatgattactttgactcaaatattgggattggagttttaggacaaaagagcttcctaaacaaagatattgaaacttcagatttaaactcttctccatattctgattcgcaaagtaaccacttttcatttagcaactactctccaaattctgggatgatttcaattccaactttcgcaaagacagctttatctaggtttaatactctatggaacaataataaggcattaggagctataaaagatgactttgatggacccggaaaagttgcaaaggccacagatttagctatagagccagagttatccaaagaaacaacggatataaagaatggttctaacaaaaaaaagctaggacataacttatcgagttcaaattctttgaatacaattgaagagctcgaatctagaaaagtggatacttctggtcatgaaagaatggatatgaactcttctaatgagttctttttggaagacgctcctaaaaatacgaataaagacttaaattcgccggtttctttgagcttcattccaaaggacgatagactgcctgaaagtttggaacaacaaataaacatcaaaaaaatggagctaatttctgaatatataaagtatcctagcatatttaaaagcttggaaaagtacaaagaggataatgaagaaattaatgcagagatagaaggaatttctgccatcttagcttctacttttattaaatacatttctactgaactatttcaacatttatacacgtctgaagtgttcatgcttatggcatgcaaagagatttctaaggttgacgctatttcaggcacaaactctaacctagattcggattttcatttagaagagcacttgagcgaagaaaaactttcaaactgcttggataatgaggagttaatggcaacaattgataagttgctttcattagagtcattagttgctgccatatgcaagcaaatatcaacttttgtggctcaatctcagtctccaagcaggcaccgttttgcaaaagctcttgccaatttagtctatatttcttttaaaccataa

SEQ ID NO: 3693 - DNA, 1287 bp, Cryptosporidium hominis
atgaggcagtattctcctatagatattgcacttgatgatggcctattttactcttttaggatatctatgggtatatttgactcgttaatttccaaagatgaagaggaaaaagtcaaacgtatatttcagaataagaaatcgttaaaggttaatgatattgacttatacagacaaggttttttgaagaaaattgatttaggtaaaaatgatctgacttctgaggtgtttacagaaaccaataattttctttcctgtattgggaaacttgacgatgaatttatacatcttctatttcagtttagtgaaataatcatattggataattctagttcaaaactagtattggctgtgaatgaatcaatttcatataattcaggtatagatgaaagttgcgaatgcaaagttttacccataaactcttcaatatttggttttgtagattatattgatactagaaatgatacaataaaaagctttatatccaaatttaataagaaaatgtttgactcatccccattcttagataataaacataaacacaataaaaatgaatttattacatatattaaactcctcctcagagtttcatttataaaatcgatttgtcttttaaaaatgtacgggaaaaaacttccgatttatttgtttgatggaagtcagctattaataaaaattgaaccgatatttaattcttcgaatgaggactgcatgatttcgtacaaagtcattgatgggcaaatagattcatcaatagtgaaggtagatctagattattaccaattcagatggtttcattcgtggaaaaaattgcttaggaactcaagtggctatttcttccctcacaaaaatagcatgtctcaatttctaccgaataaaaaactttgtttgcaaaataccaacaactttgaacccattttaaccccattaagaaaatccttatctaatgtgaattatgaggattcaaaatttagtcctaataatgaaaaaccaagtaaaaaaacatccaaatctaatcaagttcacacacaaaacaaagatattgatactgaagaagaaaatgatagttccttgaaaacaaatgatgaaagcaatcctaattctccatctttgtccaagacgactaatgatgttataaacgaattgctaaataagcctaactctaatataaaatcttctaaacaaaaaaaaaagagatctaaacaaagtgaatcttcagatattgaaaattcccaagactacgtagataaattgattcaacaacaaacaatgcagctttttaacctttaa

SEQ ID NO: 3694 - DNA, 2115 bp, Cryptosporidium hominis
atgggtcttaatcttttttttcttgggatttgtatctcaatattaatattctccataagcggcgtaaaatgtagattatactatgaagataatttacttgttactgatgaagaatatgatgtaattattattggagcaggagtttcaggctgttcaatggctaatgtttatgctaaaaatgggaaaaaggttctccttttagaaagaggtgggccaagagagaaacatccaaaaacgttattgacaaagggagctccaggagtaatcacagatgaatctataagtgaagctattacgacatcaaacggaactctgatgaatgttgcaaacattgttggaggtggggccagtattaatggaggattttatgttgaaccatctacagaatttatgcgcaaaactattgaaagcagcggtgctacgtttgatgaaaagaaatacctaaatgcaaaagaaattattcgtaactcaggtattttgaacaccgacaaccgtctcgaagataacactttcccaaaagcaatgtttgaggccatgaaaaatattaaagagtactctggaaatgttagcgaagttcctatttattatcctgaaggaagtaatacatttgttactgtttcccagtttaacgaaacaaataggtcatcggcggatattcttctttctcatgaaaatataaaaatttacccctatgcagttgtcgaatcaatacagtttaacacgactgatgaaaaccgtgatccatatagcttaaaaaagaaagtaactgctcaatgcattttgggaagaatgaggtccgaaagtgatggttttgtaagtgtaagttctggaatgacacatagaactatttataacaataatggccctaagttcaaaatttgtctcaataaacctgattcatttatcgttcttgcttcaggtgctatttacagtcctgcgatacttatgaaaagtggtattggcccaactgaagtccttagaaagcatggcatccctccaattaaaattctagaacaagttggtaaaaactatcatgatcatttacaattcggtttgtttggaattttgaaagaaaagcagcctatgtccattcaaaaagtatatagttatagcaattgttcaaaatattatccagatcctcctaatatttatgatgaactcagtctattccaccataaggagtctgaacaaaaaaatggtagttcgactctttctaaaaattcgtttgatttactactagaaccaattttaagtaaccccgaatcgccattgtttgttccaccggaaccaactgggccacaatacgaagatggaaattgctactctacaatactgaacgaagtttctggagaattgtggattccttttgcaatatctcaaataatttatagaaagtctaaagttttaatgaatcctctcttgaattatctttcactttcacttaggaccaaaattcttaatgctttggaaagcaataatacaagaatttctgatgatggttttaataaaatgttacagcctatgaatgattgttttgaaaatggttcagccgcattatccttccttacaataccaaagagtagaggatcaatcactctagacgagatgggactcccagaaattaatagttcagacttttcagatcccatggatgttgaggctgcaattgttggaatgaaacacttaattcaagtaatgacttcacaaagtgtctcctcaattcttgagagtgaattgaactcatgtatcgcatctattagaaatatttgggattctttcccattgtttggaggaatcaacgagaataatgttattggattttcttcaagagaacaaaatgtaccagctcttattccccctctaccgaagattataaatgataaaacagcatttgatatggttaaggagtcttactcaacaatttggcatccaaccggtacctgttcattaggttctgttgttgatagtgactttaacgtaagagggactacaaatttgaaaataggtgatgcatctattttccccgaagtttcggatgtaagccccacttggatcagtatttcttttggcaacgtatattgctttagtaacatcttaacaaaaagttattcttga

SEQ ID NO: 3695 - DNA, 897 bp, Cryptosporidium hominis
atgaaaactttgaaatataaatttcttttatttattgcaattactcttttgtttatttctaaagttaagagcagccgtataatctatttaggtgaaaatgcaacaagaatagaaagtaatgcaactgaacctatatctaacaataaatttccatattttcctaatattagtaataatacttttaataatatgcaagagaatattattaaagcagttgtaggattcgatagctttatctttgatattgctaaaaatattacaagcggaatgagaatagcacaatttttcattttaaacaagacgaagacttttattcttccatttgttatgtttccagacgaaaaaagttttgaaaattttaaaaattctacttcgaatgagacagaagttgacaatctcaagttagagaaactttttccaataaatattaatttgctaagtcctgacaaaagtaatttcacaaattccactcttgaagaaactttaattgaacctgaaatgcttattccatatctgagaggtagtcacaaaatgataagatacaatgacacaacaaatgaaaatttaaagaattttacaagtgtaaattcaacggatgattcagaaaaaataatcaattcaacattgatcaggctgaataagcacttattaccaccaaataatggttcattgaacataaataatcaaacaggcagacttagatttcttcagtttacttcagcttatggattagaagatattaatgatccgcaatttggacaagatttaaattatttaaatgaaatcccaaatgtaggaggcattccttcatttactcaagattatgatcagtggataccttctaataatttcgatttttataatggctacggatttgacttcttgttcatggaatga

SEQ ID NO: 3696 - DNA, 138 bp, Cryptosporidium hominis
atggatgaggattccaaagataaagataaattatttgtcgaatttacagaattagtagctgaaagcttaggagaagaatttaaaacttataaaaacacctatgattctatagtcagtgatatagcacttagaaggtga

SEQ ID NO: 3697 - DNA, 1449 bp, Cryptosporidium hominis
atgggtgttataaaaagaactcaggtattgattgttgggatgggcccggtaggtatgacattaagcaatttgcttaatttatataaagtcgacaatattattgttgacaaattgacacaattttcgcctattccaaaagcccactacatttcaaatcgctcaatggagatattcagattctgtaacaacttagatcaagaaatatataggcttcaacaacctttagaattttggagaagaataacttatctaacctattttaataattgcaaatttggtattttaggaactaaagatgaattcagtaattataagacaattaatggttactacttagatttggatagccaatcaggagtggcaaattatgatcaaagcaaactaaataatttattgtacaaacatttgaaacagtgtaaatattcccagataatgcttggaacatcttggaaaggatatgaatttgtttctaaaagtggaaaagaaaaggtaatttcaaagttagagaaaacaaattcaaatttggaatttactatagagagcgattttttagtgggagcggatggagcaaagagccaggtaaggaaagctataaataaaagttttaaagggcatgaatctcttcaaaaacttctaaatattaattttatctcaaaggatttagcaaaagtttgtctggaactcaagcaagaaattattgatgagtgtaataatattaaattagttcccaccacaagtatgttatactttattctaaatccaagtttaataggtgtaatggtacttcacgatataagtcaaggcaactttgtgatccatattcctttagttagttcaagctctgagaaatttgatttagatttttttaagcatattttcccaagtttaattagccaagtatgcaagaaaaacattaatttagaggtaaaatctattgaaacatggaatatgtcagctcaagtacttgattcgtttgttgatgaaaaaacaaatcgaatagttttattaggagattctgctcatagacttcccccatctggaggatttgggatgaatttaggaattcaagattcccttaacttagcatggagattagcatttgtattaaaaaacaaatacgaagtagatattaaaaaacaattgaatgagtttaacatggagagaatccaacatgcgcaatatgcctgtaataattctattcggaatttttataggtccctatttattcctaaagctatcggattggactggaaaataatatctagtatgcagaagttaatatctaatgccgataaatatattcctaataaaatcttagaagagaaaccagtcatggattacatttataagttaggaatgtttagattttcaaaaatactaaggaatgaaaataaaatggaaaagataaagatgcttattcaggttagtttagtactccagctatattaa

SEQ ID NO: 3698 - DNA, 1566 bp, Cryptosporidium hominis
atgagaccttacaagccaatatataagttatgtattgttggtgcaggcccatcaggttgttacttggccaaatatttgctggcaagatcaaaaaaggaaaacattgcaatcaaaatagatttattagattccttagataaaccatttgggctgctcagatatggaattgcaccagatagacatgatctaaaaaaatcgatttctagtattgataactctctttttaaaaaatattctgatgatattaaattctatggaaatgtgactttgggatatgatgttaaattagaagaattaaagagaaaatacgatgtagtggttttagcagttggtggattacaaagtttccatactcttccagtgaaatatatgaaaaatgatttacagaataaaattataggaggagtattttcttctagagattgggtattttattataataaccacccaatgtttaaaaaaatgctatatccaacaaataatgaacattctaattcgatcaataataaacttgttgataatgagagaattaatatggatatagagttgaattacctaaaaaaaaaaaacaatcaattttttgaatataagagtcctttatcttctactgaaattagcgtcccatttaaaaacgagaatgaagactttaaatatggatattgttctgatatacttagaaattatatattaaactccagtgagaggaatgcggttatcattggaaatggtaatgtttcattggatattactagacttttatctttctatacccatgaacaactttcaaaaaacaaatatttgaatcctgattatttgaatttaattaacacatcatctaaatattcaaactccgatatctatcgacctttgttcaaaaacatatttattattggacggagaggttggattcaaaattcctttaaatatccattattaaaggaatttattgataagtctaggaaatcaaaatacaattctactaatggaatgaatatcagagtaatgatgtctcaagaagattttgagctttcacaggaccgaactagcttattcgaattagaaagaagcggaccagaaataaaaagaagatatttgaagatgaagtctatatttcaggaaatggttaataatcaccaagaatatatagccaataatgataacatattccataatgataaaacaataaacatacattttaaaaacctcttctctcctgtaaatattaaaactgaagaagtcaatattccagagaataatgtgaaaaaaaaatcaatcccgtttatcaaaggaatagaattagcaagaaatatttgtgattctaaaccaattactgataaaacagagttaaatgagaaggaaaaatattatttaccttgccaattattaatcacatcattgggatttaaaccaaaatatgattatatttttaatggaaataaagatcattcatttgaaaataattgttttccctgtcctatttttaaaactggttggatggaaactaatagcaaaggagatcttaatattgcgctttcaaatcacgcacacttggtaatgaaatattaa

SEQ ID NO: 3699 - DNA, 3606 bp, Cryptosporidium hominis
atgaatgaagtggctaatttatttaaagatgaacttggggacttaaatagaggggaatttattcgagatgaaacaaaatataacttctcttttattaaatcgatcaaggtctcaaatgttggaatgttagaactctaccaacaccaaaagggagttattgtagcattcatgaagacttttactatttgtggaccatcttttactcattgtaaattaagttttacaactgtgccaaacaacaataaagggataccgcatgcgctagagcatgtaatttttaatggtagcaaacgctttccatataatgatagcattgataagatctctaacagactgtgttgtccatacacaaatgctttcactatagatgattcaactacatttgaatttgaatgtacaacagaatggagccttttacgaatgttagaagtttggctagatcatttatttcatccaattttgtcggaagaatcatttcttacagagatcgtgcatttaaatgaaaatgcagagtaccatggagtagtttattcagaagtttcttctttcgagagaaactatgatgaggttgtcacaactctttcaaagtttcatactttatgtgagagccctgctgagaaaaaaaaaatcaagcttcattctacatgggaactttacgatgaaatcactgaaaaatatgatggaagccaatctagtgtattttcatgcactggtcgaacaactggacttcaaaatctttcattagatgaactaaaggaatttcatgcaaacttttatagtttggataatatgttaatcttcatacatgggaatgaaagtattaatataaataatatttttggaacaattgggaaatttattagcgaagcagaacatgttaatgataataaaacctgtaagaaaattagaatttcagattccccaataaaccaaagaccattaaatagaaagttttgttttaatgaaaatttaaaagaacaatcttttccatggcatctagagatcccattccctagcgaagaagaggatttaagtaccattagtttttcatggagatttggagcattttcaaactttaaagaaatgctatcaattaccgtattattgcattatttatgtattggaaacgactccccattgatgaaagaactcgtagaaggtaaatcttactgttcagatgtagacatgtcaaatgtttgcgaaaaaaataggtaccaccaaattttacttcagggggtagaaacaacaaagattaataagatagtggatttatttaagagaataatttctgaattccacaatggtgaaagaagttttgatattaatgacttaaaatgtaagatagaaggtctatactacggacaccttatttcattggaaaataagactattgatacagtatttaaccagctatctggttttattaactatggaattaataatatggatgatctcaccgaatattgtaatctgcattttattttcaaaaaattgctttcagagggattagaatattggaaaacgcttttcaacaaagccttttgtttacaaaaaatgaacatacttgaatttgttccaagcaaaaaattatcaaaagaaatgacaaagagattcaaggaagaaagaaaagaaagaataagtaagaaaggtaaacgtttttttcagatttgtaaggcgaagttggaggagtcgataataataaataaaaaacgtgctattagtctcgaaatacttaataatttcaatatatctttcgatttaaactgtattgatcttaataaagcaaatattaccacaaatttgaattactcagaagccaaactaacagagattaatgaagggaacgacataatatttaaaaaattaaatatgggctatgacttagaatcacgaacaatagataattgtttgtacttttttttagaaaactcaaatactgagtttgtacacgcacaactgaggattaatttgaacgaaaatctatctaacactgaaaaactactttcatcctttttagtagaattattatttcaaacatctgttaaggttataaatttaattgggccacaaatttctgaaaaatattcaaaattaagagagtcaaaagtcttcctacctgatgttaattggtcagacggagaaataattaacttcgatgattttgataaacttttaaatactttttgtatcgattactatgcagaattcagcgatggatggattttggattctaatacaattccaaaccaaattaaagtaaattggacaaccccaatagaatataccgagttttcctcaatattaattatgagtggaatttgtggcatgagattgaatgctgaaagaatttctacaatagccagaactatcaaaggagcaatcagcgaactaaaattgagtgaagaaggtttaattacttctgtctcgaactctctttgtttctgcgatcaatcaatttttaatatttcaaatattccaaactttgatcatatttccaaaaggttgatagaagaaccaaaaaattatttgcttgaactagaaaggcttcattcagttcttattagaccattcgctcttgggaaatcagaagatattccagccagtaacacaaagttttcgttatttgttattgggaaagaggaggccaacaaaataaatttattgaaatatttttctatcaataaaaactacaaaagccaatacttaattaataaccaaatacagagcactcccaacataaatttacttccatgggaaatactttcaaaagcactcccattggatctaggtatagactttaattcaaacagctcacaaaaatttagaatacctgaaaaatatggctattcaatttacctaaaggttccaagctcaaatacagcgtgttttgttcagtcaatcaatttaaatacatttggtactttctgcccaaaaggatctcattttttcaatccagatgttccagctcttcttgtactttcaaactatctttgggatccttgctcactactctttgattcaattaggggcagtggtttagcatatagtggaagtttagatctttgtatgactactggacagttttcaaattgtgtgtatgaatcaacatcaattggtcaatctttaatcaagacttgggaaattttcagagagttatcaatggatgaaaatgaggtttatgaagagattaagaaaactaacaaattacctaattactatgaaagcttttataacagtctagatcttgatgaagcaaaaaggatcgctgcttataaatttatttcaaagcacaaaaaattcaattcttgggcaaaacagctaaattttgatctcaatgttggtatttctccaaaatttgacagttttattattaaaaaaatatcagaagttacagttgaagatataaaaagagtttcaatcaagtaccttaaacatttcttacctaatgccacaaatatgatgccttcaagttgcatagctctttgcggtggagaaaattctgctattgatgcaatggaagttctaaaggattacccaaattttagatttagtgtcatttcatactctgaatttttaaaagaaacactaaaaaatgttgaaatttag

SEQ ID NO: 3700 - DNA, 630 bp, Cryptosporidium hominis
atgaaaggaggcagaataaacgaggatttatttaatatcatacatgcaggcaataataaagatcctgataacgtggaatcgatgaattctattcaccaaagtctccaagagtcatctaaaagaaataagattcagctggaggatatgggacctacaaagttatatagatatttagacttacttccttatgataaacgattaaatatcaagaaatcaagtattcatggatttgggctctttgcaaaagaactgattaaaacaggcgagccaattattgaatatgttggcgaactaatacgtaatagcgttgcagataaaagagaaagtctttataagtcaaacggaaatcgggatgggtcatgctatatgtttaggctagatgaatccagcgtaatcgatgcgactaatattggaaatcatgccagatttatgaatcattgctgtgatccgaattcaatttgtaaagttataagtattgattcacaaaacaagcatattgtaatattctccaaaaaaacaattaataaggatgaagagattacttatgactatcagttcaatgttgaggaggcttcagagaaaattatatgccattgcggtgcaagcaattgccttggaaggatgaactaa

SEQ ID NO: 3701 - DNA, 1026 bp, Cryptosporidium hominis
atgtcctgttcgaacaatgataaaacttatcaagaggacgattatttgataatattacacaaagatgaatgtagcaatgatagagaatttgaagaggctataaaactaaacttgggtggttactattatatatatcaaagaactgaatttattgatgattcagaaaattatcatcgatttccttcacaaattttattgaaaaggattaatttacttaaaacttatattaaaacatccaacttgaatataccattaaacttcaatcggcttaaagaaatgataaatgaatttttatctttggacgtcgactttcttcagaaaataggttcaattaataaagaaatagagaatttgaaaatttgtataacttcaaacttcgaaaataatattaaaaagtttagttctaacatagagtataagaaaaaaatccaaaagtcaatcgactttatttattggttattgaaaaaaaaaacagacttttattgttctgaaagtgaaactgaagaattttttaatttaaataagattaagagtgagtccaaagtcaatgacggatttaaaggttcatctcaaatagaatctgaagttagctttgagcaaaagatccatgatatcagcagcgataacaagattattgaattagctgcatctaaaaagactcaagattatcaaggcaacactagcccggataaagaaatgaatcacttcaatctaaacgataattcttccctaagatcagcaatcgaaagtgaacaaattatgaatggaactgaaaatgactccagtgacaatagcaatacagatgatgttgactcagatatttctcagaagtctgaaccaattatcaataaaaatagaatgcataaactatacagaagagcaggaacggttattaatggaaataattcatctattatttcagacacaaaacttgataaagacaaatatttgaagttaattgaaagctacaaaggactcacaaaatctactgaaatcaaagaaaatattagtgcaaaccaaacctaa

SEQ ID NO: 3702 - DNA, 222 bp, Cryptosporidium hominis
atgctcgaaagccagttaaaaagagatgtaaaactattaaatataaacggttcttctgaaaatgaaagcaaacttgataacctcagctcaatagaaaaaatggtgaggtgccctgctcagctttatttcattaaaagaaggattgaaaatattaaggaaaatattgaaaatacagaaagggatattgctatattagaggaaaagacttctgaaacttactag

SEQ ID NO: 3703 - DNA, 1104 bp, Cryptosporidium hominis
atggataaattaatggtatggagcgatgaggaaactgacaaaatattccaattggttgttaaattgctcaacggttgtgaaacccgcaataaaataatggatagagttcaaaaaaggacggggataagatgtagctcctaccgtcaagattcaagttgtaattcaaagattgaaggctttattgggataaaaaattttagtagatcaaaagaagacaaaattgggaacttgatcgataaatatttgaaaaaaaactttatttatatgttattacctatgataatcaaaaaggcatttcttgcatacaattctctcaaggaaatatgtactggagaatcgaataatatttacaaagagaatgaattagatatttcggagtacaacctgatgattacggtattttcagaatcaattatttactgctgtgttgataaaattatggatgaagtgaaaaacaattacagctctaagacttgcgatatttctaggtgggcatctccatatataattaaagatatagtgaatatcattgacaatcaaatgttatatgaacttaatgaatttggaataactatgaaatcgacttggttcggtgaagagatgagaaacaaaattaacaaagctttaattaagatggattatcaaggtttattgaccaataattcagtttcaaaatccagttttggtgcaaatttcagatatgctgtattagaaagtgacgagattcaagatgaaatgcttgtttactttaacgcaatagagtatcttccaaacgagctgaatgccaagcttgggagaaatctaaatatcttatcaaaatctatttatattttatcaatagagcctgcaaataccgggtttattataggaaaagattcagaatcttttattccagggagtaaaataggaataatttacttctcctgtaaagaaaaaataaacattaattgccaaaacaacaaaacaaaaaaatcagtagaacttgaattatctgacgataagctggttatagctgatttaaataaaaacaagtacacttttcgaaattttgagtcagaattagttacctactgcatactaacatacatatttggccctgaataa

SEQ ID NO: 3704 - DNA, 246 bp, Cryptosporidium hominis
atgactcatattaagccaaaaataacaggaatgataattgaaactagtaatcaggcaggaaacaactcaccaatgtctctagaagatccagatgaaccatctccttcaccaataaatccaattactcttaagcacactcttagacttgcttcaagagtaagtatttcgaataatgctaaagtaagtcaaaaaaatttagttgatgcgtttattttaattattaaaatgataaaacttttagattga

SEQ ID NO: 3705 - DNA, 3879 bp, Cryptosporidium hominis
atgtcgatttttgtcgaggaaattaacgttaataaccccggcttattgcaaggccaaattgaaagttcgaaaaaaaacaagtgtttggaagagaatgtttcaaataaggattttattgaaaataaaattcaaaatgttggatttagcgcaaagaccgctgttgaccatttggatagtaacttaatcttaaaagatgataaaaaagggatgactattttagaacaaagtgaattggaaatgaagcttaagaagttgctagaggcaacaaatcagtactcataccttttatctggagagtccaagaactctaagcatttagagtctaaatctaaatcaggatcaaactgcaggcaacactttattactgaaaaagaagaggatgacattctaattaaagaagttgaagacgacagctttcaaaatgaagatgaagagataaattactctatagaaaaggtggctgaacaaccagattgtattactggtaagatgaaattctaccaattagagggtttgaattggatgtttcaactttacaaacacaatattaatggaattttagcagatgaaatgggattgggcaaaactttacaaactatatcaatattgggatttctgaaaagtacttttaaggttgaagggcctcatattattttaacacctagatctactctagataattggttttgtgaattgaaaagatggtgcccatctttacgtgtagtgaagcttcatggagaccgccaactcagagatgagattttttcttcattgcttttccctggtagtaaagtttccgctggcactttatattgtaacgaatcaaatgagctagctgaagatgaggaaaaagatgtagaattgcgccaaaattctgaagagagaccaacctttgcgaattttgattacaatgatggcaatctgcattataatgtttgcttaactacttttgaaatggctattaaggagaagtggaggctacagaaaataagttggaaatactgcattcttgatgaggctcaccgtataaaaaatgagaaatctcttctatcggaggttgttcgacttctcaaatcaaaaaatagacttcttattacaggaacccctcttcaaaataacttgagagaactatggtctttactaaatttcttaatgccaaacttattttcttcttctgaagacttcgagtctttgtttgatttttcaaaattagaatccgacgatcaacagaaatgtgttatcaaaacattacaccaaattttacgcccatttatgcttagaagactaaaagctgatgttgagagagaccttccacctaaaagagagctttatgtatatattggtctatcaaagctccagaaaaaaatatactccgaacttttgacaagaaatttagatgtactaaacagcgctagctcaaataaaactcaaatgctaaatttacttatgcaacttcggaaaacttgcaatcatccatatctatttgacggtgttgagccagggcccccatatgttgaaggcttccatatggttgaggcaagcggaaaaatggttcttcttcacaagttacttccaaaacttttttctcaaggtagtagagtattattattctctcaaatgactagactacttgatattattgatgattatcttcgttggtctggctatccttattgtaggatcgatggatcaacacctggaatagaaaggcaggaaagaattgatatatttaataaagaagggagcgaaaaacttatcttcttattatcaacaagagctggtggtataggcataaatttagcaactgcggacgtagttatattatttgattcagattttaatcctcaaatggacttacaagcaatggatagagctcatagaatagggcaaaaaaaaccagtaactgtatataggtttgtcacagaaaagacggttgaggagaggattgttgaacgcgcagcaaaaaagctaaaactagattcattgattattcaacagggtttaatttcgaatgcctctcattctgctccagataacagagaactacatgaaatgatccaatttggtgcgcaagaagtatatcataccagagactcttcttcagttacagatgaagatatagatacaattttagctgcagcgcaagagagaacaaacgaaatgaatgcaaaaatgaaaaaattatcttcagaacttgatcttcaaaatctgagactagatggaggaattaaagcttcaatgcatcctgaaagtaaagatgatgaattaaaatcaggagacgattcaaaaaccaaggatttaccgacaattcaatcagatatcacatggtttgatcttggagaacgaaagaccaagtggaagcttgaaacctcttcaaataatacaatatctattaaaaaacaaccaaagccaaaacttattggatggagggcgcaagtgggtggtggatatgatcaccaattttttaatataaaacgtttagatgagctcgaagagatcgagaaaaaatggaatgaatatttaaaggaaaatgaaatccaacagaagaataatttaaatgattctgtatgcgcaaaattaagtaattttaatgaagatagcttaaaagatgttttttctgtgccaccagaacttaaagaattgaacgaaaatcaactgatccgtcttctagatgttgcagaagagcacatggatgtttcaattgataaaagctcctggcctaaaaaaaaacttttctccagagcaaaagaactcttctcatccgggttcgttcttcctagatgcaatttcaaagaagcgcttgctgatcttaggctaatgttcaatgatggaagagcatgggatatgaatatcccatgcgccagacaacgaagtaaaaaaaagaataataaagagaaaaacttggaaaatagtcagaatccaacagtttttactgaattaatgaaacaagaaatgatggaacttatttcccaggggtttgctacttggacaaaaggtgattttcaacgcttttgtagagcagctgaactttacggttcagatttacattctattactgattcaatggaaaacaagagttttgaagaagtaagcaggtattataatgtatttttgaaaaggtataaggagcttccgggcggcgagagaataatgggtcgaattaaaatgacagaagaaattcagaattggttttctgatgcaaataacgctataaaatatattgtttgtgaacaaataaaaaaaaataaacttaaaaaactttctcttgaaaacatttcattaccatttaaagtaaaaagcacgagcaataagtttgaatcatttagccatttacaggacaatgcgttattaattgcaatgtacaaactgggcgttcaatcttacaatgacgtttcaatatcctttaaatatttactaaactctataacatcggtaaattccctttattattcacactattctgtagaatttatcaccgaaagatgtaacgaaatttctaaagctgcaataaattactacaagaaatgctctcaacataaaaaaccaaataaactaaaaatttccaagcataattttcaagataaacttggagacactaataaagtttcaagcctaaataagaaaaaaaaaacaaaaatacaagataaaaagtcagatagtacggatggccagcacaacttagggaaaaactatgaaatggactttgaagatcaggaagaagaggaaagagaagaagaagaagaagaagaagaagaagatgatgatgatgatgatgatgatgatgaagacgaacaaggccatcataattcaaggaagaaaagatccataaatactcgaaagaataataggaaatgctcaaaaaggaaaagatttaattag

SEQ ID NO: 3706 - DNA, 393 bp, Cryptosporidium hominis
atgtacctggataagaaaatactatattggtgtacaattcccgttaccatattagttttttgtggagttattttgagaacaattcttcaaacatcctcgcaaaaaaagaaaaagaaaaggttgccttttaagaatgagaaaaatttgaatgattgcttgatgtccactcaacgcgtatctttgagaaatcaagagttccaaaatcacctcaatagaagtgcattaataaggtctagaagatttttaattccagaagattcatttttgaaaagaaagctgttttattgtgaaccagagagtggatattttcataactctccagaatctccaagcccattggctgcactctcaaacccaggtatgtttgcgtgtttaattcttatgacttcataa

SEQ ID NO: 3707 - DNA, 309 bp, Cryptosporidium hominis
atgatgaaaaaccaatttgggtttctaattttgaatggaggaatgggatacttggtaaacacattattttcgggattcctagttgtttatattcctttcccactttcttattcatttaagggaatgcttcaaagaggaatagaatcaaatccaaatataagtgcctcatttttgtcagctctatcattttatttcattgcattactctgttgtggagaggttgttcatcttttcctttctattattggtgttgaaggagtttcaggcccgcaaattgatctaccaatgatgaatcagcaaggtaagtaa

SEQ ID NO: 3708 - DNA, 5328 bp, Cryptosporidium hominis
atgcctgcgcagattaatgatattattttcttaaagagtgctttagaattactacatccatttgaatacgataatatgttagcatccgggttccaacttgaagaaatattttatggatgtctaacatcaatatttgcaggctcattaccatcctcaacaattacacaattgtatgacttattgttcaatgtatacttccaaccaaaagatattttcatgaaaaaaagagagcaccatcataaacatgatcataaaaatgatattgattataatgataataaaataaatatttcacttagtaggcgtattttaatatgcttatcttactttatcataacagaatcatatcgtgaaattaatatcaacccattgatttcttctaagtgtattcgtgaaactattaaatctactatggctactatgagagatccattagaaatggtacacggcattgaaagagctgattttatcatttttggaaacaagaaaatttatgaaagtatattaaaattatatgagacatatattatttcataccaagaatctttatggttttcgaaaaagcaaaattcggtgttagaaaaaatgatcaatatgaccccattacaaaatcaacatggtagtgatgcaccttcacatttaggaatgagattcattggaggaagatatgtacccaagactgttgcttctcctggattatcactaaaagatttaacagagtcactatatccattaattaaattccaagcactctatgcggggagaaatctgcaccaattaccacctggaattgctggttatgtaataataaaaatagatgaagtacgtgaatttgccaaatataatgaacccatatctccggtagtttgtgtgagaatggaccagtataaagttgcaacagaccctgcaaccgaaagatgttctagatcatttatatggaaatcaaataacgtatttatgttcccaataccaatttggaaatctcctacacaaaagaaaaatataaatggacgcaacagctatcatttacataaagagtcatctgaatccgaaatgccgttgaccgttgaaatttttatcgaagttttggattccgaagcgcttgatgatgaaaataaattattgtgttcagcacaattaagtttagacaggtggtcaactgacggtggtagcttatcattaaatggtgatgatggaacattagcaatatataatgattgtaataaaatgagcttactattttcatggtatacatatgtaccaaataatgagttggatacaagcgctttgttaccattttcatttggaaaacaacaatggggtgattatggtggctatcactgcatctatgcaccagttaatgtagagtcatataggaatgaattgcattccgaactaaaagaggaaaaattgaaagaatgggaatcagagccaagacaaagcgtattagatattattcgtggtcatagaaaaatggacgagagtggtggaaatttagatgctttaccaacaatgagatccatgtatcccggtaaattggaaattagcactggaaagtacggcccaactagatcgcaattgcaacaattatttttcttctcagctccttctcttttaccatacgttgatgagattgtcgagagttttgcaaaaatatctatgaactcatcagaggagaaggtcacattaaccccagtacctttaagagaactcattgcatccattattttatgttcccgtggtacattaagcgaaaaagccaatttattatttgatttatttggctatgatgatgcaaatcgattgtctgtagcattccattcaatgtattattctcatactcctcaatatccagcggctattcaaattggttctcaattaaatactcatttaccagttgaagtatctgataaactaggtgttgctccttcaaatgtaatttcactggcaggtgtggcagcaatagtacaaactgcatgcatacgttcaaatataccattagataatgttggaatttaccaaattacagcttcagtatttgaccattatttcgatgtacctagtgttgtaaaggcattgattatacctcctaagggatatgatgggcgtgtatctaaggaatatattacacataattatcgcaatttgaagtatgatacaagctcaatatcaaatactgaagatattacaatagataatatgaatatttttagtgattgcagaggaagtaagagtatctttaactcaattaattgtatgaatggtaaaagtgttaaagaaaatgcatattggtataacatcgatcatatgattgacagtaaatttattttggatgtatcgagatccataacgcaccatattagaaaaaatgcatctttggaagggttatttggaattgatttctctgttcatacttgcctaaggcattttgatattaatgatcctttcccaggtttaattaaaacattaagaataattattagtgggaagagaagtaaacatgaaattagaataattgatctaacaattgatgagaaaggccactttattgattcaagagtacaatatggtacagaaactagtgatgatttgcacacaacagatgttagaggagcaaatcaattcagacaagcatttgaatcaggtttagcaactgtcgatttcccaagactattatttagtgacggagctgcaaatggtaaagaaagagtgcctactgctagttttgtcttcaatttacacaatatcttaatcgataaatatagttttgttacaaagttctgtgatttcacattagtaacagaagcaataaggagaatcactgctaatgatcgtacatgcgagcctaatcgatatcttaaattaaatgtagaagttaatttaaccctcgaagaaaacaaatcttatcctcattacagcgttgatgaaatcctaggcgttccattaaaaataatgaataataatgacgagctagcaaatcaattaagccaatctctagtaatctctggctcaaataataatattggtaatcaaagtcagagaagtgttatttcaatgaatgcctcaacattaatgaatgaagatggatacatgactcagagatcaatgatttcaacaaattcaaaacaagtattcgagccgtctttatcggtgcattcttcaatgcctttattaacagagagtgaaaatacaaatgaagatgttggttgtcaaagtatagaagcagagaagttgaaatcaggtatttcattaacgagcaacaatagtattgctaaaagtgagattgaaaagatgttatcaaagaaatctactttagttggagatgaagaattggaaaaaatggtttcaaacaattcctatcaagacaataacgttaataatgccgaaaagttgccgacaagaacggagagtaactcaggggctgtattaaagcaagcttctactgcaacttctaggatagctgctctgtttatgactaggcaatcttcattgtttaattctctatcattcaataatgatggcgaaaataataaagaagctgacggtactttagattctaaattgaattctattgctaagtcatcttcaaacatttctgatgaagagataaataaaatagaatcaacttctattccaagaaataaatcttacaatattgatgaagatgaggaagagcttaaagtagatgaagaagaggaaatattattgcaacaacaacaattatcttcagcaattaattcatttaactctaaaagaataaattctcaaacaagtctacttagcgcagtaagtcgcggcgcatcaactgtaaatctctgccgtacattcactagaggaaattttggctcatattatgaggctgaaggcaagacagagtatcaggttgatattccttttagaccaccaggccaggtagaagagagacataatattagagtttatttggctgacagcatccgtgttttaaagaacaaggtaatggaagcttgcaaatcaattgctcaaagattacaagaaagtggaattgataatggattgtataaagagattgtattagggccacaccatgtagttgagctagttgttactgactttgatggccatattcgttatttgcctttattaaatgaaacaaactctattgaagactatattctttcaaatgaagatttactgcaagaatttataacttcgaatatgaatagcattcttaatatcagaatcattccaccaaagaatttacaaacagagaaatcaactagaatcgttaatgagatgcaacacgaaagtggtggagcttttattacaagtatgtatttggcaaatgaacttgcaaaccacgaaatattggaagatggattattagttaggaacccattagggtttagaacatatttccataaggctcattatgaaataagaaacaagatgattgaaattgaaccaggaaaagtggtatcattggataatttatgttttgtaagaaaaagtaatacagtactaaataacctagcagcatgcataaatttagattggaatgttgacgagtgggttccagcagttgcaattagaggaattaatacgttcttggatgagcttgaaggcattcattctgagtcagtgcgtggccgcacatctagaattccgcaagcagtattaagtgcatcgtcaacgatcggagggtttatgccagtaacattaggagcatataacccaatttctgctgcgtttgactatggttatggagcaagaaatggaagcatatctgtttcaaataatcatagaaactttggaaataattctagtacaaagaggtacaaaactggaacaaattcggggactaagaaatttggaacaactacaactggtatagccagtacaaaccaaccttctaactctgtatcttcaaagattaaaccagaagatatgattacatctgtttatggatgggatctatgctatgaagttattctattagatttccatgacttgatgattgaaggaggaatcaatacaagagagtccatttgtgtaactgaaaatgatgttattttctgtttcagaaatccaagtgtaaggcagcaattcgagattaatcaacttactacagacgaaaaaattagaattatgtctctttctgaatcagggatgtgtcctcaaagaattgcgctcgagctatctgaagaccgagtcgctgcattaaagagtggctcgtactctatgctatataataatcaaccaagagcagttgttgtaccacaccaattagtttctgaatttttgagaaggttcagagcagcaattgaagaagacaaacatattttctaa

SEQ ID NO: 3709 - DNA, 1725 bp, Cryptosporidium hominis
atgagggaggttttaatgctaatattttacttaatagttattgtagggctcgtggtctctgcggagtccggtgacctttatatcaatgaaaaactcaatgttattcctgtaagaaataatctgatcaacgttgttccaactaagtcgaacaatcaaatgcttaatagcaggagtagtatcgtgcttgataaattgaggcagaaatttccaaattgtcccttgagttgcgaagagtcttggataggtgatggttggtgtgacaaagagtgtttctccgatgattgtggaaatgacggaggtgattgcgttgggtggtgtgcgcctgagtgccgtcctacttggcttggggatggacagtgcgacattgattgctttaattcaaagtgcaattgggataacggtgattgtaaaggacataacttcgatttaaataaagaaataatattaaatttagaaaataaatggccgaacataaccaatcttgaatttgactactctaaatgcaattgtaataaagaactgcttggaaataacgtttgtgatatagaatgcaatagtatcgaatgtaacatggataaaggtgactgtttacatagatgtaattctcgttgtattaacatgtggcttggagatggtcaatgtgacccaaattgtgatactatagagtgtttctatgataaaggtgactgtaaaacttgttcaggaaactgcagaacatggatgatagggaatggaatatgcgataatagttgtaacaataaagactgcaactatgacggaggagactgtacaaatatttgttcagtttcaaaagttgactataataatcagcctttaatctataaattttgcttaaattcttggctaggtgatgggtactgtgatgaagattgtaataatgaaaattgtgattttgataagggtgattgtaattccaaaaaaaatgattctccattagatactatttattcatatgaagctagcctcaacccaccaagaaaaatcagagataacaaaaataaagtaagtaattcaaatataaaaagagataattccattgtaaattctcaacacgaacaaaatatctttactactactactgcaacaaaaacatcaacaataactactactactactactactactactactactactactactactactactactactactaccactactattactaccactactactactaccactactactactactactactactattgctgttgctttttccaaaaattacttaaattattttggaactatgaattcagacacgaatttatctagtaatacgatctcaagaacgattacttctacaactacagtaaacacaaattttaatttgataaattataatcatcataatactcgaacagcaaattttctagattatcctagatacactaatcacccagtccaatactcgattcaggataggaattctcaaaacaatcgttattatggaacatacaattctcaaggtgggtactacaattataatcctatttcgaatggctacaatttgccattatacccaagccaaaattatttatattctaacaactatagttataatcaaaatccggggaatagtgcaaataatcttcaaaactacaattcaaatcagagatatattaataattataattccaaccgaagtgaccataacggaaattttagatattatgaaagaagaaattaa

SEQ ID NO: 3710 - DNA, 1374 bp, Cryptosporidium hominis
atgtctaatatcagtcttgaaaaattaatttctaaagacatatattatggcgatcaagctttaacgcctagcagcaattcaaatgtttttgttattgcagttgcagggggaagtgcaagcggaaaaacaagtgtatgtaccagaattttttcagagttaggagataaacgagttacggtaattgagactgatagtttttataaaactcctgtcttagaggagggacaaactatggcagactacaactttgatcatcctaattctgtggactttgaacttctatacaatgttttactaagtttgaaaaacggggaaggggttcacatccctaactactgttttaaacaacataagagattggaaacaggaaggaaagtttctccagcatctattattattgttgaaggcatatttatcctttttcatccaaaaataagacatcttataaatatgtcaatttttgtcgatactgacgatgatattcgtcttgtacgtagaataagaagagatactattgagagaggcagacaaattgacgatattcttaatcaatatgagaaaacggttaagccatcctatgatgaatttatttatccgactagaagatatgcagatatcgtaattccccattatccaaatgaagttgctgttgaccttgttgtacaacatcttagatacaagttaaaaatggatgatttaagaaaaatttactctaatttgcatattattccttctaattgtcaaatacgccatatgcactctattataaggaataaggatacatcagcggtggactttgtcttttggtcagatagattaattcgactagtcgtcgaaaatgctcttggccatttgtcttttactggtcaaacaattgaaacacctattggagaactatacgatggagtgcaatttaattacaaggataaactctgcgcggtctcaatagttagaggaggagaaagtatggaaataggtttatctgctgtttgtaaagatattccaataggaaaaattctacttgagttccaaaatcctaaaacagaacttgatgcccagtttgataaacctagaattatctactgcaaattacccgatgatattgcctcaaggaatgtatttattttagatcctattcttgggaatggatttggggtattttccgcaattaaatatttgttatcaaaaggggttttgcagcgtaaaattattgttcttagtcttattgttgctcataatgcaatacatagaatatgtaaagagttcccggaggtaactctagttacgactgaaattgaccgtgatgttaactctgatggttttgtaattccaggattaggttgttttgctgatcgatactttggaaccgaataa

SEQ ID NO: 3711 - DNA, 648 bp, Cryptosporidium hominis
atgattgacgaccaacttattatatatacgcttgtaatatctcctgttgtcgggtggcttacttcaacaaaaagaacttggaacaaaaaaaatcaagtaaacggagttattcttgcactatttgtgttagtgattgcatgtgtattgcaaaatgtaagagtttctcaaaaccactaccaaactttgggtatatcgagtaatgcgtcaaagtccgagattaccgcagcatacagaaaattagctcttaagttccacccggataaaaactcagatataagtgcaagagaaatttattctaaaattaggaatgctaatgaaatactatcaaacgatttaagaagaagttggtatcgtagattcggaacagttgaaaataatttagatttatacaaggcttcagaagatgaagaattcattgattatccattacatctgactatagtaccttttgttactgctgtaattccgatttgtttgtcattattgatgtggaatgatcaagaaaatataagaagaataatcctttgttttatagtttggacgttatcatgcgggattttacttagatttgataggaatggaaacgattttctacatttattcccattttcagaaattttctcccggtcgagaaaattagagttttag

SEQ ID NO: 3712 - DNA, 1536 bp, Cryptosporidium hominis
atggagataaaattaggtgatagagtgtcgcatttggaagatgaaagaattgggacaatctgctcaaccgtatttaatgagaatggcgaggaactttttggggttttgtgggattcagatataaattacaattcactaaattcagatatacaaaatatttcatcatgttatatgaacaaaaataaggtagaaaagaaactagaacttcacgaaataaatgaattatcgtcaggaatttcttttcaagaagctattagaagtcgatatttatgcgatgaagaagttgaaaattttgtgggtttgaaaaaggcacaggagtattgcaaaaaaatatcaattttatctctagaaagaatgagcattgttacttgtgcctgtaaagaacttatgaaatctttagaatctcctgtagacttgaccttatgctacaataatattaattctctttgcttaaacaataatttactatcagattggaactctttattttgcatactgtctcatttaccaaaacttgaatgcttaatgctaaatgggaataggttcaaagaaatttcttttattaaccataatcagttcaataatatcaaagttttaagtatgagtaaaaccttcgttaaatttgagcagctaatgctgttatttagagaagactcagtattgcctaatgtcaactatgttaacctttcatcgaacaactactattttatttcaatggattattcaaacccaacaattcaaaggttagatttgagcctaaacttactatctgattgggagaatatagaaaatatcctaaaatatttgacgggtctgaaaagcttgaacatatccagtaattatttttttaaattaccgatattaaaaacaaatacaaatattgatattaaattcccaaatattttagaattaaacttggacaactgcgggattattgaacttggcacaattgtttacttaaggaaagctttcccaaacttagagcacctttgtcttagaaacaacattattttgaataacactacaatagatttaagaagtataataatttctatattaccaaatataaaaaccttcaataaaagtataattaataagcaagatattatttcatatcagcgttattatatttctcaatatacagtactaaaaaataatatgttgaaagagatagacccaaatggagatattctctgcgaattcatcatagaaaacgacatatcaattcatcaaaatttaattcctgactccgataatatgattaaagacgaaaaatacttagatataagctttattcctcaatttaaatgttgcattgactgtaatccaaccacaattaaactaaacaaaaaaatggccgtatctgatgttaaagttttaatttggaagatttacaaaatacaaaaaaatgaatcattggagtatatatttgttaataacaaaaataagattaaaattgaaggatacagtgattctcattcactatctgacttgggaattgaaacaaatggaaaaatttacattcaggatttgtga

SEQ ID NO: 3713 - DNA, 1665 bp, Cryptosporidium hominis
atgaatcatttgaacgaaataaatactagtgaaaagactgaaaatgggtcgagcacattaattgagcaatctttcaataaaacaggaactgtcccatcgacagcatgtgtatcgccaatactagaagggaaaagtttgtcaaataattatatcgaatcattgttcacaaattcaggtcaaaatactagccaagcaataaattcatctctaggacaaaatattgggattggtttaaaccttggatttgggttaaatatgaatataggtggaattaatgaattaaaccctggttttcccctgattttgccgaaccagctgtatcaagtaaacaacgctcttggtgcagttcgagctgtattgccagactgttatagtgccattccaagaggctacaatttaaacggcgcagtagttccacagagtgttattccagtaagtggaataccaatagccagttttccaggaatagaatcaattttgtctactcaaaacaatttgttatctaaagaggagaatcaatctattaattccataaaattggattctcaacctccaattatcaacccattgttgcagtcaccactgttgtcaatcggatctcaaccctcgattattcacccgaatatcatgcctagaatatcgccaataattggcccatgtctaggctcgatttatcagaataatttggttagtggaaccgaaaattgcgatattggcaaaattaaaaagccagcgcttccgttgaaaaaggaaataggcgtgccagaagaaagtgataagcttaattcattgctgaattcttatctaaataatattgctagtctggcggatgcacatgaaagagtaaaaaattatttgaacgcaaacggtgactttaataaaagtactaatattgtttgtgatgattcgatgaagctgattggaaaccccggactgccagattacagcttaaggaatattaaattgggccagatttcatttgaaaatctttcaaatggcatttctcacagtagtggctcagaccaatgcattctaggggaaccaaatgatgtttttaagattagccatacaagaaaatatagattaggcgaccagggaagggcattattgaaaagtgagttgtcagcctaccttagaagtcatcccgaaaaaagagttgaagcaagcaaaatagcggatattcggaacgcaactacaaagcagctttggcaaatagcggctatgtgtgggcttgaagaacggtttataaacttacatgcacaatcgctcgctcaaagcaaagggaaagtgggtttgaggggtacaaagagaaagcctagcactaacattaatgagttgactaaggtaagcgaacaggtaaatggtggagactttgctctgccttcaagtacgactgagtcacaagaattagatcctaaatcgaattctactgaattattagttgtaaaaagtaatggttctatcgaaacatctacatttgaatacaaaacaccaaatattgaaatagaagctcaagcagaaatcgaagatcaatcagcagatactggaggagagattaatactttggtaactgctaatggtataaattccgaatggagtgaagtgagggagaattcaattatttctaccgaaaatgacgtgaagagaataaaagtggatgcttaa

SEQ ID NO: 3714 - DNA, 1887 bp, Cryptosporidium hominis
atggacatatatatatctaatgataattctgagcttaattgtaatgttctaccggactgtacatacagtttgtgctacgtaaacttagctctaaattctcaaaaatttgggagaaaggggaaatttaaatctaaaagttttgagttctttgttaccttatacaaaaagaatttattaactaacgaggaattacaaataggaagttgcagaatattaccttcgaattattgcacgccattcgaaaggaattattgtacagtttattttaattttttttcaatagatgaattaaaagaatttttggaaaagaacgaaataattgtaatattgaagttaggttttggcattaatcattttgaggtgttgtttgacgaaacgataaattacttcatcaaaccggtaacaagcattaagaatgagttatttttatcaaacaaaaataacgatttcgaagtcacttttattgttaatgtcgagtggtttgcaacaattcctaagatcattaaaaacaatattgaaaaccccgaaaagctagacaaagatattcctatctcttcgagcttaaagattgagaataaaatccttaatattaatataattgataatcctaatataagtttgatatatgaaaaaacaatttgcaatgacccaattatatcgaaaaagatagtttgttcgcaacctataacgaaagcactaagtaaacatactatttacaagtcaacaaatattaagaacaatttttttgcaccaagtattcactctttgaacaatataggcaattggactgtgaaaattaaaaatattatattgactgaaaatgggttcacttttcttcatgataagttcccgaaatacaaacaatcaaaaagttacaaggttattgtccagtattgcattaaaaatgaagatggaaaaactataacacaaactagaaagcattggagtataatgagttttttaaagaattgcaataatttttctattgataatagaattccaagaaaaccttactacattgcaaaagcaaatatttattctagaattcctgaaaatatcactgataaaatagaggaaaaatactttcatattagtttttcgattccaaattcactttttttatatgaatcaaaaattgataaaggaaatgctattttttatggcatattgcatccaaatgaaatttctttaactaaagaatctttggtcaaactttattcagagtttcataaaaagaaatgtttaggttatgcattaatatcattctcagatataaaagaaaaacctcatgatagtataaaccttcattataaaatcgatcgaattatcgaaataaagaatgattcaaataagaaacaatgtaaggcgggttatttagaaggaatgagtattatttatctgtatatatactggcacattcaatttcgggcaaaaaatgaaaggaaaacacctgaaagtattttagtagagttttattcaaagatttcaagttcaaaaactattgaaggaggagtaaacgtaacaggaatgaacaagtgtgttagcgcattaatacactctaatactgaattaactcatagtttgatgagctacacaagttgtatccctgaaaacctcacatggtttaacaatgtttatgaattgaggtattatttactgttcccccatcttgaaacatttgaaaactcttgcaatgatattttttcaaataacaattcaatagttttcaacgaatacgaatttgcctataaatgtaatgagttgggcataagagaatgcatctcaattacttggatagaaatgatgaaatcatcctttgcaaatatttctttgaaagcttatagatcgtgtttgcagctctataaggttgaaaatatattcttgtaa

SEQ ID NO: 3715 - DNA, 981 bp, Cryptosporidium hominis
atggattttattaaaaaaagtttaagtgcactttcaaccgactctatcaaaaaacacaacagtgagcatatattttattgtattcaatatgtaaatcgatttggggaatatcatgaaccagagcaattcaatttggttcaaagcgaagataagataaattttagaagcattacacttaaacgaataaaagaaataattcctaaatataagttttgttgttgctattcaaaaaattgtctctgcgacttctctgtaaggtataaaagtcatgatagcaacggtatttatccatgggtttggtgcgacttagttactgaccaagacactgcaaccccatataactctaaaatcattctaaaaatactagtttttgttaatttctcatcatcaaattatgatggtattcatacagaatctgttaattcaaattatgaagcaagaactgtgaatatgtgtatgccttacgaaactgatgaaaaagaatatgttgatagatctaactctaaaattcaaaacaatatatttcaagcgcctacccctactaaatttgacaattcggatgactccaactttattaatatagtaaatgatgaacaaacaaaatttttaagcaataaaaaatcatttacctcgcaaaaagtcctagaatcaaaaattttggaatcaagtaataatgaaaagagtgacaactttggctacgaagatcttgttgaagaaattagtagatggtctagaaaacctgacggctcatacaaagatattcgcgttttactaagctcacttcagcaggtattatgggaaaatgcccaatgggaacctattgaattctccaaactaatgtcagatatagagctagtaaagaaggcatataggaaggccataatactttgccaccccgataaaaatcacaatgaaagtgaaaagcacaaaagcagagctcaccttattttcatggcaatcaatgagtccaataacaaataa

SEQ ID NO: 3716 - DNA, 657 bp, Cryptosporidium hominis
atgagtgggaaagttagtagcgaaactattcgtcgtgcaatttctgagattttagaaggctcaaaggctaagccaaggaaatttgttgagactgttgaattgcaaattgggctaaaggattacgatactcagagagacaagcgttttgctggtacagtgcgtttaccaaatgtcccaagaccaaatgctcgtgtatgtgtaatgggagatgctgctgattgtgaaagagcacagaaactgggcttcgatgtaatggatattgaagagatgaagaagatcaacaaaaacaagaaggttgtcaagaaactttgcaagaagtacgatttgtttttggcatctcaggtactattaccacagataccacgtctattaggtccaggattaaataaagcaggtaaattcccaactgttatcaccccaagcgacaaaattgacgagaaggcgaatgaattaaaggcaagtatcaagttccaattgaagaaggtgttgtgccttggtgtggcgattggtaacgttaacatgacggaggaagagattagacaaaacctaactttagcaattaacttcttagtatcactattgaagaagaattggcacaacatcaagagtctaacagtaaagagtacaatgggaaaatctgtaaggatctatggatga

SEQ ID NO: 3717 - DNA, 477 bp, Cryptosporidium hominis
atgtgtcaaaaccgcatctctgaacaaaaatattcgaggaaaaaggtcgtttcaaaaaaagatgcaactaaaaatttgagcattcttaataagaagatagatgcaactgtgaaaaaactcgactcatccaaatttggcgacagtaaatatgacgattttggaagattaagtaaacgcgctttcaagtttcaaagaaaatgcgaaacaagggactcaataatgaataagcatgagaagagagacttggagcatgaaaacatcattagttcagagaaatgtgaagtagaaagcaatagccctttatccgagtcggaggtcattaaagaaatgtttggtattgagcgattcgaaacatcaaaaaataaaaaccactcaacatctagcctttcttgctttagtattaaatcaaaaaggaagtacagacaatatatgaatagaccaggtggtttcaataggcccctttctcctactcagtaa

SEQ ID NO: 3718 - DNA, 525 bp, Cryptosporidium hominis
atgaaaattaagacaagagaagtcatcaaagaaatacaaacaattgagtactgtaaaagctgtggactacctactgattattgtgagtatggccaatgtacgaaaaataaaatattaggacacaacgaagtttcagaagcaaataaactggattcacagttaaatacttctcttaaaattgacgaaactcagatatcccaaggaaacgctcaaaaaaaatatgaagaatcaaattcagcaaagaaaaaaaagaccaaacaaaacgtaatcacgattaaagtagagagtagagctaggagaaagaatgtaacggtagttaatgggctggaactatttgatattcagctcaatgaggcggcaaagaagtttgcaaaacagttttcttgcggtgcttctgtagttaagggaaccagtggaaagcccgatcacatagatgtacaaggtgatttcgacattacaattgcggaattcattttgaaaatttacccaaatattgagccaagtaatatcgttatacaaacataa

SEQ ID NO: 3719 - DNA, 1167 bp, Cryptosporidium hominis
atgaagcagttcgatgcattttcaaagccaatatctgagttccgtataaaaactgcatttggaggatacttaacaatattgagcataatcgccatgatcatactgttttattctgaattaaaatattacttaaacataactagaaaggatgaagttactgttgatcatttgtcttctaatagaaatattaaccttaggatgcagttggaattcccaaaactcccgtgcgatatattgggggtacgaataattaatcttcaggaaaataaagaaatatatttaccagatggaggaatagagttcgttaagatcggttcaaatgaaagtaatgcaaatagttcttctggatgtggtccttgctatgacgcatctattaacaatgatttgggagtagttaattgttgtaatacatgcaaagatgtttttaatgaatacgataaaaaaggaattaagttacctcatgtaataagtttcaaacaatgtgattatgataaatcgaagaggatttcaaatgcattgtcttctaacttaaattcagaagggtgcaagattaaagtaaatggatacatcccaaaagttaagggtaaaattgagatttctcacaaaagatgggttaaatataaggaaatgacagatcttgagattgcagaaagccacttatttaacttttcatataaaatgaattatctagattttggtgaagagctccctggaattccaaacagatggaaaaatcaggagtacattcaaagttctagatttgaaaaattgggatattcacaagacttggtttttgatgatgcttatattgatttcgatatgcattgtatacctacacaatacaatactataaataataagtcgattaattcgcaccaattttcagtcagaagtcaatataaaaaagttcttgtttccttagctaatggcaaatttattcccgacacttcaatacccggaatacatatcaattatgattttactccgttccttgtaaaaatgactgaaagtcgcagatcgtttttgtcgtttattacggaatgttgtgccataattggaggaatttttgcattttctggaatgattgatatatttttctttaaatttttatctagtgtaaacaagtatagacaaaaaaacaatacatcatttattcaaaattactaa

SEQ ID NO: 3720 - DNA, 4110 bp, Cryptosporidium hominis
atgttgcagccaactactgaatatagcatacgcatcgatattcatgaacttagggatttgaaattcaacgatggaacaagtaatataactccaagcccatatattgaaatcaaagtatgcgatcaaataagaacaacgcccaaacaaacggctgtttcatcagcattggttcaagcatcatataattttacagagactctcaacaaatgcgattttgattgttctattattgaaattaacgttatgcatgcatatgtcctttctagtgctcctataggctcatatgttctcagttttaactatgtatatagtaaatcgcagcattggatctacagaaattgggtaccattgatattaggagataagccttctgaaattatgggttttgcacttattactgttgggatttttgcgccaggagactcaatccctgcagttgatgacaacagcaatattttaagtaatgatggcgatcaaggtacaagaatttcatcttcaccagaaataaatttaacccagtataaccttaatgtatgcatatttaaaggacaagacattgctccaattgtagggatgtataataccttagaaccttttgttactgtaaggcatggaatttcaaaaatttcaacagtctgtatcaagaatgaatctaacccaatttggaaatcatcgattaatttgcctgcatattttccatgctcagactcgaatttattgtttgaactttggaacggtgagtcgaagccgactttaataggaaaatttaaactggatgtttttaatatttttaaagagccttttcctatatcttgggtaaatttatattggactcagcctccatatggtggagcagcagaacttttttcgtcttcaaatacctcagtaacatcatatatccctagttcctatgccggtagattgttaatttctgctagctcacaaaagactcaagcctgttcaataaagtcaatacaatctataccactttcaaatgagccaccaatgacgcgctacttactttggattgatatttatgagatttcatgtagacctgcatttgatggcgaggtcatattggaattttgtatagggcctcactctgcgacaactattgcaatgccacagagcggtgaatcaattatattcgatgaacaaacagggaggattgatgaaacatatttttatttatcggatgggcaggatccttgggacctatttatttattctcaaaccggctcaggagcaacattttggtcttcaccttcatttacgagagcatcattcactagggttttgctctctgaagtttccaacgactctaacgggaacccaaattggtatacattgaagccaattttcgacataagtgctggatatacattcaatgtgcttgcaagcatagtcattctccctgcgaatacggcgtcagaacgccccgatcgattggtttatacgcttcagaactattattttaggtcgttcatctatgaaggaatgaacttgaggggagttgggtcatcattaccaaacccatatgttaaagtgtctattggggaccaaacaattcaatctcgtactatagaatcgtctatagccccacaatggtacgaagcatatgaagttcagatttcactgccaacaaatttatcattaggatcagatattttgattgaaacctttagcaagagccatggttatttaagttctgattctagaataggatttacatcttataagcttacgcagattcccaaggtatggaagtcttcgccaatatggcttcatctcaaaccttcagatacaaaaaatccacaagaagatacaaatgcaaggatattgtgttcttttgagttgatatctgttgatgaagttaaacagtatccattttatgatgatattcggccaacaacattccccgctgacgtacgattatttgtcataggagttcgtatgtttagatctcttaatagtccaaccgtatccgtgtcttatggccgtgaggttgaagaatctaacgcacccctttggcatgattcaaccccatctccaaattgtggtgatgaagggaattggaactatttacatgattttgcgataactgctgaactacctaaaagagatgtatttcagtcttatttcgagattactgttaatgaaaaagtttctggatattcaggtgaatctagtatatcttcagggttcgcgatactttatttcaactcagcaataccatggtatgacgaaaattcaagaaagtttaataaagaattttttcatttaactactttggatgaattaattaacggatcaattgaatgcgaaaatgataatcagatcaatattgcagggcttgatcaagaagaagatgatgatgatgaagactcttctggaaatgatcaaagagttcttaatacgatgaaatcaatatctgcgcctacaaatatagtttcaaaatcaagccctacatacgatgcagaagcatcaaattcatttttttaccctgccattgatctaatgaaaactgagaaaaaagatgagagtgtttatattgacgtaagttttaattctaaagatgatgaccaagcaaatcttgctctaaaactgaaagaggttggaacactttttggtttcgatgcaaggctcttgaacttcgatttgaaaatattttctgaagaagatgaaactgagcaaaggtttgagattccatacgaattagagcaagatctagatcctgcagagctgccttatcagacacttccaattgtatctataaacgaaaaaggattgtattatattgttgggtatataaaatatacactgtgtattatacaacagccagacagtgatactaacgttattgtggatacaaaagaacaagaagaggttcttcagacattttcagacaatagaatgtggattgcaaatcaatacaataacataaaacctattgttgcaaggtgctacatactttctgcgagaggccttcttccaccaagtggagatttaaacccatctgtatatatattcattcgctcgagagaaagtaatggggatggtattatggttgatggaagcggaaaaaaaaaaaagagtgtttatccgaataatatcaaagatacagggtttgttaggcaccaaggctataaacccgagtttaatcaggtatatgagataggttgtattcttcctcacaatgcattagtaagagtttccttaattggcacaggaacaatgtctgaagaaataattggaagcacttttattgatattgaagaccgttggttccatccgaaaattcaatcaatgttggaaagtgactcgacccctatagaaatgagaaccctaagggtagaaaatagttttgtatctcatggaacattaagggcctggtatgaaataatgtcagaacaagttgcaaaagctacgccaattactgaactagcttcggttgatcctcaaagttaccaacttagagtcgtgatttggcgtgtaaggcatattccattagaacctaatactacaatatcattatatgttagtggaatatatagtttagatgaatctaattctgatactcagtctacggagactcattataattctaaggatgggacaggaatttttaactggaggtttgtatttgatattaagataccaactcaatatccaatccttaaacttcaactatggtcctatggtttaattcagagtgataacattggcgagtgctcaattgacttaagcaatgactttggaagagcaaaaaaacattcagctcaagtcacaaaaattcctaaaacctggtttggattttcacatccgacggaacaaaattcacctcaagggcaagtagaaatcgagatatctattgtcccagcaaaaatatcggactctaacccagtgggaaaaggaagagagcccccaaacgttgacccagttttggaagatgttacggaaaacagaacatatgttgattggaaaggaattggagaagctatttcatccgcaacttcatctatatggagctctgcaaaaaaaggattcattattgcaatgataattggcgtaattgcgctaatattatttttaatgattatgcttaaataa

SEQ ID NO: 3721 - DNA, 549 bp, Cryptosporidium hominis
atgtggattgcaaatcaatacaataacataaaacctattgttgcaaggtgctacatactttctgcgagaggccttcttccaccaagtggagatttaaacccatctgtatatatattcattcgctcgagagaaagtaatggggatggtattatggttgatggaagcggaaaaaaaaaaaagagtgtttatccgaataatatcaaagatacagggtttgttaggcaccaaggctataaacccgagtttaatcaggtatatgagataggttgtattcttcctcacaatgcattagtaagagtttccttaattggcacaggaacaatgtctgaagaaataattggaagcacttttattgatattgaagaccgttggttccatccgaaaattcaatcaatgttggaaagtgactcgacccctatagaaatgagaaccctaagggtagaaaatagttttgtatctcatggaacattaagggcctggtatgaaataatgtcagaacaagttgcaaaagctacgccaattaaggaaactcttactaatgcattgtga

SEQ ID NO: 3722 - DNA, 1362 bp, Cryptosporidium hominis
atgcgtatgggaacaaatagtattttcccaaaagtgaaagatataggtgaatggcaaaaattatgttcatacaattttcatgatcaagaagaatataagttagaatggtggctaggaattatagaaaaattgtgcgacaaaaataaatccttgttgattgaaattaactcgcttaaagccattgctcaagaagagtttaaattctggcccattgaagttctttctttaccaaatatttttaagggactgataaaaagaaaaaaattagtgaatttgaattttatcaataaatatatggtaaagatatggcagaatgctgttgaagtagaaaaaagtcaatctagatcaaaagtatcaagaattggatttgcctgggttcgctcaataattgggactttttttaacgatacatatatattagaaaccgatgaaagcaccccagaattagatacatttgtatgcattcctttattggacaagttatcaagtaaattagttaatgatataaatagaggattattaggtagcatttcaaaatcaatgggaatagatgaacttcttatattaaatactaaatttaatgattatttagtgcaaaattatgatttatgtgaaactgcgaaaaacgtgctatatgatatgatgatctggtattttattacttattcacctggagaatggagcttgaaaccatttgtcgttcacaaaggtaataataatcatgtcaatgccattaaatttagtaggtcgtactccttagtagcaaagaaagaaattgaaataaatgatacagacatcgcagatattatacttaaaattaccgaagaagatttacaaaagtcattaacaaatttagaaaagaaatttttatttcatgactcgaagtgcaaagaatatgctttatgcgaccaaaaacaactagcaataaaccatttgaagcaaagacatcaaattgaaaaagcactaaatgatgttaatgaacaactacttttattgagtcaatcaagagtcactctagatacctctaatgcgaggatttctcttgtaaacgcacttgaaacctctactaatataaccaaggatattttcaatgaaagcgaaattttgaaaaaattggaaaatattaatataatgagagaagaagttgaggttacgcaagaatccataaattcaatgataaagtcatgtgtaaaagacgcttcaaaaaatttggaggctacatcttatgatttagagagggagctggaagaaatcctacataaagccgacatttctattcctaaaattgaacaaaattgtaaatttaaagagccgtcaagcgaattcgaggcggaaaaacatcaagtgactaacactgtctga

SEQ ID NO: 3723 - DNA, 2499 bp, Cryptosporidium hominis
atggttaattttacagttgagcaaattcgtgagattatgggaaagccccataacatccgtaatatgtctgttattgctcacgtcgatcatggcaaatcaacattgaccgactctcttgtatgcaaagcaggcattattgcttcaaaggcagcaggagatgcacgtttcaccgatacccgtgccgatgaacaagagcgttgcattaccatcaaatctaccggaatttcacttttcttcgaacatgatttagaagatggtaaaggcaagcaaccttttttaatcaacttaattgattcaccggggcacgtagacttttcttcagaagttactgcagctcttcgtgtaacagacggtgcgcttgtagtcgttgatgctgtagatggcgtatgtatccagacagaaactgtccttagacaagcattaaatgagagaattagacctgtgcttcatgtgaacaaggtagacagagctttattagagttacagtgggaggcagaagatatttatcagaactttactcgtgttattgagaacgttaatgttattatttctacctattctgatgaattgatgggcgatgttcaagtatttccagaaaagggtacagtttcatttggttcaggacttcatggatgggcatttactatcgaaaagtttgctcgcatttatgcaaaaaaattcggtgttgaaaaatcaaaaatgatgcaaaggttgtggggagacaacttctttaacccagaaacaaagaagtttacaaagactcaagaaccaggaagtaaaagagcattctgccaatttattatggagccgatatgtcaactattttcctcaattatgaatggtgataaagctaaatatgagaagatgttggttaatttgggtgtagagcttaagggtgatgataaggctttagttgacaagcctctattaaagaaagtcatgcagttgtggttaagcgctggtgatactttattggaaatgattgtaacacacctaccatctcccgctgcagcccaaaagtaccgtgttgagaacttgtacgagggtcctcaagatgatgaaactgcaaagggtattagaaattgcgacccagacgctcctctatgtatgtttgtttcaaaaatggttcccactagtgacaagggtcgattttatgcatttggccgtgtcttttctggcacagttgcaactgggcaaaaggttcgcattcagggtccaagatatgttcccggtggaaaggaggacttgaatattaaaaatatccaacgcacagttcttatgatggggcgttatgttgagcaaattccagatgtacctgcggggaatacagttggtttggtcggaattgatcaatatttgctcaagtcgggtacaatcacaacttctgaaactgcgcataatattgcatctatgaagtactccgtatcacctgttgttcgtgttgcagtacgaccaaaggataacaaagaattgccgaaacttgttgaaggtcttaagaagttgtctaagtctgatccattagttgtatgcagtaaagaggaaacaggcgaacatattatcgcaggatgtggtgagttacatgttgaaatttgcttacaagatctccaacaggaatatgcacaaattgagattgttgcatctgacccaattgtttcctacagagaaactgtagtcaatttatcaaaccaaacgtgcttgtctaaatctccgaataaacataacagattgtacatgactgcagagcctttacctgatggattgactgatgatattgaagaaggaaaagtatcaccaagggatgaccctaaagagagatcaaatctcttgcatgacaagtatgggtttgacaagaacgctgctatgaaaatctggtgtttcggccctgaaacaaccggtccaaatattatggttgacgtaactactggtatccagtatttgactgaaatcaaagaccactgtaactctgcattccaatgggcaactaaggagggaattttatgtgaagaagatatgaggggaattcgctttaatttgctcgatgtaacattacatgctgacgcaatccatcgtggagcaggtcaaattactccaacatgccgacgtgtaatgtatgctgctgcattaactgcttcacccagactgttggagcctatgttcttggttgagatttctgctccacaggaagttgttggtggaatctatgctactctcaatcaaaggagaggtcatgtattccacgaggaacccaagtctggcacacctcaagtcgagatcaaggcatacttaccggttgctgactctttcaagttcaccactgttctccgtgctgcaacatctggtaaagcgttcccacaatgtgtatttgatcactgggagttgattaacggcgacccacttgagaaagggagcaagacagaagagcttgtaaaggcaattagaagaagaaagaatatcaaggaagaaattcctgctcttgataattacttagataagctttaa

SEQ ID NO: 3724 - DNA, 633 bp, Cryptosporidium hominis
atgatgacagctgatgcccaatcagcattaaggagaataattgaagtttcctcgaaaaacaccagatttgttattatttgtaactacattagtaaaataatcgagcctttggctagcagatgcgcaaagtttagatttcaaccaatttcggcaaattctcagatagaaagactgaagtatatatgctctcaggaagatgtttcatacgaagacggtgtattagaaactattgttaatttatctcagggagacctaagaagaggaataaatattcttcaatcagcctctgaactatttggtaaggataaaagaattagcatgagctctatcttagatgtttcgggtgcaccacctataaaaattattgaaagaattataaattcatgcaaaattctaggtgcagaaagtatattgatagaaaccgcgaaacttatcaacgaaggatggagcgtagaactgattttcaaaggtctggcagaatttatcattatgagtgataagatcgatgattcaaaaaaagcatttttaatgttgagaatttctgaggcagacgcaagtgtgatagatggatcaaacgaatacttaactttgctaaatgtttgttcaagtgttcaaactatttttgcgaattaa

SEQ ID NO: 3725 - DNA, 285 bp, Cryptosporidium hominis
atggaatttaccaggattcaagctcaacatttctatttgtattctccactgccattaatttttgaagctaaccataataatattttgacattaattgcatctcatggggtaggaatatctagaatttcaatagattctagaagagagtcaactgcaatttttttaacaggaattttgtattttttaaatgcattaattagagagtatatcgtttacttgagatctaaaatgcaagcattacttcaggcttgctattatattcaatattacctgttggaatattaa

SEQ ID NO: 3726 - DNA, 444 bp, Cryptosporidium hominis
atgaatactgattattctccgtttgcaataagaataattttttgtttggtctacttctttatatacgggcgttttgtgtattctttttcttttgatggattaagaatacctccccctaaatcaattctaatacatccacatcaattttttatctttgaaaacgatgatacatattataatttattagtttcaaaacctacaaaatattcaacgatttattttgataacttaaagttaaagtcaagcgatggaattatactggatgatgaaagtatagaaattattgttgttccgagcaaagaattggagaatcttatcaggaatgatcagttgggcgtatgctgtaataaagaaaacttattatctggaaattgccagaatgagaatacatttattaaaccgaatatcaatggggttaattatctttggtactcagctaagtaa

SEQ ID NO: 3727 - DNA, 903 bp, Cryptosporidium hominis
atgacaaataacccagatgagcttgctgatggtgagactcgcatttgtagtgattatattcctccatttaagaaaaagaactttgaagtatctcacaatcttttaaataatcgtgaacatcaaaaaaaactatgggatagactagagaaaaacataaggggggagatcaataagttgaatttttcaaatattgagcaagttttaattaatattttgaagaataatatcattcgtggtagaggaatattagctaattgtataattagagctcagttatctagtcattcatatactgctgttatttgttatctttctgcaataattaattgtaatattcctgactttggctcattgcttttgagaaggctcataaatcaattcagaatatcatactctaaaggagataaatatgtttgtaaacatactttattgtttttagctcaattaatcaaccaaaaagtagttcacgaactaattgccttgcaaatatgcctttttttaattgagaaattaactgacgattcaattgagatatgtattgatttcatttttgaatgtggccagttcctgttagaaaatacgcctcaagggctgaatacaatcatgaataagttcagaagaatactacaagagggtagattgaataaaaaaacaaattttttaatagaacgcattctaaaggaaaggcgagacaatttcatgaactatccaataaataactcagaaaatgagctaattgacttaaatgaccaaattactcattttttcgatattttagatggagaaattcccatacaagatgaattagatcacttattgaaaccgaacccaatatttttgaagaagaaaacacaaaatgggatgaaatttcaaaagaattgctttctggactatatggtgtaa

SEQ ID NO: 3728 - DNA, 855 bp, Cryptosporidium hominis
atgaacagcttaaattatgaggagtgcacgcatagactgttaaagttaaatattccaaaagatcaaataagtgagacttgtgcaatgatactagattgttgttcaatggagcgaacatatcaaaaatttttttctttggttgctgaaagactttgcattattaagaaggaatatcaagaatcttttgcgaaactattttctgaaaactttgaaactgtccatcgcttagaaacgaataggttgagacatgtaactaagttttattcatatttacttagtaaagatgcaataccttggaatttactatttattgttaagttatccgagaaagacactgcatcctcttcgcgtatttttattaaaatcctttttcaagagctttcctataatatgggaattaaaaatttagatataaagcttaattcctctgaagttttaccctttacagaaggcattttcccaaaagaaaatatttccaaaataagattttcaataaactttttcactgctattggacttggtgcactaacgcacaaacttagaaatactctgagtaatattgaacagcagcaaacaagtaggttgaatgagctatgtttaagctctgggattgacactatacaagttgatatctcaaactcagaaaaaatatctgaagatgcagaaattataaacacaaaatgcttggatacttacaaaaataaaatggaacaaaccaaaatgaattcaaattattataaacaatcaaaagaatattccagttcttgtttagaagatttaagtaataacttaatatttaacaacggtataaataatcaaaaaagaagaaatcgcagtttttcaagagaactttaa

SEQ ID NO: 3729 - DNA, 1287 bp, Cryptosporidium hominis
atgaataacaaagaaacaagcacaattccgtcaccaaagactattgctagcaaaatatccagcgaattaagtgaaatttactcaccaaaaatgtcaacattggtaaggaacaacattccatgtagactaacgagtaaccgagttatggccccttctaaatcaacatatagagttatacttccagtccgtgatattggggatctatcagttatcacgtatgaacatgaagtttatgtgggcaatggtggatctcttagattctttttattaggaaaacaagtcaggcaccgttttattaatgtccatttagatgaagaaagtccaataccttcttatatcgatcccaataaagtcccattaggagatcttccggttgtaaagctgggggatctagttatttttgatgaaattccttgcttaagatatttagcaaagaagcttggagaatatgggagaaattactatattgatttcgtaattgatgacgtgatttttcgttgttcaaagtggagagatattttaatggaattaatttcaaaaagtcataaagaattcttaatcaacgatataaatgcgaaaaaagaattagaaagatcgatttctaactacaaattgttgagagaacaactttattgcgaatttgaaactttaatttcaacaattggtgataaagggccttttatcgcagaaaaaaacaagccaatgatttgcgattttattttattttcaattttattcgatgatatttctctgattgaatttaatgaaggagagaagtttaataggacgtctttgttaccagaagagtcattaattcataagttcccaagattaaaaatgctttttgaatctgttgctgtgcttccattaatagatcagtgggtaaaaggtaaatatttttctatacaaatagaaggtgaaagcggtgagctagtaactcctcctgcttctctatctactcaagatcatgttaaaaattctgttttaggatcgaactcatttaatgtgtatcagcattcatttggatatcaacctccagtacttcaacaattaccgaatcagatttttactcatgtaaacgcaggagtgcgatttttcccacaaaaaatgtcattgccgataaacccaatttttcctacaaataatagctttatttcccaacctattacaaacaattatcaccactttttgaatagccaggttcaaggccatagatatttaggaggggtttcatccccttttatgcagagggtgagcccttctcaaagttttaaactcgagttttga

SEQ ID NO: 3730 - DNA, 435 bp, Cryptosporidium hominis
atgaagtctatcttagatgagggcgatgtgatttgtacagaggtgcagcgagtccaaagtgaaggtatttgccatcttcacactagaagtgcaaagtatggaaagctggcaaatggaatggtcgtaaaagtacctaataaactaatacaaaggcaagctcaacacattgtcaagcttaaatatggaatacaacttattctaggactaaatggctatgtttggatatctcttccatttgagcattcgcatactgatactcttaactactcctcttcatctgtaaaaccagaaattgtgaactcaaatatcaggaaatcaattgtgatgttggcatttattatcaaactttttggtttaaaaaatatgcaaataactcctgagcgaatttgtaaagtattcgatcgctttactgaattacatttatcatataagtaa

SEQ ID NO: 3731 - DNA, 2256 bp, Cryptosporidium hominis
atgaagataaatattatagaatgggaaggtaggtttacagattcagttgtaacaggattatttagacgtcaaatacaaaaatcaattttcttggccttaaattttatagatcataatttatatatatacaacgataaggatgaactagtacgtgaaaaaacggtcattcctggagacaaaattcaaactgagccgaattacataaggtaaatgaagtttgcagacaagattgagtcacttgaatcaacaaaatggggcggaagatttattaattatcggagccttatacaaactttaaaccaatgccactcgaattttttgaattcaattgggaaagaatctaatttagctgcgttaaaagaacaagcaaatcacattgatgtttcgtataggccacttaataaagatgtatctggacactttgttttgaagttagagcagtttcatctatcattaagacataatatagatgttgttatattgagttataataagatattgaaagataatagtgatcatctagaatgtatttctactttacttgatgataaatcagcgcaaataagctctaaactacatttgccaaacctgattttggatatttggaaaacatttgatgatttacaggaatatgttctaataaataaactagctgttttgaaacttttgatgagacgcgatgaattatttgatttttatttagaaaatttaccaagcagtgaatcattcacttcttgctttgataagcttgaagatggttcagtttcacgagagaagttaattgaattattttccagatcaaaggatctcatagaaaattcacctaattatgattcaactaagtataactctcaaaaagatcaatcaagcacaaatattgtttttaataagattaaaactcagggattcgacgttttatataagtcttcagtttttgagcttgaagcactgatggaatatgggttgaagtcaggaaaaacaatcggtaaatccttatttaatccagattttaaaatgtcatttttaattggcatttgtgttgtcctgcttgttaatctatttgttatatgccgtcttccggtggtgaatagcgagtacagcatacaaggaacactggcgatatttccgttattcagacttgtattgatgggtattttcgtattatggggttctggtatttccatttgcattatggagtattatggcgtgaattataagtatatgattggaatggatcctaacagcagagttgctacgactacgatattctcttttgccgcattacaaactatagtttggattattattttcactttatttattacagattatcgtttgggaatttctctgttcagctatttcaatatagaatattatccgctatgggtttatcctgccttattaatgactattgagttttcccttttattcattccaagtaaaacattcacttacgagtacagaaaagccatattttactcgatgctggaagtctttagtcatgggattataccaaaagttgtaaatgttactcttagagctaatattgttggtgatatttttacaacactttcaaaaccatttggcgacgtagaatacaccattacgttttttgtatttgtaattaagaataagggtgatgtactcccaacttctctatttaacttcttatctaattatagatggatgcagactattgcattggctctcccttatgagatacggtttttccaatgtggtatgagatacttgactgatgaatcacccagtagaagaaaccatctctttaatatgggtaagtacacaactggtttggcaattgcaatagtcgctaccgtcccttggacaactgtaacatcgatgtcgcccttcatagctagacttttatggtttgtctgctatatcacaggtacaatttatatgtttatttgggacatttatatggactggggactaatgaaagaaaggtcttcgtttcttcgctctaaatctatttatcctagttggtactacttcttggttgcattttataacttgattggtcgtttaacctgggcgattactctaatccccatcacaattatcgatgacatacaaatcaatgccgcattaattaatttgtttgtggcaacaatagaagtttttagaagaacgctttggtgtacaataagacttgagtgggagcaagtgcatttaaactcaaaacagcctgcaaacttgtgggtaagctcaaataaaaacaaattatcatattag

SEQ ID NO: 3732 - DNA, 3807 bp, Cryptosporidium hominis
atgcttactaaagaattagattgcaacatcttattgcagcggaataatctttgtgagaaaggttggagagttgggcaaatcaagagagtaataataaatgatataggaggacacgaatttattgatattagtctacttcctggggttaatttaataacaggcggaaatggaagtggcaaaagcagcttagtttctgcaattgctctcctatgcggttggagcggtagaaaggctggtaaggacgcaaatttgaataaatatgttagaataggtgcaaataagggtactgtctgcatacactttgcaaataatgataacgaatttcaaagaggatatttgaatgatatttatggggaagaaataattattgaacgcattatttatttgaagggcaattcgaattatacttttagaggctctaaatctagttctccaattcacagatcttttaatgcaaaacaccacttgtctcaatttcgtgcttatgcaaacataatcattaataaccctgtaacgtttttaacacaaatggatgcaaaatatcttattcgtgagcaaaactcaccaaaatctttatacgattttttccaaagagcgcatttatttgattactcatggaaacatttggctgaagaacaacgtcgcattgaaaaagcagaaattatttccaaatcgttaaataatgacttgaaacaattagaaagtgaactggaagaatttaatagtatgaaagagctaattcagacatataataaattgcaaatacatcggagaaatcttgaaagtataaatattgtggcatccataaaaaatttgagcttatcaataaattctcttctttttcagtctgaagagctttataaagccaagtcagcattagatattgaggagctaaataaaagaataatcgaaagtgaaagagaaatctatgattctcaatctgaaataaataattttcattcagaacatgaagtcaatattaataagcataaaaggctaacaattgaactggaacaaatatgtgataaatttaattcatataataaacaaattgaagaaataaaaggcgaaatttcaagcttagaaaaagaaattgaatttaaacaagagaattatgactcaaatcaagaaaaaaaaaaattccattttaaaggagaattattagaaaaaattaaagcttcaaaagaaaaaattaatattctgaggtctaaaaaagaaaatttaattttactctcactaaataaaaaaaatgaactatcaacattatttgaacaaattaaagaaaataaggccaaaattaatttattttctgatgagaagctatcatttaatctcaagttagatgaaatcaagaatattttggaaacagataggaaatctcttaaatatgattctgatttagaacaatcaaataaatctaattctacagaaacaggatatattgcaaatcataactccaagattaacgactccaaaggtaaagaaagtttggcagttatgtattctagattgtatgattactttacagacgaggacttcgaaattatatttggttattcaaaatttatacataataaaattattaaacaactcgaaaaaattgaaaaaggagtgaaaataattggtccaattgctcttcatatttttcccaaatctgaattctattataacgaaaaaatattaagtatacttgatgaaattataggtggaaggttcgagaggtacgatactatatctggctacaaaattagaagaaattataaatattggctagttgaaaattcagaaacaaggaaagaattgatttcattgtttaaaaataacaatgttttcttagacccttcattaatttatataaggtcttcattcaatcaaaaatatgaactatctgctgttcgtaaaaaattcccaaaagtaggattagccgtaattgatttaatacacgttgaaaatgatgaagtttttaattttctaatagataacttccaaatagaaacaacttttatcttcgtgaatgaccaagaaatggatttgatatatgattacagtcttaatattagaagggcacattgtctagctaattattcgtttaaatatcgaagaggtggaatagtagttgccccagaaatttgtatccctaagcaacatgtaacatcaaaaattgttattagaaaattaaatgggatttttcaattaagaaattatggatctgatttacgtgttgatcaaaaaaaagaaaaaaaatgtaactttccagaaaaaatcgaaatgaaacggctattagaattgaatataatggagaatgagaataaaaagaaggaaattattaaaaaaattatagaaatcgaggaaaaaaataatgatttaaaactttcaataacaaatcatgataataaagcctcctatattcgtaatgaaatatctggcttcgagactgaattggaagatattactaaagaagagcaaataattaacatgaaaattgtagagttagaaacagagcttcggaaacttgatagggatgaaaaacacattttcaatgtaaatatttctgagattaatcatttatctacgaagttaagtgaacttaatcaacttcttactgtaattaaagaaaaaattagttgtgaggaaaaattaatgaaaaataaagaagctgatgtagaaaaattaaaaattatcctcgataatgaaaaggagttgatcaagttaaaagaacagaaacataaaattttgaaaactaataaaaattctttacttaacgaaaaaccccaaatcgaagtagaaataaatcagataactagcaaaataaatcagttaaatactgaaattgatttaaaaaaaaatgagttgaaaggcttgaaaaataaatatcgaacgattaataccaaattttgcgccgctgatgaatctgaaattggaactgacttcctgattaccaatgatctattgtctacactcgaatactttaattggtatttaaatttgtcgggagacattgaaccctttccagattgctcaaccatagaactttggaaatcaaacatatctagacaaatggatactatttttttagaaattatggaaaaatcaaaaattttcgggttcaatgctacccagagaaattgttcagaagacttaattaacaaaatactggacactataaatataaagtatgaaaagtacaaggagaaaataaatgaattacaagaagaaaataagcttttaaatcagaacagaacgaatctaaatagaagggtccaacgattacaaaaagatcatattcgctgcggaaaaaatgtaaatttacaattcaagcattacttttctattttttggtcaaaaacaatgcgccctcatctcaagttcgaccatgataagtcgatcttgactatctatgttattcctgatactgctactgtgaaaaaacctaaacagactgaaagtcatttatcttctgaaagaaattctacatcttgcaaagatcaactcaacaattttgtgagtagggaaattcaatctctaagtggtggagagagtagtagtattggtatatcgcttctattagcgttatcccaaaacaacttttcaccgtttcacctcttcgatgaaccagatgtatatatggatgacatccggagaatgacgatgattcggtcattaatagaattcgaacgtttgtgttcaaaaggaaaaatagcttttaataggcaagttttatttattacaccccatagtgaaatcgtaccacatattaaagagaattatgccgatataattcatgttatacaactaattaaaagatag

SEQ ID NO: 3733 - DNA, 903 bp, Cryptosporidium hominis
atgagtggttcgtttaaaacatacacaaacaatgggaaacacgacgaaatatctcatttaagatatagaaatgctttggaaatagaaagatctaatcatacaaacgaattagcaaaaaaagcagaaaaattgaggttaatttataaaactagatttgaagaggatttacgtgcatttatggtttctcacaaagctcatgatgcatgcttgaattcacatgcgtttaaatgtattaaccccaaacctttgagaacaggtaatatttgttcacataaatttagaatcacttcaaagctttcacacaataattcagaagttcaaaattcatcctttatcccaacttgggcatggccagcatcattgagaaataatgaagatttaaagttgatatctttattttacactgcagagactaatgtaccattatcaccatctcaagttggtggcaagcgtaataaggaaactcaaatttgcaaccctattaaacaaaacacttccaacgacaaaaagaatttgcttaaagctcttaaaatatctaagaaagatgagcaagagaaattaaataatcaaaatatatttgagccaaataatttaaaacagaatcaaagacaaagacttcggtcaaaatatggtgctccttttacttgggctcaaaataaatcaagagataaaacagaagtgatttcatctccacttgaaggttcttcagatatttcaacgcctcaatctcaagtgtttactgaaattccgaaacagccaagcatttatccactagaattggagcgcaatatcgactcacataatttgggtatttctgagtttattaagaaatcacttaaaatgcaaaaaactttagaattattacttgaacataacacagaaaataatattaaaaaaacataa

SEQ ID NO: 3734 - DNA, 705 bp, Cryptosporidium hominis
atgatatttctacccaagcgtcggaacaaaaggtacgcaggtcaatttttacttatcattctcttatttgttttttataaacttgcttttagctcagaaattagtgaaatttcagaatctaaccaatatgatctagaaaacgaaaatatatcaaaaagaccagaaggtgccacttctataccaattaaaaaaaaattatttaaaaattttagaaaggaggtgacagttgataagtactatacaaaggacggaaagaaagtcaaagtaatcttagtaagaaaaagacgtccagtatttaattggcttagaaaatggagaaataaacgaaaaattaaaaataaagcaaaaaaaagatataaaatgaataaggatcgaaaaagtaaaaaacctaacatactaaaaagagtatttaaaagaaaaaaaatgaatgataaaagtaaagaagactccaaaatatcagacgtaaactatgcgaaagaaaacgaggaaagcgttccaaaaagcgatatatttgaggaagatactgagtatgaggttaataaaaacgaggaagatgaacctagaatgaaagaaccagatactcagttggatgatacggccccttcacccagtagaacatcaagttatgaaagaagttcaattactggtgaaaatacgggtcctactgatatgaaaacatcaactttcgatatgagcgccctctaa

SEQ ID NO: 3735 - DNA, 2628 bp, Cryptosporidium hominis
atgtgtattaattttctgggactattttcattaatatacctatatagttatttatttgttggccaaaatactggttatttaattgaggttaacttactaaaaaataagcatgagaaaagttcgttttctacagatgagagcgaagatgaaacttcaattatagatgatattaacatttcagagttaaatgaagctaactctcaaatagatattaaagataattcgaggaatatttttattaaagagagccacaataatcaaataatcaatcaacatgattatatttctgtttctgggaagtcacattataaatctcccaaaaaggtagaattatccaccattaagccatttaaactaatcaaaaaaccaaaaatagaaagtcttcaaattgacgagtttgcatttatggtgagacctaatgaaagaatgatcggaattgaaaattttgttattaatgagattgaaagactaaatacaaagtataataatattagcgcaggaagtgaaattaccgagggagaaagttcgattaaaaataataaatataataattttggatatttttcatttccaggaaatgtaaaagatgaaattttctcgaaagaaatatatttacgtactattccatatgcaagatatactccactatttattgaagtccgcagttcctcatataatgctgcattacatggaatatataagagagaagaatcaatgcaattgtctcaaagtgatcaaaggtttccttggtatgttgagccaattattaggccagtttatagaagaatttatcctgagccaagcttgtacatattttttttaaattttcccatagaaagatggtgtattggagatacttggccaattaataacccaaaaatatcagttggacaaatttatgcagaaataattggaaggccatactcccctgcatacactagaggttggtatgttcagccaagaaagtttagtgctcatgatatagttccatacgtcgaactagatcctagcacccccttgaggaatccattacctgttacaatacctaaagaaatggagtctaagcgtgtattggtttttgataaggatttgattgttgaagaagcaagaccatttacttttatacctaaggaatcaattattcttgaacatattcctttagttgaatcacctgacgatttacaagtatttccgggttgtcccaatcctcatttaagtaaatttagcggattaacaaaatacaaaatttcttcatgtataccaccttcacggggaactttagatattataattaatggtgcgaatggatacttctcaaatgccttatatagttgggaggggttttttaagagtaggccatactttgtacaaagggggcccttaagaagtgaggacgttagcttacaaagttcaatagtagaataccctggaaatagtctgtacctttggtcatttattaatgagtcaaatgccatatcatggattatttcaagacaattgggaaatactaaccccagccaaattttggctatttggagaaggccaagcaattcaaggattaaatccgaagttgattggcctgctgaaagagggatggaattagagcctgatggttgggcatttttgaaacccccatttaaaaagaaatatgtgcacaatatcccaaatagtaattttgttgaagaaaaagtttttgtcagaattataggcattaaaccaaaacatgttaaaatggtaataaatggaggcactgatgatattaatggagattattttcatttgggagaatatctaggattccctttttttagacaaaaaagaaataagaagaaaaatcaccctggatacgtgttgtatcgagggatagtaattaataagtctaaagatacttgggtaattggaactacgttagggagcattcatggaataaaggcatatgctgttgattatattcgcaatggtcattctaatgagttcgactcaaggttaggatttcaatactttggaggaacaagatggcctcatcaactacctatcaggtcatggagggtttgggggccatcagatgaaaatataaagatcaacatctacagtaatgaacttaagggcataaattcagaagaagttacaaagtctattgaatttaaatggagaagctttgagtcgttatacattacaatggaatatttgaacccaatttcactatttaagcagcatttatctcctgttattggaaatattcactcggatttaagacaagaaacaattaacacaaatactgacccaatatcgttggaccttagcgatttaaacaaaaattcttctggcgatttaaacgataccaaaaattacaaatatcaaacactagatttaaatccaaataatttgagttatgatattatcaattcaaatgttgatgaagataaagtaatttttgttggaaaagaaaaaaaaagtatttccaatagaataatagggattttgagtatttctggatcgatattcataggaatatttatctggatacttattaaaagtaaatttcatcgagataaagtcgagcttaatcaagaaattattttgggtaatccgaaaggaattgcgcaccctaacagtaaatttagataa

SEQ ID NO: 3736 - DNA, 882 bp, Cryptosporidium hominis
atgaattcaaaacaaagtctagatccattaacctataattcagcggtgaaatctacacaactattacttgccttacaaaaccaaactccattgattgggttacaaaacactccgatagaagtttcaagaccgcaagtttcaagttcttctactcaagtcgctccacttaatatacttaacaataatttaaataattgggcagaatctgctctttcaacattgctagataaaccggatatgcttatgaatttaatgcgacttggtgctgccagtattatggcatcttattatgggcaaacacagaatccaacgggcgtaaatatcttacagcaaagttctccgtttatttataatatgtctctttcaccaaaacaagctgaaacaccctgcattaataatgttagtcctattgagatgaacaactcttctatggcatttactccagtaaaatcaccttcaacagaaaaaattgaacaccaaaccccggtatttacgccgaatgcatctcaacagttctccgacgaactagttttctataactttcttgaacagagcagaaaactttcgtgcgacatcaaaaatcaaaatgagaagaaaaatttatctacaaataaaagtaatggacaaactattaggaaaagctgtgcagggaggccacgtttagatcgttcagattggtgttgtagtttatgtagatgcattgaaactgcacaatggagatatctcagaaatacccttgagaataatcaaaacaatatttgccatcgtggtaaaatcctggtgtgtaacgcttgttatttaagagtgtctaaggaaaacaaaattagacaaaaaataaatacctataaactggaaggaaacataaaaatagacgataaatag

SEQ ID NO: 3737 - DNA, 882 bp, Cryptosporidium hominis; identical to SEQ ID NO: 3736

SEQ ID NO: 3738 - DNA, 252 bp, Cryptosporidium hominis
atgaatgaagaggttttgaatttccagtttccagattctacaatttcaaggatttctaaatcagtattaagtaacaactctcgtttgtctaaagacgcatgcaaaattatcaataaatgtgctacattattttcaatttatttagcatctctatcgtgttcctctaaagatggaaaaaaatcaacagtgcaggactataatgtagaggtcgctttgaagtatatatcttcgaagaataattcatctatataa

SEQ ID NO: 3739 - DNA, 1824 bp, Cryptosporidium hominis
atgggaacatttttttgtttccatacatcagaaaggacgatacataagataaatcgtgaaattaattatattactaagtcgaagaaaaagttcgatgagaagtcaaataaattcattttaaatgcattaaagtacgatggaaagaagtcaaaaattttggttgacataattaaaattgaaatatctaattcaaatactacttttgaaagaaggtttttatatttgcgtctgctagatagattaattattggaaatgcgacgtatttacagttggcatatcaaaataatttactttcgtgtattgttacgctttcagacagtgcaaataagaaagagctgtttaaatattccgaaaaagaagaggaaataatgcttttatgcaaccttgcggcatcctgccttaacaaatggtatgagaagtattcgagtgtaaataatgaatcaattgaattattaagtgagtttgtaaataactattttgtaaatccttcaaatactgaaaatgattctcaagaaaatggaatgggtaataatgaattgaataatttaaaaaataatcaaaatgatttcttgatatccgaagaatcgaatattttaaacggtttaaaacctcaaggctttacaagtttatctaaccaagtgttggataattcagattcttcatgcttgtttgaaatggaagttgatccagatttgtttgacgtaacttctaaagtgaatggaaatagctcatgcaaaattgttttaaaccaagattcatcagttgagaataagtttatcgaggaagaaattattgaaacttgtgataaggatataaatttaacggcaattgagccaaaaactattaaaattgattatattgaggactcaaacatgagtgagattgaaacaaagtacagcttattaaaagaaaaatacttgtttcttgttcaaaaaaatgaatatttaatatctagattagaatattacgaggattttaatttgctttcaaaaagaattacaagagacaatcaaagcctaaagaataatattgaactatttagtaatttaccaaacgatattgatttaagcagttcctttctagaaaattttggcaatctcatactaaataatgattgggttttatttgaggataacctcattcaaatgggtgttaaatttcaattttcggaaaatatgggtagttttagcttgtatttaggaaacaaactcccaaacagactagaagatttcacaataacattcgactattcttatatacatcctagggctttatcaattataaagaaaaatgaaatagagtatccaagttatgtttcaggaaaacaacaaatatgcctaatttttaacgtagaatgcaacgatgtatattttggtgttccaacagtgatagtcaaattcttgttggcggataatactcctaaagtgatagaaatcccatttccactattggtgagcaaattttcgtatgaggaagaacaatattcaaatgatttcatctcaaatctctggcattcagaagtatatttaatgtctcaagcgtctacacaaataaatactaagttttctataaatcgaatatcagatgtagtaaataaatgcaagcttaatgaatctttctatttattgattgaaaacgaaaataatgaagaaacagacaaaataatttatttacatgggaatgtattaaaccgcaaagtaatcattcaaattcgtgagtccaacccaaacagctatatcttgcgtgtaagatcagattctggaattctttctaattctattctttccatagtgatattccaaataaaagatgatactttttaa

SEQ ID NO: 3740 - DNA, 1536 bp, Cryptosporidium hominis
atgcaaggaaaatgtactcttcatggtttaaatagatacaaaacaatttgcgaaataggtgaaggcgcatttggggtcgttttcaaatgcatggatcttgttactaacgaaattgttgcgcttaaagagtttaaaacaatctattcagacgagaacgaaaactcatatgttactaaaaattcagcaaatggtaaagtaaatacaaatatttctcataataaaattctgagagaaattgcaacacttaggagactatatggtcagaagaatatcattcaactaaaagatttttttttacatgaaaacagatattatttatcgttagagtattttccacagacgcttctgcaatatttagaaaaaagtcctaaagggctccccatagaaataattagatcaagtatttaccagttgttgacagcattgaaaaagtgtcactctatgggaattattcatcgcgatgttaagcctgaaaatattttaattaaagaaattgagaaaaacatgaacttggaacttaagctttgcgattttgggttcgcaaggttcattcaacaaaataaaagttattcaaatcaatttaaagatagtttgtcaaaatcagtggatagtttatgtgtagcaagccgtccacttacaagttacgtttctacgagatggtatagagctccagagctgctcgtaaaaagtacggagtatgggcctggaatagatgtttgggcagttggttgtataatggcagaactgattgatggagaaccgttgtttccagggacaagcgacattgatcaactttatttaataagaaatacaataggaaaattagatagcaaaagtcaaggcattcttgaatcagacaaaaggctctacgacgcgtacaaaaaacatttttataatggatttatatcggggtcaaattcaagatacaacactgagttaagccaatcaagcgcagtaattcctccataccaaataatttcaatcaaagagaggtacgaaaaaaaagttgatcttatagcgcttgactttctgcaaaaatccctaacaatcgatccgaagatgcgaccagattgtcaagaattgttgttacatccgtttttctcttcaatcaacgggactgaaggctttgctaaatatgagcaggagtacgtttcatcttcactattaaatattacagatgcgtcgtctaagtcactttcattgccaattttttttgagtcttgtcattcctccgcaaaacacagaggaaaaaattatgattgcgaagacaatgatggcgtaaataagttcttggagaattttgaacaaccttgcgcaaaaaataagtgtgtcttgaacgatgacaaaaccactgccccttctactccggacgataaatccactcctttgccacacagcggtatattttataattcaaaaatttggtgcgaaaaaatttcactccctaaatttccacacattatgccacctccacctaaaaatataaacaatttgaagaattggtcgaatattgatatgcaagaaaatataaagtaa

SEQ ID NO: 3741 - DNA, 5040 bp, Cryptosporidium hominis
atgtctaaaattaggttccagaaaagtcaattattaattgaaccaggacctccaaaagagatagacgaggatcatcgcgattttttaattaaggagtctaaatggatgtatggatgtttcatagatgaacacaaatggaaaataaaatcatttaaagcagttgctcaatgtgcaattagataccttcagaccaaagaccaacgattaaaaaaacgaaaagaagaagaagataaacgtctaaggattgtttcaaaaaatatttcagtaaacatcaataaattctggaataacatttctaagattgtgagacatcgaaagctaagcgaattaaataagcttttgagaatcaagcaattcgaaaaacttgataaacttgtatctgaaactgaaaaattttattttgggactaatgaggattcaggaaaaaaaactcaaccaaatgataaatactgcaaagtagatttaaaaaataaatctgatagtgaagatgatctcgaaacagacaattgggactatattgaagaggttgacaataaattagatctagaaatggaaagttctgactttgatagtgatgaagttaatgctgagttagatgaactgaataacgatgcaagcttaaatttagaagagttgtacttaaagtattatggtaatcctcacgacaaaaaaaataatttaaaaagagataaatcagaccatgcttatattggagatgcaataaaacgtaaaaaaaactactgtgaagagtatgttaaaaccactattagcaaacatattgaagaagagttgcgtacggaaaaagaaatgaatgacacagataaaaaaaatgattttagtctgaaggatgaatatgaaacgttgagaaatgatgcaaacactctaattgataaagctattgcaaacctagaagaaaaaaataatccaccaaattttttggaaactaatagtgctctcgcaaaagtttccatcgatcaaattaaaatcccttttcttctaaaaaataatatgagggaatatcaagttgctgggctcgaatggatggttaaattgtacaaaagaggattaaatggaatccttgctgatgaaatgggtcttggaaagacaattcaaactatttcgctccttgcatatcttgcttgctatatgaaaaattgggggccacatttaattgttgtacctaccagcgtaatgttgaattgggaaatggaatttaaacgatggcttccatgcttcaaagttatcacgtactttggaactccaaaagagagacagaagaaaaggattggatggaacgaccctaatgcatttaatgtatgtattgcgtcatatactttaatcttacaagatgcacatatatttaaaaggaaacaatggcaatatttaattttagatgaggctcaaaatatcaagaactttaagtctcaaaaatggcaagtaatgttatcatttaatactgaaagaaggcttctgcttacaggcacaccattacaaaataatttaatggaactttggtcattactgcattttttgatgcctcatatattcacatcgcatcatgactttaaaacttggttttccgaccctttaacaactgccattgaaaatcaacaggttgaaaatgaaagaaatttattaagaagacttcactctgtgttgagaccctttttattaagaagattaaaaaaggatgtggaaaaggaaatgccatcaaaaattgaacatgtaattaagtgccccttaagcaagcgtcaaaaagagctatatgatgaattccttgaaagtaaaacaactcagaatactattgctggcggagattatattggcttaatgaatgtattaatgcagttaagaaaagtttgtaatcatcctgatctttttgaacctaggacaattaagacgccaattgttgaaaaaaaactaatgataaattattcatttagctcgctaatattcttcccaaatatatgtattacaatgtcatctaatgtgcctggactgggaaaaaatatctcgacaaataattacctatatatcggcaaaaaaactaataattcgaaatacacgactctgtttgacaaattaactaatcataggtttgtgaatataccaaatatttttattttatacaacgaaatccatatgagcaagtttcaagcacaatcacaatgcgaattaacttacaaaaaatggactgaaacacaatcctgtaattacaacatagaaaattcattgttcagcaaacgtattataggaactgagaatctgttggaaataaaccgttttataagaattggtcttgatagattagcttctgttgaattcaactcccccttaataggaatggattcaaaaaataccgagtacacaaaggatgttaataaatatatacttgaccacatttctaataacaaggtgaaaaataaacctaatagtgttatgaattcaacagagaatgtttctttattttataaagaggataatcaaaagattgcatccgaatggagaaccttcgtgtgaatgtctaaaattaggttccagaaaagtcaattattaattgaaccaggacctccaaaagagatagacgaggatcatcgcgattttttaattaaggagtctaaatggatgtatggatgtttcatagatgaacacaaatggaaaataaaatcatttaaagcagttgctcaatgtgcaattagataccttcagaccaaagaccaacgattaaaaaaacgaaaagaagaagaagataaacgtctaaggattgtttcaaaaaatatttcagtaaacatcaataaattctggaataacatttctaagattgtgagacatcgaaagctaagcgaattaaataagcttttgagaatcaagcaattcgaaaaacttgataaacttgtatctgaaactgaaaaattttattttgggactaatgaggattcaggaaaaaaaactcaaccaaatgataaatactgcaaagtagatttaaaaaataaatctgatagtgaagatgatctcgaaacagacaattgggactatattgaagaggttgacaataaattagatctagaaatggaaagttctgactttgatagtgatgaagttaatgctgagttagatgaactgaataacgatgcaagcttaaatttagaagagttgtacttaaagtattatggtaatcctcacgacaaaaaaaataatttaaaaagagataaatcagaccatgcttatattggagatgcaataaaacgtaaaaaaaactactgtgaagagtatgttaaaaccactattagcaaacatattgaagaagagttgcgtacggaaaaagaaatgaatgacacagataaaaaaaatgattttagtctgaaggatgaatatgaaacgttgagaaatgatgcaaacactctaattgataaagctattgcaaacctagaagaaaaaaataatccaccaaattttttggaaactaatagtgctctcgcaaaagtttccatcgatcaaattaaaatcccttttcttctaaaaaataatatgagggaatatcaagttgctgggctcgaatggatggttaaattgtacaaaagaggattaaatggaatccttgctgatgaaatgggtcttggaaagacaattcaaactatttcgctccttgcatatcttgcttgctatatgaaaaattgggggccacatttaattgttgtacctaccagcgtaatgttgaattgggaaatggaatttaaacgatggcttccatgcttcaaagttatcacgtactttggaactccaaaagagagacagaagaaaaggattggatggaacgaccctaatgcatttaatgtatgtattgcgtcatatactttaatcttacaagatgcacatatatttaaaaggaaacaatggcaatatttaattttagatgaggctcaaaatatcaagaactttaagtctcaaaaatggcaagtaatgttatcatttaatactgaaagaaggcttctgcttacaggcacaccattacaaaataatttaatggaactttggtcattactgcattttttgatgcctcatatattcacatcgcatcatgactttaaaacttggttttccgaccctttaacaactgccattgaaaatcaacaggttgaaaatgaaagaaatttattaagaagacttcactctgtgttgagaccctttttattaagaagattaaaaaaggatgtggaaaaggaaatgccatcaaaaattgaacatgtaattaagtgccccttaagcaagcgtcaaaaagagctatatgatgaattccttgaaagtaaaacaactcagaatactattgctggcggagattatattggcttaatgaatgtattaatgcagttaagaaaagtttgtaatcatcctgatctttttgaacctaggacaattaagacgccaattgttgaaaaaaaactaatgataaattattcatttagctcgctaatattcttcccaaatatatgtattacaatgtcatctaatgtgcctggactgggaaaaaatatctcgacaaataattacctatatatcggcaaaaaaactaataattcgaaatacacgactctgtttgacaaattaactaatcataggtttgtgaatataccaaatatttttattttatacaacgaaatccatatgagcaagtttcaagcacaatcacaatgcgaattaacttacaaaaaatggactgaaacacaatcctgtaattacaacatagaaaattcattgttcagcaaacgtattataggaactgagaatctgttggaaataaaccgttttataagaattggtcttgatagattagcttctgttgaattcaactcccccttaataggaatggattcaaaaaataccgagtacacaaaggatgttaataaatatatacttgaccacatttctaataacaaggtgaaaaataaacctaatagtgttatgaattcaacagagaatgtttctttattttataaagaggataatcaaaagattgcatccgaatggagaaccttcgtgtga

SEQ ID NO: 3742 - DNA, 705 bp, Cryptosporidium hominis
atgaataaacggccaagagaatctaccctttggagtgaatactcatccatatctctctcaagtattgagataattgattcagaagttaaaaagggatgcatggaattccggaaagatttgtctgaacaggttacgatacatttaagagaacggattccatccaaaatagttcaactaaacaatcgaatgaaaatttctgataaaccgggatcagttttatcttctgaggagttaaagcctattaataatggtgatggcaaagtttattcgaatctgcagattaaagaactagtcgcctatgttaaacaggaagttagtgagttaattgaaatggttagttctataaaattatgggtacaactaaatattccccaaattcaagacggaaataatttcggagtaggaatacaagaagagactatccaggagcttggtagagttgaagatgcaacattttcattgtacgaaagcgtatgtaagtactattctgaaagggcgagactctcatcgaaaataatcaaatatcccaacgttgaggattatgtggaagcagttagagaattagacgagagatattgggtctcattgcgttgctcgatagctgatatgagaaataattatgcatggctacacgaccttttaactaaaaattggggaaagctgagtaagcctcgtaattcggaaggtacgagtatggtttattag

SEQ ID NO: 3743 - DNA, 3129 bp, Cryptosporidium hominis
atggcaactgataaacttaagttgtttgctgacttcttgaaagacaaaccaagtttaaaacacgaaatgtcaccatcttataatccatcagaagtggagtcacattgggacgctatttggtgtgaatcaaaaatatacctcccaaattttgaaagggcaagtaatctacctttggaaaataaatttgttattgcccttcctccccctaacgttacgggaaggcttcatttaggtcatacacttactgcagcaattcaagatagtttatgccgttataatagattaataggcaaagaagtgctttggattccaggcacagatcatgccggcatagcaactcaaactgttgtagagagaattattcatcaaacagataacgttactagacatgatttaggaagagacaattttcttaaaaaagtttgggagtggaaagaaaaacacggatctgctatctgttctcaatttcgtagacttggatgctcgctggattggtcaagggaattttttaccttggatgaaaacatgtctaaagcagtgaataatgcgtttattcaattgtttaatcaagggtatatttttagaaaaactagacttgtatcttggtgttcatatctccgcacagccttatcagatatagaggttgatctattagaagttaacaagccttcaagaattaggattccaggttatgaaaaaactgtcgaagttggggttctatggcatttttcttatccattagaacagcatggtcaaacatatgaatggcactttatgccagaaaacattactaatattgaaaaaataacagttgctacaaccagaattgagactatgttgggggatgtcgccgttgcagtaaacccaaaagacaatagatataaatctctaatagggaaatattgtttacatccatttatcaaggatcgtaagattattatcattgcagatgaacacgtagatccagaatttggaactggatgtgtaaagattacccctgcccacgataaaaacgattttgaaattgcatctagatataatgaaaggcataaaagcgaaccattatttgaaaagctcaagttcatttcagtattcactaatgacggaaatattgggcctggtttcggaattttttctggaatacaccgtttcaaatgcagagaattggttgaaaaagaattagaaaaaattaaactactagttgaaaaaactcctaattcaaaagcaatgcagattccaatttgctcaaggtcaaatgatatagttgaattattccttattccccaatggtggatgaactgcaaaccatttgctgaaaaagcatgcaaagctgtgaagaatcatgaactccaaatcgaacccaaatttcatgaacaaacatggttttattggctggaaaacatacaagattggtgtatttctaggcaactttggtgggggcacagaatacctgcatacaagattatttcaagtaaattaaattcaacagaagaaatttgggtcgctgccaaagatgaggagacagcaattaaagaagcaattcaaaaatatggtttaagtgaatgtgactttcatgttgagagagatagcgatgttcttgatacatggttttcatctggtttaataccattttcccctcttgggtggccagatgaagttaaccaaaaaactaaactgagcgatctttccacattttttccaacaactctcttagaaactggatcagatatattattcttttgggttgcgcgaatggtcatgttgagttttgcttgtactgataaattgcctttcaaaaccatttatttacatgcaatggtacgcgattcacaaggaagaaagatgtcaaaatcacttggaaatgtaattgatccaattgagatcatcgaaggtatttctcttgatgatttaaataaaaagcttgatcaaggaaatctccctcttcaagaaataaaaaaatcaaaggagaataaccttaaagacttccctgatggaattcctgaatgtggggcagatgcgcttagaattggtttactagcttacacaaagcaaggaaggaacattaacctagatacaaaacgtgtagttgcatatagacatttttgcaataaactatggaatgcttgtaaatttgcatttgggaacattgaaaacgttgcaaatcatatgaaacaaaacttcgaagcgataacgattaacgaactattctcaaaccatagtgaagacttattgtgggaagattattatgttctttatcgattgatggtctgcattaattgcgttaaggagtcattcgataatttcttgttctcagatgttgtaacagcaacttacaatttttggctttatgagctctgtgatgtatatcttgagctcgttaagagtaggtttaaaaatattgaatcgtcatttcgatatgcatacacagcagcacaagttttatctatttgtattgagtacggattagtgcttttacaccccttaactccatttgttacagaagaactatatcaaagatttaagcaagtgacacgatcttccataattagttcaatatcaacatctgaattcccacaaatttccgttcacaatggacttatatcctctagagatcacgaatttaaaaaaatgatgaatattgtcacaaagatacgttctttaacagctatactaggaatatcaaacaaagacaaaataaatattaaggttcatgtagtttacaatggaacagatctcgaatacatagatctcatttcaaacgttgcaaccgcattcgttacaaagctatcgcaaataggtggaacaatggtgcttcttaatccaagtatagatgagattgatgaattaaaaaaaaattgtttgctagacattgtagatgaaaagaccgtttattatttgaaacctccagagtttgtggacttatctatagcgcttaaaaaaatagaaaaacaaattgattcaaatgttaaatcccttgaatcatacaataaaaaaaagtcatcttcatcatatgataaagttccagaatctgttaaaaagctcaatgatgaaaaaattgatcagcttgtttctaccattgatgcacttagagttgcgcattcaaatatagagagtctcatcaatcaataa

SEQ ID NO: 3744 - DNA, 2235 bp, Cryptosporidium hominis
atggaagctttagaatgccaactcttcattgaaagcaaaaatcaggaaattgagtgtctggcagtaactcctaatggttacttttgcgctgttgcccaaaaagaaggaagtattaccatttttgatacaattacttttcattcatggctgaagattctaagtattgagcaatattctttgaggagtttattctttttgaaaaaatctaattcagattttgggtttcaaaattctcaattaatcgacagtaattcatttttagaaaatgaaaatttgagtgaaactgatagtgactgtaccaatactacagcatgcacatctcctattaaatctcctttgagaaaatctcgttactctctatctagcaattatattaatatgtctgatttgtataaatacagacttgtaggtttgggtctcgacggaagaattatcgagtgggacttgagcactggtatgaccttggaaactactttttcttatggaggtgcaatttttcaaggctctttatctccatcatgtgaaaatttagctttggcatgtgcagatggttcgattaaaatgtttagtttattaaacaatgaactttcattttcgtattcattgccaaagcatagcaataagctcctatcaattacatttctaaatgaaaatacaataatagcaggatctagtgatggaataattctagaatataacctggaaacaagaatgtgcattaataagatgtcggtatgcactggtaaaaaatcaactgataaaagaaattcaaaaaatgtatcaatatggtgcttagtgactctagagtctgataatattttatttagcggagattcgaatggaactgtagtagtttgggatttaatcacctatacggcaataaatacatttaagcttcaccatggagatgttctaacgctttcaaaactcggaaatattaacactaaagcctcaaatactactattgtttcaactggaattgacggccgtgtggtaacatatattaatacaaaaaactttgatcattctgagaaatctggaaagtggcttcctagttcattttgttatccgcattcatcttctataggctcagttgcaaccgtagctataccccaaataaatgggccattagccttatctggaacctgggatggaaaattgattctttggttgtcgcttgagcgcagtaaaaagaattctaacaatgattacgaatttgtatctacttcttcgaagctcaaattcttggctcttcctgcgggagtattaaaaaacccacaaaatattcacatagcagaaagtgaacgtttaatacttcaccaaagtttaagaaatcttgaattatggttcatttcagatcccgaaataactagcattaaatcaggttccggaaaaattttgataaacccatttcaaattacttatagcaaattaaataatatatgctcaaatatcactgataacgatacaaatgtctctaatttagttccagtgcaaccaatcaaattattagacattaaactttccaacaaaaaaaatgaaattattgtttgcagtgtcttaagcatagacgggaattatattgtgagttcattttctgactctggaataagagcattgcatattgatctgcaaagcctaaatattaataatgttcaacttgaatcttgtaacaatgtgatggctacctgcatgaaatttctaacaaataccgttttaattattggtggttttttgacgcaagattgcaagaataatccaaaaataagtccaaaaatttttattattgatatcgaaagagatattattatttattctttagaacttaaacatcagattaatagtgaatattctcgaattggaaaaataactgaattaagtatttcctcagataatcaatggcttgcggtgttaacaagttttggtaatacttttattattgaccttgattcatttaaattagaagcagatctaacaaatttacaaagcgaagttttcaatcctttctcacaaaacaattattctacaccaattgcttctatatctttcaataatcgtgaaagtgatattgtttctgttatgatgtccgacggaaagtattacttttattcgatagggttgaaaaaaactataccgaaggaatacctaagaaatcataaagatttcacagataaatcatcgaatatctataaagttcccaaaaagaaatattctccaattttgcatggaccgata

SEQ ID NO: 3745 - DNA, 972 bp, Cryptosporidium hominis
atgccaataactggctttataataaatatgaaactattgtcattttttaaattattctccataatatctattttatctcttatatatgaacatgcattaggatctcatattaacctgattaaagaattaaaccccgttagtgaagaggaatctggaaactttagccataatggttcagaaatactaccagaaactattccaaatttcaatgaaatgtcaatacaaatacacgaagacagaaataaaactttgaataatgaaaatggaccaaattatttagaaccggaaatagaaacagcaaataaacaaaatttaatcaaatctgcaaattttcaaacccactttgacttgaaattaatagcaaaagaaaatgatactttaaataaaactgagaaagaaactcattcaggaactgcaaatgagacaaaaaagattattaacaataatatacatcgcttaaggagatatccggatgctgaacttaatgatcaatcttttctcacatttaatcaagaaccaaacctttacaatgaaacaacttctttggattcaaaacttgtgttaaatgataatgccataacagaggaagaatcttcaaattacgatgaatctcagtcttctaaaaaaaatagccgtctgtttgccagaaggataactaaaaattattctaatgagtatccatacattaatccatttataccgattagaagtcaagaaacggaaaataaggaggcagatcaagaagcaattagtttccccgtaattataagaataaacccagagtacataacaggaaacaaaccccatgaagatgagacaacagatccaaatgttgaaatgaaagaattcaaaagtaatttcaatttaatcaaaagttttcaatattcaatattaaagtttgagaaattagattctcaaaatgaaagttttgtgtcccgagttcaactctatgtcaacatccctcatttttaa

SEQ ID NO: 3746 - DNA, 1557 bp, Cryptosporidium hominis
atgacagagcagaataatgatttagatttcaaagatgacaataccaaagatttgcaaagaaaggaggatttagaggcaaatataatttctcaaaactacggtataaaaattagagatacatcaagaaatatgagttatacgaataatagaagagatgaaattttcatgcagttacagacagaattgttcgatattcttttagaaatttataacataattcctacatggggctcatttaaagaaaacttctattttcattggaagagaattattggtgcctgcaatttcaaagatcttcatgcatataggttaatttttagatgcttgggaaatttacgcccttcttcaatgcctatatttattctaaggccaataattaaacagctagatgagtacagaaaaatttcagaacctgaatattctccatctagttttgaatttaacccaaatatacacgggaacttagctacaacttctaatggctcaattgccatgttacaaaattcacatcccattaaaacatgtgcccaaattgaaagtaaaaaagaaatattgcttgaagataaaataggacgagattttttctccgataaatttaattctaacttttttcatgaaattatgaaagaaaatgcaaaatattcaggattggtattatcaggattaaatgaagcaaatgccattccattttcattactagaaaatgatatattcaactctgtgccatcacaaaataatagtaatctaattgataatatctacaattcaataaataagaatttctatttttcgataactagacagcaaaacggtagttttacaaatgataatgaacaattaaccgaagacaagaagataaaaaatgagctaattgatagaaaggagcacattctttcagaggattataattccaatgaatttattaataattcattggttatttcaaatcattggaattcaaactctgcagtctcttcgccttatggttcggtttgcactgcaccatcactttcacctacagaatataaaattgaagggcctataatgacagcttttcaacatattcaagcagtagcagttgcaacagcagttgcaaatagctctaaaaacaaactaaactccgcaagtaatttatcaaacgaacaaaatacaatacaaccaaagaaaagaccgaggaggaatggtgagattcaaggggtatatttcgacaaaatacgcaaactttggcgtgcaaactggaaagaaaatggacgtgtaaaaacaaaagggttttcagtttttcaatttggagatgagggtgctagacaaagagctattgaatatcgtaagaaaatggaaaaggaattctatgtcgtgcctaatacaaagctttctagaagttcaagcaatagcggaactatctatattaatacagaaaagacgtttcaaaacagtatctcacctaaaaaaaaagatattggacttagttcaaatttaaacaacactttgagcagttcaaagctaagctctgaaaacacaaaattatcagaaaacaccaactctaattttaataattaa

SEQ ID NO: 3747 - DNA, 258 bp, Cryptosporidium hominis
atgcagagaaacttcaagctttcatttcattgggagaattggaaaacgatattcaagatttatccaatttattcaataataaaaggtgagtttttcattcattaccaaatcgatttattggcttttaggctgctactgatacaatcgtctaatgatattgagaatgatgacgatcaagaggacaatgagagcgaggagttgaaccagaactcagaaggtcaaaaagacactcccacaccggtaagtactcaaatttag

SEQ ID NO: 3748 - DNA, 1068 bp, Cryptosporidium hominis
atgaagatagcctctaatagaattgcaattttcttcggtggactaatatctggtattatatttaaggattatttcaagacattttctaggttaacaataaactatttaaaatctattattttttctatttcttatataaaaactgattcagttatttctaaataccaaaatcattttaataatcaaattgacaattgcgtaggagttgattctccagatgcaggaatcgcagactcttgtgcaggatgcccaaatgcaccaatatgcgcttctggacaagcaaagaaaaagcctatagagaatattgaaaacttatcaaaagtaaaaaatattattttggttctatccggtaaaggaggtgtaggaaaatcaactatatcttcgcaaatatcatggtgtttatcatcgaaaaaattcaatgttggacttttagatatcgacatttgcggcccatccgcaccaaaaatgatgggagtgcaagacaatgatgtacacatttctgcgaatggctggtctccggtatatgttaatgataatctctcagttatgtccactgcatttttacttcctcaatctgatgatgctgtaatttggagaggcccaaaaaaaaatgggttaataaaacagtttctttcagatgtagtttggggtgaattagacttcttaatcattgatactcctccaggtacttccgacgagcatctctctatagtttcatatttaaatggttcaaacgtgaatggagctttgatcgtaaccactccgcaagaaattgcattacaagatgttaggaaggaaattaatttttgtaagaaagtgggtttaaatatccttggggttgttgaaaacatggggatgatttttaaaaatgctgagcatgattcttcagttaaagatatgtgtgacaatatggaagtagaatatcttaataaaataccatgggataaagaattactgtacgtatgcgatttgggtctctctatctgcgaaaaattcccccagtcgccatcttcaatcggaattaaaaaattagttgatataataatttaccaatcaaaaattaactaa

SEQ ID NO: 3749 - DNA, 369 bp, Cryptosporidium hominis
atgtcatttaatatccttccattccaaatcctatttgatgggagattgccaaaggaaaatcccttcaataaactttataacagcactcagtctcaggtaaatgctagtaataaagtaactaacatagcattaagtaaatcttttcgtggaagaaagttaaatggaagaataattcatttgagtaaatcaagccattcaatattgattttatctaaaaataattctcgaaaaaaaatggatttaattattgataagtctcttaaccaagtaacatactggaattatgatgacgagattaaacagtcggatgatatccctcaatttctaaatgttattcacaattttaatattctgcacagagaaacttag

SEQ ID NO: 3750 - DNA, 360 bp, Cryptosporidium hominis
atgacatttccttatttttataaagtacttatttatggcgcattaagtaaaaaaaaaaaaaaaaattttagaaaaatacaacaaactcagttgattatttgttacaaaagtttatattctcctgtaatttcatctattaattctgatggacctggaccaattgctattgctgtgtactctcctgctgcaatttgcgtccttccagcgtccttgattaaacaacttgtaatatttttttcttttgctctcctttcagattcaagtagctctttgaagctaactttcaagacaactttagcctgcccggatctttcccaggcttctaccattttggggtgtctttttatcgcttttttataa

SEQ ID NO: 3751 - DNA, 309 bp, Cryptosporidium hominis
atgggtagaggaaaagttgcttcacagtgtgggcacgcagtactaggtgcttataaaaaagcgataaaaagacaccccaaaatggtagaagcctgggaaagatccgggcaggctaaagttgtcttgaaagttagcttcaaagagctacttgaatctgaaaggagagcaaaagaaaaaaatattacaagttgtttaatcaaggacgctggaaggacgcaaattgcagcaggagagtacacagcaatagcaattggtccaggtccatcagaattaatagatgaaattacaggagaatataaacttttgtaa

SEQ ID NO: 3752 - DNA, 2496 bp, Cryptosporidium hominis
atggatcgaattcgaaataaaaaaagaaattcttttagagttgcagatatatgttcgtacaatagaaaattcgacgaattcattaaaactagaagtgaagacgaactaagcaatattttaacctcctgtttatattcttcaacgattgtaaagaatgttgaaggacagaattttatttcaagagtgatatcaaagctaagtatcgacatacatattgaattggtcaatattataaaatcttttgttcccaagctaagttcgaatttattaatatgctatggaaatattttatttattctttggctagagtataataatcagagtaatgaagaaagaatgcaaaacctcgaggaagcgatacaaagaactttttgtattgggtcaattaagttgaaccccttaattgctctcaggatgaggctaattttacacggttttcatagtaatcgtgatgactttcgagtaaataaactattattaaggttatatgatccattaatttggagatatatttcagttgccaattggaaagttaggctcaacacaactgctctacttgcaatattattcccattgattgacccatcactttctgcaggaaactataattcggaactagataatcaattttcaatattacaaaacttacttattgataaccatccggaagtaagggtagcagccattcagtctgtttgtcgaatattaacattatattgggagataactccaattgaaagaattcatgaaattttatcaacgctttcactaagatgtattgaagacaaacattcaattactgtcagagtcgcagtggtaaatggaattaatgctattataaataacccattatcgcaaaaaataataaatggctatttgccaaaaatatttacatatctacatgatatggatgttgaagtaaggtattccgttgctttactcgttctcaaaatttctagaattcaagggttcgattactcaaaaattatctcaaaaaaacaaattctttcgaggatttccaaggagtttataatttatcagctaaaacaatctacgtactttttgaaaaatggaaatttgtgcaaacattctgaaataataatagacgaaatttttgctagcgatcaggagtctgtatgcgaatctttaaaagttgcaagggtacttgcagagttgttaaacccttcaatatttaacgaaaagacaagggagcaacttaaaaactgttattttttttgcgacctttgcccaatagggatggttggatatttttgtagcttaaaaattttggtagatgagactattggaagaaatatagaaaattctgatcttttacgtttaggagtacttttgctcacaacaacaatagaaaattaccaaaaagataaaattacatacaataaggcaaaaattctgttggcatcaagcaaggaaattttatcaattttattctcaaacgactcatctttagtagattcaaacaaagattactacttaattccgaagtctagcgataaaatagcaacaaataccatccaaatcgcgattaaatattttacaaatacgtgcaatgatgattttttgttaaaaattgatccaaacgacagaatttggataaacgtactgcagttattgcaacaccaaactgtattgagatcgagctattatccaaaattctcaaaaaaaataatatcagaattttggaacaattctttattggctttcagaaacaaattagacgaaaaggatgcgaggatacgtttgggtgcaataattttgttatcaaagaattggggattactagaaagtattgttccaatattgatagatagcgcttgcaatataatttcaaatggattatcagcagatcatgaatttaacacaaattttgataccgagcttgggcccaatgagtctggagctttgtgcattaacatgcttttaaacatattggagtacaatgaagtaagggaatatctttcgagccatttttcaatacttaaatacttagaaagtctaacgaaaagcatttttaatcttcatttttataaaacttcacatatattagaattggatttgatgcggctaacaaagaaactgctaatattctctttgacagtaattaaaggcaagaaatctttctatgaatttattctaataattattaaagaaattgattgcataaaaaatgataaaaactgttcaattgataaatttcttttactgttcgagatgcttggaataatactttccattccggatagtagtctttctaatgaaaaaagaattatcgaagaagtactgaaggcattggaaaatttgtcaatcataataactattttggaaaagaaagatcaaagcaatgcattcagaacccaagttaaacaacgaataaatacatgtttatctgcgctaaaacaaattttaggaggttcatattttgaatcggacacttatgtaaaagaaataagatcaggattaggtagattttcataa

SEQ ID NO: 3753 - DNA, 841 bp, Cryptosporidium hominis
atgcgtttaatagcagcccatattttatcgttttatctgacggttttagaacttattggagacggaaatgtcatttttatattcaaatcattacaaagaaatggattccgtccagatttacgtttaaatggacttccaacaaccaatgaattgtttcaagatgcacaaattttacaagaaaaaatggaaaaaattagacttatgaattcaattcgcatttttgcacttgatttatctcaaaactgtatttttgaagaaaacaaaagaaactcgtgtggtgacacgggaaagtgtcaggtaatgggaaatgaaagcgacttgtcttcaactctatttggaattgataaagtcaatgacataaatattgctgataatgggaattgtaatgagaaaaaaacaaaggtagatatgcttaaaaacccaccatcaaacacacagtataaaggtggcgaagtttggcgtcacatatattatgaaatagaaaaagttgattttcctttacttaaaaaattaatatcaggagtccagagtaatattgctattcatgcatctgaaagatatagaaagattcgtgacgatgattatgattatagtttgttaaatttcattaacaaatttgtattatttgaagatcgaggagtaaatcttttagttacgtttcattacattgttcaatcagtttgtatattgggtccatcatttgataagttcatggaagacttagataactcaccagaaaacactaaattaaaagaagaagttaaggatattttcaacaaaagtcattattattcatgcagaccagaatacaagagcaatattattcctcctcaatttcttc

SEQ ID NO: 3754 - DNA, 768 bp, Cryptosporidium hominis
atgaactattatttttatattatcatttctgctgaaatgaaaaattttccaaagttttccgccagctgtgaaaaattcagatttatgaataaaaaaaacaaaatatggaaacctcttatttctgatccaaaattacttgaagagtattccgttggattaggtgttaaatctaaaattagctttattgatatttacacaacagaagagaccgaattttatttttgtggtataaatccaatttctttaatagctttagtaccaattaatgatgaaaaaatttgcaaaaagagaaataaattaggatgcgaaatgaatatctcccagagtgtttggttcatgaaacaatacattacgaattcttgcagtgcagttgcgcttttacattcaattttgaataatgataaaatagaacttgaagaagaaagcatcgccaagatgttattgaatttaaaaggtgatccaaatgatctacccagagaaagagggttttatttaataaatgacaagaatattgagtatctacacgaaaaattatcatcaagagatctaactaaagactgtgataaatcagagttccattatgtatcttttgtaagtaatcatgggcatataatagaattagatggaaggcttccctgtcaaattagccacggagtatgcaaaagtgatgaatttcttaaaaacacactaaaaatcataaaagaacattttattttgccaataggaataaatggcaaaatagctattgttgcattgtgtataaaatag

SEQ ID NO: 3755 - DNA, 2751 bp, Cryptosporidium hominis
atgatgaaagtatttaatgaacaaaataaagaggaatttaaaaaccctctaacaaattttggaaaagatgacaaaattcatagcatgctgtttgggcgtttaactctggagcaaaagaaggcagtatttactaaccatgaaagttcattgctaattgttgcaggcccagggactggaaagactgcaacattaacatctagaattgttcgttttttattgagtggatattcaccaatacttgcactaacatttactaggaaggcagcaaatgaacttaaaagtagagtttcaattgtttactcatcttcttcaaaaattatttattcaaagtcaaaacaaataaagaatgatttaagaaatgaaaagagtttatcagattttgttccgactccagaaatatttataggaactattcattcattttgttggaagcttcttaaagaatatggatctttcatcggcttaccaaaagatattgcgataattgataaggaattggcaattaaattgctaaagtcttgcttatctgaaaattcaagtaaagtcacatctcaattatcaaattattctccacttatttttgatccagccaattttgatgaaatcgagagagacgattttgatgataatatttgtgatcaaactcacgatattaagggtgaaaatgagcaatgtaaaaatttatataatttaaacaatataaaaaaagaaacaggtattgaccaaactacaaaaaataacgaatttgaaaaagtatttaaaattattaaactgatgaaaataaaaaaatttttaaataaaagtgaatgtacaatagatgatgttaatggaaatcatgaattacttggaatttactacttatataacaaaaagatggtggctcataaaccttatttagtagattacacagatttgattacacttgcattaaatttattaggaaataatattaatataagggaaaaaattcaggattcgtacccttatatattttgtgatgagtttcaagatacatctaaattacagtttaaaatacttgaattgttaactaaaagcataataaataaaaaaagaaaatttgaagctgaaaaattcactaaagatcaaaatctaaggagaggaggaattactgtggttggcgatgatgatcaagcaatttatagttggagaggcgtcgaaactggagtgttttcacaattttcttctatgtttaaagataacattaatttaatttatctcagcacaaattttaggtcgactaaatctataattcaagtttcaaacaaccttgtaaaaaaaaataaatttagaatatccaaattattaatcagtaataatgattttggcgtagagccagtagtttattattttccaaagcaaattgatgaaatgcattggattgcatccacaatactgcttttaaaaatgaaatttaactattcgtggagtgaattcgctatattggcaagaacaaatgatactcttttttatgttgaaaaattattgagcgataaaaagtttttaatcagttgtttggaaatgctccaagatactgagaatataaacaatgaacgaggctggtttaagatgatctctaatgatttattagattttgatgttgaccaattaagtcgatacaaatctgctgaaattacttttcctctcgaaaatacatctagaaataatccaaaatttgcatctgacttgctgtacagagcggagatattagatattttatcttactgcagactaattattgatgaaactgcagatgattgctttttgagaatttgcaatcgtccaaaaagaggtattggcgataatgctataaagttaatagaagaatatggtgctaaaggaatctcgttaatgaggaaatctacccagcccttgaatggaatttgtgaattagacacttctgtttatggaaatacaacaaatgtatatacatcaatagtgagcgtatgcagaatgttagtatcaagtaaatttgaaacaaaatctaaaattaattataagctacataaaaaaagcataaattctattaaagcattcttagatttcttagatgatttaaaacaattcattaagaataaggtctcagtatcagaaataattaatttaatagtgaagaaaatgaatcttgataatcaaaatgaaataatggtgaaacaatctaaaaacaagaggttacttcaatctaatttagttgataacattaattctagtacagaagattctgaaaaaataaattcaagaaaattgagcaccttaaattctatctctacccttttaaagtattcagaaccttacacaccaaacgatgaacaacctactgggtatgaatgcttactctgctttctgcaagatgcatctaatggtttattacaaataaaaaagggagaaaaaatatctttatcaactattcacagagcaaagggacttgaatggaaagttgtttttatccctaaattcgttgacaaagtattccctttatatagagaatcagaaaatttggagataaaaaacgagttcgatgaaatcactatagaagaagaaagaagaattgtttatgtggcatttacaagagcaaaagaacgactttttattagcgttccattaaatgttggaaaaccttcaccctttatacaggatgcaaatctttccagttataatataaattcaaaggagagggaattaattaaacaatttccgagaatagtaactgggaaaaattggataaaaagttag

SEQ ID NO: 3756 - DNA, 1236 bp, Cryptosporidium hominis
atggtgatgcgttgctacgcgcaattgcaaaaaaaaaaaaagttaattattactaactacttcataattaatactttattcaatatgaccgaaattaagaaaattcgctcacgatcgccctctcctataggaggaaactgcgagcctaaaagaattaaagccgattcatttgtaattggaaaagagactagattttcgctgattaaacaactagagtattatttttcagatgaaaatcttaaaacggactcgttcttccagaatataatgcgttcagaccctgagaatcgtttacttgtttcttaccttttgaattgttcaaaaatcaagaatctaggtattactaaagaagaagaaattattgatgcgcttaaaggtcatgaaatgatcttgattgagtttaaccaggaagggaaagcaatgataaaattaaataaaaatttacccgatttagagtcaaagaaaaaaacaaaagaaaagaatttaattaatagtaaagatcttcacgctggtggctgtattttaaaaattataaatttgcctgaaactgcatcttggtcttctgttaaagattctataaaagagaaacttaaagaattgcagccagaaagccaaaatttaataagatatgtatcacaaacaactcaagatggtacatgttatattttgcttaaaccatttaagaatgataaatcgcttatcgaaaatatggaattgacatttggtgaagaaaatattcctatttcacttgctagtcaagatgaagcgaggaaaataataaattcagtttttccaaggcatatacaaaaagaaagagaaaaagaacttaataaacaaaaaatggcatttatgtcaatgccaatagttgtaggtgggcaaacatttgcatcaatagaacatctaaggcgatgtattaaagaagttttagaacaatctgaagttaataccgtatttgaaaaagaaagtttaacatataaagtacttctttcaatcttggagtatcacccaaaacgtgaaaagaaaaccaaaggaatagattcaatctgtattaggatccacgaaaattctacaagcaaggatgatttatgtagcaaatgtttctacattgttagaaaatccccagatggcattgaagaatttgaagattttagtgtaaataaatgcctacaacaattatctagaaaccctccattatcttctaagttagaggaagctttgattgaaaatggtgcctga

SEQ ID NO: 3757 - DNA, 2457 bp, Cryptosporidium hominis
atggagagtgaaagccgtatgaatagtgatgaggtagtactgtttcaagaacaagatttaaacaagtctgagccaaccgttcagtcaccaaattttgaatcacatgagccttttaccgttgaagataattttgatgataattgcagtagcacaactggagctagtggatatagggatgcttcggtttcacctcaaagattttccagtatcggacatgaaattggaaccgatagtatttccgcatctagagctaatggcattgaacttgaattcaataatttggattcttacaaagatagcggctcaagtggaatacataatgaaatatgtgttactgaagaattagaaaaggaaaatcaaaatattgaaatagaaactaaccattctacatcaaacattccaactacaaaaatcgttaatgctaatcatgaaaatgaaaatttagagaatacagatattaggctcgataattccgatataacatatgacaatttgtcttcaaccgaatttctatccagacagagagccctagatagagctaatgtctttttaagatggaatttggctcctactaaacaacagattgcggagtttttagaaatggcccaaggtaaactaaacttgagtatggtatctgaaaaaggatacgactattgtttactttattttgaacttcttcgtgatgggcttattaatgctcatctatggcgcgatactactatagaagaacttgatttggcaattacagaagctcgtcaaaccttaaatggtgaaataactcctccccaaaacatcaagaagcgtagggttaataataatactctacaggaagaccattcttcgtcttataattcaactaatattgaaaacgaaaaaattccactccatatattagcaaaagtaagtaaaagtcattccgaattagatgacgcagcttcggaacttcaagaaaccccagtaaactttaattttgagcaaagtattaaagttgatgaagttgaaagaaaatcaaatgtagataatgaagatcttgacaactcatataatagtttaggatggcaaggcatcaatagtaatagcagtaaggctagtgatataagtatcgaaagtaatggcttgaacttgaacaaggataccagtgccgaatctaataaagatggaagtgataccgacgatacgggggataatactcatgataatgaaggcaactcatcttctagacaggatgctatgaaccgtcttttaaatccaaagtcagggtgtaaaggtgtttcatggtcgaatcgacagatggcttggcttgcattttggaaggaagataatcaaagaaggtcaaagacattttccgcaagaaagcttggattcgaagaggcccaaagaagagccatagagttcttgcgtcgtaagagagaggaggttcgcatgaagacacaagcgcatttatatgaagaactccctagagttggaacaaccattaattcatccaatgataattctggtattaaaactccaaatagacgtaactattctaactcgaatgctacaacggcaactccagcgactccaataactccattagagcttgaccaatattcaaatacggtacatcagtttattccgggatttgatgactcgacgcgcaatttgatagctggagcaaacccactatttagcacatcggggaatatattggcaaataacattccatcaatgattaatcacggcactactgtccaacaaaacgtcattcaatccaatattgggcagccaagtatactaacagctactgcggctgcagctgcagctgctcaccaaatgggattaccatttcatcttgctgcgctttcatccatagcaggaggtattccgattgatccctctatttctgctactgttgccgccgcaacaggcatgaaccttggtgttcaaactcctcaacaaagtcaagcaaactctattaataattttacacaagctgctttgatggctgcaaatcccttctttatgtttggtgcagcagcagcagcagcagcagcagcagtaggttctagcaatactcatatagggtctggtagctccaactctcatttcccttggcaacaattccaaaatactggaatcggacctctgattcagagtcaattacaagtagatatgagagatgcaccctttccccaatcaattagtaaccttgcctcaaacagacccgaacaaaagagtgataataaagatgactcttcagaagtgaacaaaaatcctttaatagaaaatgaagatgaacagaatcacagtaatgataagactttagtcggtgaatcaagaacggaagttatagctaacgatgtaaatgagtctttgatgggaaactttaaatcaacaccagaaattgaagatgacgtaagttcgatcaccaatttgtcggcacatgctcgaacactagatgtttataggcactga

SEQ ID NO: 3758 - DNA, 2250 bp, Cryptosporidium hominis
atgcctgagaaaggaggtgttgtcttaaaaattaaacatgcagcagaaaattataacgaagataaaaaagatggaaaaattgctgcaaagaagcaaatagagcttgaacacaatgcagcaaaagctattatgaacttgagacacagaagagattgtaatggagaagtcaccaggttttcttggtgtagcgacccattatgtagaatgtggtacgatatgactcaattttttggctttttgggagaagatattattgatacagatattgataatgcaattatttctgtagcagatggaggaagtggaatatatgaaaggttgatagttcttgggcacagaattcttgacgctacaggaaaggaatatgcagtaaaaaaatatatgaattcaggtatagatggcatgcctaaagaaattaataaaatagttggtgaatctaataaaaagttacttgtctttttaaaaatgcgttggttgagtaataatgtatgttctatagagtgcctttcaaaatttgcaaaacgatattgtcattattgtaaagcggaattgaattctgattcaaataaatgggacgatattaaattatctaagtatgtcaagttttgcatttcattttgtatttatggtcagggaataatagattggaacaacccactaaatattgaaaataaactttgccaaagattcccttggttagaggtattaataagaagtatggatatgagcatacttaatccttctatgcaggatgatggaaagttcctatcagctgaaggtataaggaatgcaaaaattttgggaattttacacaggcactttggatacaataggggaaaaaaagatattccccccagagttttatttgcattaaacacgcctgaagggtctcagttacctgaagaaaagactggacaaatgattttcagtcattacatcagccattatttcaaggcagtagcttctgagcatggctttactggaattgatatactacactgggtagagaaagaaaaaaatattttattacaaagtaatgctgtagaattatttgccttaatagacttggagctaggtgaggtttactctaatggtgtatcatcaaaaatagaggagaaattttcaagatatagagggttatttttttcattaattgcaaatatgtttgtactatgcgaagatgataagagtgcacaaatatggttgcaagagttagttacatgtgttaggcagatacaactttacataattgagttttgcgagtacagtaattcagagtccatgcaaaaagttaatagcattccccaaaatgaggttttcactatttcagaaacttcacttgatcatactcatgtccctgacatttttacagatttggagcctgaagaaataatatcatttattagtttacttgaaaaatgtaaatcaccagcaattgttgatgccttaaaagatgtaatatcaagttcaaaaaactgtgtcaatgcagttactgaaattgcctccattccacagaaatggttaaatgaagctatcattaaatttgcaaagttttctaagcatgaagcaaagaaaacagttaagaagtgtaataaacttagcttgtttagcgaatcttgcaatgtagaatcagatagtagcgaacaagagcaaccaacaaatacaaatttggagaagcacgacaaaaggagcaaggaaactacatcaagggatagtaaatgtaaaaattcaaataaagatatagactttaatttaaaaatagaaagttcgaaaaatatccactgtgcgaaggctttaggtccaattttaagacctgtgtcccttaaagcacgaaatgatgaacttggcctcgaaattcagccggtttctctaacatttattgatgaagaaggtaaccctgtacattatactttaactccaaactctagtgccattccaaatggaatagtaaagccgataggcgaaatagttaatgaaaatacaaaagataacgcaatgaaggaaaatgacaactcaacacctaaaaataaatcattacacgttttttcgagaaatattggtagaagcagatcgcctaatcaaagaaatttcaaaaaaaaggaacacggagtgtttatatgtggtgatttctccgaccatattgaggaaaataatcctataagagtttataaagaccaaagggattacatgaaatttagcggatataatacaaatgattttccaatcaacaatagttattatcattactaa

SEQ ID NO: 3759 - DNA, 1686 bp, Cryptosporidium hominis
atgagaaaatttaaactaatttatgaaccaaatgctttcataacaacctcttcaaaaaataaatttagcagatttaatcaaatattgaagcttttaaaaaattcttctcaatttatcatttctgaaaaaaaaacaggtttattttggatctcacataagaataaaggagattggcataaaacagataatttaatacctaaatattcaaacgataaggaccctaaaataagtataattacaaaagtaaaatcaatagaaaatcaccttgggtctatagaaacatcgaaaagagtagaaaaaaaagtgccaacaaatagcgcggttagattatttcatgtgagcaatatgataataaagctcctacttggatctgcgaaagaaacatatagcgattataaacagggaaatggattttcagtcaagggaaaaatattaggaaatgaaaatattgaaacagtaaatcaaacagtaaagttactaaggggggtagcacttaagtttgcacagtttattaatctaaataatattggtattcccattgagttatcgaatgcactcaatgatgcaaaaaaaaatgcgtttgcaattccaatctgccaagtacataaattaatggaattagagtttgggaatggttggaaggaaaacatttttgcctatttttgtgaaaatccctttgcagcagcttcaattggacaagtacatcatggaattcttaaagatggacagtctgtagctgtaaaaattcaatatcctaacataatgaaggctattttatcggacataaatctatttcaattgataaacagttattcccgaattttcccaaaagggctatttattaatgagctgatggctgaattaaaaaaagaattaatttctgaatgtaattatgaaaatgaacttttatttttgaaatattacagggaaaaaatcattcccactatgaatgtgtatgatttaaaagtgaatttttatataccaacagtatttaatcatctttctacaaaaaaaattttgacaacagaaaatatgaattcagaaaatacaattgaaatctcatctttgttccaagataatataaaaagcacatttggcttacaaaatactatggagttgaggaattcaatagcagagtcacttctttatttgacattacatgaactttttatttttagaacgcttcaaacagatccaaatcctgcaaatttcctggtggatttgaagaaaaatcgaataatactgctggattttggggcagtaagatcatattcagaggattttgttgatgactacattaacatgattagattcgcaattagtggatcagaacctgatatcattaaacaattcattaaaatgaaatttattttggggactgaaagtgaagaattcattaaattgcactgtaatgcaatcaaaatggtctctgaggtgttcaagtattctccatccccatttgacttctcaaaaagtgaaatagttgcaaatatttcaaaaattgtcccaaatatattgctaaaaagagaaacgccccctctttctgatttttattcactacacaggcgcatcgctggattctttataatttgcagtcgtctcggagcagcgataaactcacataaaatattcaatcaagtattggagaaatataatacgagaagagttaaatcaactcctaactag

SEQ ID NO: 3760 - DNA, 1641 bp, Cryptosporidium hominis
atggataagttggaaacccataagaaggcttataaaaagacctttgatgaccctagaaggaagcgtgaagaacagcaagcgcaaattcgaaaacaacaacgtgatgaacaacttagtaagagacgtcaaggaaacgatggtgaaaataatgatatatctatgggtatgaatatccaatcaggaaatatgtacggtgttgagcatattccggcattatctcagggaataatgagtcaagaattcagtactcagtttgaagcaacacaaggcttaagaaggctgctttctagagagcacaacccaccaattcaggcagttattgacgctggggtgatccctcgtttggttcattttttaagtgattatgaccacccaaatcttcagttcgaagctgcatggactttaacaaatatatcgtctggtactactgagcaaacttgtgaagttgttagacacggatcgattccaaaatgtgttgaacttttaaatagtccaaaacttgaagttaaagaacaagctatttggacgctcggtaatatagcgggtgattctgcaaattgccgtgatttagtattgagagcaggtgcgcttccaccaatcctacaattaattgcactagaaataggtccattggacaatagcgaacaaatgatgaatgtaaaatcaccgagtacagtaggtggcaaggttagtggtaagaccagcatactaaggacggcaacttggacggttaacaacctttgtagaggtaggccaccccccccattcgaaatggtgtctcactcactaccagtgctatgtagacttttatatttttctgacttggaagttatgacagatgcttgttgggcgcttagttatatctcagatgggcccaatgatcgtgttgaggcggtactaaggagcgaagcatgccccagacttgtagagcttttgggtcatccatcaccccttgttcagactcctgcacttaggtgtgttggaaatattgttacgggcgatgatagacaaactcaaatggttctatcatgcggagctgcgaagtaccttttacaacttttatcttctcccaagaaggtaattaggaaagaagcttgttggactgtgtcaaatattacagcaggaaacaaagaacaaatccaagaaattattgacaacggattaattgttccattagttaatctactaaacactgcagagttcgatgtgaaaaaggaagctgcatgggcgatttctaatgcgacaacaggaggcaccgtcgaacaaattgaatatttagttagccagggggtgatcaaacctctttgtgacttgctcagcattgaggatgcgaaggtaatcaacgtggctctagaggcaattgagaatattttaaagacaggtgcgataagacagcatgaacgtggtcttcaagaaaatccatattgcgcccttgtagaacaagcttatggactatctaggcttgagaagcttcaagaagctccttcaaaggctatttacgaaaaggcattccatattattgtttcctatttcccgtatgaatacgaagatgatcacgaagaaatctttgatacaattgaaagtgctgagccagaatttaagtataatcctgattcgaatgtagattttaaatttgagtaa

SEQ ID NO: 3761 - DNA, 243 bp, Cryptosporidium hominis
atgaaatgctctcctccaatgatatccagtagaaactcaaataataaattagctgaatcgctaagcaacgaagacaaactgaacatgttcactaatatcgaagcagactgcaccaataaagagagtggtaaaataacaattaaaaatactctcgaagaaaacgttaaccatatggtagttgaaatatcaaaaataggtgtgagcgcattaaacagcgcagattttactatcgagaggaggtaa

SEQ ID NO: 3762 - DNA, 1866 bp, Cryptosporidium hominis
atggagcaagaacgaagtaatgtgaaagataatgcattcttgtcagatgctacttcatcgaatatagtcgagcatgagaggcctgaagaaagatccaaatccgaggcaaatattgaggagctgccctataaccaaagatattctaaaattgagcctggaagtacttcatttgatgaatcaacttcttcttggtatcaactggctattcggtcaggatctaagaatatttcaggtgaagacatgaactctttattatatagcgatgaaggtgttttgggtggcttgttttcaacaagacgaccgagagatgcaatggcagggtttagcagcggaatgaagacagtggggaagggtgttgcagctggtgttgcaacattagtcgccgcacctgtggtcggagctgctaccgaaggtgtatctgggtttttcaaaggaatgggcgctggtttagttgcagcagttgcactacctgtaactgctgttggagttgccggataccaaatggcgaggggagtagcgaatactccagaggccataactgaaagtaataaggggaggaaatgggacaaaaaaaacagacagtggatcgaatattactattcgttagatgatgaaattcagcgacttaaggaaaaggaaataaaatattcacaaaaaaatgataattatgaaactggcgattataataaaaaagaatcaataaatttggattcaaaaaatgttgtagatacaacttattatgatttgttatctgtttcgccaaatgcagatgcagatgaaattcgacggcaatattacaggaaggcaaaacaataccatccagataaaaatcctgacgatgcagacgcaaaagataaatttcaaaagttgggcgaagcttatcaaatacttgctgatcctgaacgcaggaagagatatgatgaatatggaattggtgctacttatgatatgcccgttattgattcgaatttgatttttacaattttatttgggtctgatagtttagaaaagtatgtaggcaaactgaaaatggtttctcttgttgagattgccaccactaataatggccaaaatggtgctggaaattcaatagagatggagcaagcaattgagaacgaacaaaataaaagaacaattttacttgcaatagaaatgagaaagataattactcctatactggaagagtttgatgctgaaaaatcagttccaattgaaacttcagagattcttattaattggagagaatcgatttctcaagaagcaaaaagtttatgtaacaattcgttttgtgacgcaatggttgaggcaattggctggagttatgaaaattatggttctcaatacttaggaaaaatcgacacctttctcggaataggaggtaagtatgccaagtttcaagcaaagacaaggaatgttgcatctacttggaaaatggcttctactgcaattagaacagctatggcagctcaaagtctgcagtcgtccattaaaaaaaaatccagtggaactgcagaaaatgaacacacctatgaatctaatttggaacaagatgcagaggaatcagcaagaacacagcagcagttcgaagagacgttaccacttatattggatacaatgcttcagatcacaataatggacattgaagatacagtcaggacagttgctaagaaactagtgaaagatatgggagttgatctaaatacaagaaagcgaagggcactagctctcatagaacttggttcaatttttcaatctgtagcaaacgattcaaatcaacagagagaagaaaaaggcgataaaccggatgcaagaagaaaagttgaagaggcgttcattaaagctgctcaacaaagagatgaaaaatag

SEQ ID NO: 3763 - DNA, 1143 bp, Cryptosporidium hominis
atgagacaaacctatccacaaaacaaattagggatttttacaatacatttatctcaaactcagataatggtaagttctattattagctctttaatattagtattttgtaactataatgatatatatttatatattattaaatgccaaaataaatttgaattgattttatctcgacatcacacactaggattcatggatattcggaggtttagaatcgttttggggctactagatgatgggcttctttctcaaatgatttttaacgcaatggacactgataacaataacttgcttgatttttacgagtttggtagagcactagcgataatgatttccgataatttcgatgaaaaggcaaggttttcctacagggtaatcaagggagaaaattatatgaatttgagtgatggaatcacctttgagaagttattaaaatctattagggcaattgataatgctagatatatgcttgttgggccgcaaatattaaatttctcggatcaagaaattaaaaattttttcaacgactattcaacggtgaaagatgaacaaaatgaacccaaaatctactttgaaagttataaagcagctattcaagactccccagagtttctctcattttttggaataataaccccgaatattcttgaatcttatgacttagatattgaaaacaggaaatcgccgttaatattcgagggaattaatatttttaataggctaccaattgatagagttgggtataacgagtctattgaaaaggagtttacttctcgactgaagctacaggtctttaatattttagaggacattaaaaacattaaacaagagacaactgattcgcttaacactctagaaaaatggattcgtagcccaaatgaaaataatttattaaattgtatgctttttgatatcaataaaaacacaaatatgtttgaagctcaaaattttactgatactaatagcatagtacaaatatttaatcatgacatgctcttgcttaaaagtgtattgaataataatatcgagatgcttgattcaatttacaaaaaaagtatctattctttgcagaatatggtgccatcatctcaaatcgtaacatataacaattttaattggggaataataaaaaaaagtttataa

SEQ ID NO: 3764 - DNA, 789 bp, Cryptosporidium hominis
atgaaaatacttacagtaattgattcaatactaaccttcgtttggctaacttattggcaccttaagtcgttattgaatattgctccgtcattttggagattttgttataatgcttgcaattcactatttacaaagttacagtacacttctaacattgatgtctcatttatgaactatggctatgcaattaaaactcctcatagccctcctgaaaattcggagctagataaatttatcgagtctaaattggaaaagctaaagaaagagtccccgccaaactttaatgatgtttggaactcagtgcagctttatacagcagttctatctacttatgatgatgacttcaaaggtaaatccatcttagaggtaggctgcggaagaggaggaggctcagttgtagtttgcagtgttgctgagccgatgtcttatgctgggattgatatcagtgatcaggggattgaattatgcagacaaatatataggaatgatttgattcctgctggaaataaagtattttatgttggaagcagtatggaacttgaaaattactttgcgcctgaatcttttgatattgtgttgaatgttgaatctgctcactgttatccaaattttgacaagtttgtaaagggagtttttgacttacttaaaccaggtggaatgatgctctttgcagatatttcacccacaattgcttggccagatataaaggtaagcttgcaaaatattaaggaatcttcgttcaatactaaattaggatacaattgcaaatactggattccaaattattaa

SEQ ID NO: 3765 - DNA, 1833 bp, Cryptosporidium hominis
atgaatctttctcgtcctggatcatctaaagttagaacaaacgagcatttgaattttaatgtgaaaaacaaattaaatagaacaaagattacggtggttgtcagaaaacgacctcttactgataacgaaatctcaaggaatgatattgatgttgtagaggctgtatgcgacgaaaatactatttatgtccatgaattgaaaaccaaagtagattgtactaaatatatagacaagcattcatatacttttgatcgagtatatagtgagcaaatcaacaatagagaactatatgaagatattatacgtcctttaactgaaaacatctttaccccgggatttaaatgctcctgttttgcctatggccaaactggaagtggaaagacttatacaatgatgggaagtgaaaatacggcttattctaatagtttgcagaggagaactgaacgtgaacttggaattttcgaactagcagttaataatatttttgagcttcttgaacaaagcgaacatgaaaataaagaagtttatgtttcgtttttcgaaatctactgcgacaaactatatgatctacttaacaatcaaaagcttgtgagcgcaatggaaaacagtaaacgtgaagtagttgttaaggatctaactgaaagattgataaaaacccgggaggacttgttatctgtgatcagcaaaggattagaatatagaagaactgcccaaaatagtatgaatgatatgtcatccagatctcacgcaattctgcaaattgaaattagatccagaattttttctgtcacaaaagaatctactcttcaatctcccctttctccgaaattcattacatatgggaaaatggtatttattgacttggcaggaagtgagaggggtgcagacacagtgcatagcacaagacagacacaacaggatggagcagggattaatcgctctttacttgctctaaaggaatgcattcgagctctacatgaccaacaaagcagccatgttcctttcagacaatcagaattgaccaaggttttaaaagatgtatttgttggaaatgcacactctgttatgattgcaaatataggcccttgttactcttgttctgaacaaactttaaacactcttagatatgctcacagggttaaagaactgaggaaaaagtcagttaccagatcagatacttttcatagcgataaatactcttctaagcatccactttctagaaaaacaactgcgcctgcaaatatgtctaaaaaagatgcatcttccagtaatgaaagcccaagatcatgtactgaagaggaatttgaggaatctaatgctgatactgagtttagagaagatgatttcgaaattagccaggaaatgatcaaatacggaaatgttgtagagcgtaatttaagtcgatcgtctccaaacatgcctaatgaagagcatctgtcaatcagaaatgaatctccacaaatcgaaaaattatttggaagaagcagtatttttaacattcctggtattggcattgtcaataccgacacgattccggaggctgatctaaacaaattaaaaaaatatttgggtgaatactttattaaaaaacaagaagaacttgcatcaaaccatgcaacacatttgggtgtgttgtgtgagtgtttgaaggaagaatcgctaatactaaaagacttgttaaagaaaaactatagcagagagagctctaatgaatacatccaagaattaaaaagtttggttacgaggaagtcagaatctttggaaaacctaaaaaaagaattggtagaaatcgaagaactcatatcgattatggatactataggaatcaggtaa

SEQ ID NO: 3766 - DNA, 1122 bp, Cryptosporidium hominis
atgtcgctgttccagccgagtaatcaaatcaaactgaccaatgttgcagttgttcgctataagtctcatggaaaaagatttgaagttgcgtgctataaaaataaaattctgaattggagaagcggagtagaatgggatcttgatgaagttttacagattagaacaattttcgcaaatgtctcaaaaggccaagtggcgaattccgatgatttaaataccgtttttggaacaaacagcattgataatatttgcaaaactattttgagtaagggtgagattcaagtatcagaaacagaaagaagttatatgctagacaaacaatttaccgatatctgtcacatgctcaacagaatgactgttaatccaaaaaataacttgccactatccgtaaaaattatagaatctgaacttaaagattctggattttctgtatcattaaataaaacaactaaggagcaagcactaaaagcgtttgacatattaaaaaagcgtattcctgatcagattgaaagagctaaaatgatgctaaagttgtcggtagatattgtaaacaaacagaatataactaaaaagcttaatgaatttaatgtatttcctatctcatctgaagaaaaacataatacctatagcattacgtttctttgtgagccacgatattatcgagaaatagatcagttggattgcaaattactcttacttgactcaaatgtaaaaactattgacaaaaattcaaatttagataatccagaagctattcaacttgaactttctaacaaaagcgatatattgtttgattcaataactaccgaccccaggcatataattgataaaaaactagaaaaaacagaagttagtattaaagaaaatgcaaataaatttgtaaaaccgattgtctcgagtttgaatatagaagaaagcaaacgtgagattaagtctaacatgcttctttgtcgcaaatgtaatattcaattgatggatcataatgcgtttaagcaacattaccgatctgaatggcatatttttaataccaaaagaaatgcaagaaaaatggagccgattagtgaggaagaatttctagagcttcagcaagatataaagttgggatttcttgcagtagaatga

SEQ ID NO: 3767 - DNA, 1944 bp, Cryptosporidium hominis
atgcccgttgtatcagtaagtacaagagtgctttcttcttatttaaataaggaggtaaccagcgagtggttagatgaggtttgcttcaactttggtctggaattggattgcatagagttcgatgaggaaataaaagataatgtagcaaagattgaaatacctgcaaatagacctgatattctctgcttagaaggtcttgtaatcgcattaggttgttttataggaaactcaaatattcctttatttaatttgaaacccaagggaaatgatcaaaagatcattgtaaagagaaatgtagcaagagtacgaccctttattttatgcgcaatattaagagatcttagcttcaatgaagatatttataggagttttatcgattatcaagaaaaattacataataatatttgcagaaagagatctttggtatctattggtacccatgatcttgatatgatcgaagggccattttattatgatgcaaaagcacacagtgaaattaaatttgtacctttgattggctcagcggaggttgatggaaaccaactattagatttacttaacaaacatcagcagctaaaaaaatatgtctcactggtggaaaacgaaatatttttgcctgttgttaccgattctaatggaattgtattatcagttcctccactaataaatggtagtcaaagcaaaatcacattaaatacaaaaaacgtttttattgaagtaaccgcaacagactataatagagcatccatagtcttaaaccaaatcgtttcttctttctcaatgtattgtaaaaataaatttgagattgaacctgttaaggtagaatacgaacactcgacctatcctccatttccgcataaatacgaggttttagcaaatggtaattatcatgtggtaaccccgaatgtagagaggttagaatttgtggttaaagcatctgaagcatcaaatctacttggtatcaacccaattctagatccaatagttgctcagagtttgcttcgcaaaatgatgatagactcagaaataattaaagacaatgaatctttgaagtgttttgttccaattaacagatcagatatattgcatcctgttgatataattgaagatattggaatttcttttgggtttaataacattgagttgaaaaagtcacgtttttacgaacttgataaatcaaacttgatggcagaacaagttaagcgtgaactctctcttttaggaatttcggagtctttaaactgggctctttgcaaacactctgattgctttgaaagcttatttagaactgagaatattaagttaaagaatttattcgagagtgaggtacaatacaacttgaattgccctccagttgtagttaaggatgcaaaaacaagtgaatttgaaattttaagaacaacacttattcaatctttattgaaaacaattgcttctaacaaaagtttgcctcttccacaaaagatatttgaagtgggcgatgttgtaattttggataataatactccatccggatcaaggaatgataaacgagtggcaatagcatattgtaattcaagcggtagtgggcttgaggagattcacggatttttagaccaattactaagtaagctgggtcttgttgcagaatattcacttaatgaacccaattcaatacacccaaatattattggtatgtattcactttccgaagtcaatgacccctcttttctaccaactagaagtgttaaaattaccattcaaaaagtagaacttaatagctgtttaaagagtattgacattgaaaaaacaatgttaaataagcaagttgttattgggattatgggcgttgttcaccctaaagtattaaacaatttttctttgactctgccaacaagtgtgttagagctgagacttgagcctattatgcatttgtggccagatacatttttctatgatgaatag

SEQ ID NO: 3768 - DNA, 432 bp, Cryptosporidium hominis
atgccgaagaataaaggaaaaggaggtaaaaatcgtaggagagggaaaaatgacagtgagggagataagagagagttggtattcaaagaggaaggacaagaatatggccaggtccaaagaatgttgggaaacggacgacttgatgcgtattgctttgatggacagaaacgtctttgccacattaggggcaagatgagaaagaaagtttgggtaaatcctggtgatattgtattagtttcgctcagagactttcaagactcaaagggcgatattattctcaagtatactccagatgaggctagagcattgaaatctaaaggcgaaattcctgaaactacaaagatcaatgagtctgatattttcgaggatgggtacgatgaagttggaattgagtttgatgaaacagaaggagtagatatagaagatatttaa

SEQ ID NO: 3769 - DNA, 948 bp, Cryptosporidium hominis
atggaaatatttgaaaaaaaaatcaactttaatactctaccactcaataaagtaagaagatggatatcctcaaaaactgaacaaattcttggaaaagaagatgaaatatttatagattattgcattaatcaacttgtatataagattagaaagtctgcagcagaagaagaattacaaatatcgcctaatgagctcattaagaatattgaaggatttctaggtgaaagagcaattgaatttgtaagtgaattatgggaatatatatcaaaatttgcaggaaaccccattaaaattaagacaagcaaaaaccataactcaccaagaaatgttgcaataaaaaaaaatattttgcgctcaagtgatatatataatagagataaaaacagtctgatcacaaaaaattcaaacataaatgaaaagattgcatgctgtcacatttataaaggcaatgcaagctatataagtgcaatgaataatactgaagatagctcaaaattcattccattaacttctaggcattcaaaagaaaacaagagagctagatctcttagtagatcattatctccggatctatatgaatcatatggaattaaaagttataaatatgagaaaatacaaaaaatggaagaaaattcaattataggtggaataagtcgctcaaaagtttatacgaataaatcggaaaagaaaagcgaaaggttgtctaatataaacaaacatataacttccatagatgaaaaaccttctcccgatataaatccgttgaataattatcaagctgctctcgcggctctaacttctgaaaaaatggaagagtataatctgaggatgaaagcattagaactgtttaaaggaaaaaatcaagcaaaaaattttagatcagaatccgaagaaattctgcgagctcgtgctattgaaaaatttataaaaaagaaaccaaaaaattaa

SEQ ID NO: 3770 - DNA, 2664 bp, Cryptosporidium hominis
atgtattggattagatggttcatctttctatttatcatatattcttcaagtagagacgtggaaacaaaacctggaatttcggcatcacatggtaaaattattatttccagcacaaatcaccagtatgaccatagtcaagtatcttcaacttcaaatggagtaaatggaagaacattcatccatgataaaggtttaaataaccaaccaaggattgagcctccaatttctcccaagttgttgtgtccaaagggttacgatttggttgatgggagttgttttttttctcacattattcctgcaaacattgagtgtccggaggggtttgaagtacttaagacagaccttagtgtagaatgtatacacaaaaccttagtatctgcgcaattcaattgcaagaatggaactcctccaaaaatattggataataacgcatattgtccaacggaaataaccgagaacccatcaataaattgcccttcaggtacttttcagaaagaaaatcaatgcattattattgaatcaaaacctccaactttgaagtgtttggatggtttttctttggataacaattctaattgcaaacaagtcattgaattaaagcctttactaaactgccctccagatacagtattagaacaaacaacgatgacatgcgttacaaaagttattgtagaacctttggaggtatgcccacctggagcagtcccagtcaaatctaaagatctttcggacattaaagggttactgaacagaatagcaataaatgaagataataaatttaggaatttgcaagaaatccccacattggggtctcttgataaatacaaaaataatttatcttcagtcgaagataatataaataattctcaaaaagatagaagttcttttaattattttaatgatcagaagcataacaataacaagttagaaaataaagattttaataacgaaaataaaatcattaatcctggatcaggtaatattaatggccaaattaaattggcatctaatacctcaaataaaaataaaacaaataattcggattctgtttcaaatgtacgagaacagttttatgaaaatgagaggcctattggggtaaatcttggtcagattgatacattttatcaggcactgtatgattcaagtagagacttgaaaaataatggtggaataattaatgaatcattaattggagatgaaatagtatgtttagtacttcagtttacaagccctaaggtagagtgccctccaggacttagtcttggagaagatggaatttgcattcattcagatatattcacacctaaaaaaacttgtgaaggcggaatagagcctgatagtgataatatgtgcgtagtagaaaagttacttcccgcagaggttgaatgcccaaaaggttttaccttagaaattataacaggtatgtgtataaaaagagaaatagaagaacttatttgtccggaaggaacaatactaaatagatcctcactgaaatgcgaatctgatcccaaatgccccgaaggatttactttgaataactcaactatcagttgcgaatatgagaaatcagaacctcctcatcagaaatgtcctgaagggactgaatatgaagaatcttctagctcctgtaaggtgaaggacgcacagctaccactaatcatgtgcccagagggttatgagcaaagaggggatgattgcattttagataaaagaatccctgcttcttattactgcccatcagattattaccagacaaataaaaatgattgtgttaaatggtaccaggattacttgcttcaatgccctccatttttagacctcaaggatgagatatttgcttatagaaccgatctaattcctccgcctgcggctgggagaggacctgtccttccatatatggaatttggaagaagattacagaaaatttcttacgaaaactttaatcaattttcggaacaaagaaatatagatcaaactaaaaatgttacaaataggagtggggttgtcaatctcaaaaacgctaatagtataaattcaagaaaacaatatgatgagttaagttcatcaactcctattataataagaagttcaaaaactagagggatggtctgttttggatggggaaaaagatataaaatgattgtaaattgtcctgaaggaactactttgttaaatgagaaatgtattgaaaccaagttaacttcaccacaatttttctgcacaaaaggatatacatttaatgaacttgactcaacgtgtatatatgaagaaaaagttaatccgaacatagagtgtcctgcatatatgaatttaacgttcgctagtactggatcccctatttgtattggaagcaggagggaacctgcagaagtaaattgtcctgaaggatttgaatggttatccgagacactgaattgccaatcacaggaattttcacagccaagaattacatgtattaaagggtattcaattgtaaaagaaagtactggaactttttgtaaaagaactgattcgatcaagcccacacctagctgcccaccagaatatagatacgacgacttgaataaaatttgtatttacgaagtaaaacttcatgaagtgagagaacgagatgaaaacttaagaaattcaattacaaacattagaacaaatctgaatttataa

SEQ ID NO: 3771 - DNA, 1797 bp, Cryptosporidium hominis
atgttaaatttattaaataaatttgttgaacaattaaattatggaaaatgcgacataaataggctaatctctgatgaaaaaattaaacagcccataaagggctattttatagctaggggaatgattgagtattttcaagagcaagaactattcatctcaaatgaggaatttgaccatggaagccctgcaagttctgatattttttacggttgcaataatttggctcgaaagaaccaaaggaacggcaacagctatagcttcagaaacgtatacagatttgtgccaattccgttcgaaaatagattacattggaatcacaactttgtagaaaaggaaaacgatcaagactatttttcaaatgtttatcacaagtttgatgaatgtatggtaaagacttacgattttaccgtagaattacctgagtgcatttctttaattgaagttgaaactagaaaggctttctttgattacatgattggcactacaagtaaattaaagattaatcaaggaactacaaacaaactaaaaattaatgaacttttagaaatattaactaccgttgaaatccaagatttagacaatttcgagtatttatctgagatggaagagaagctatacaataacaaattaatcaaattaagccaaagaactcaaagaaaacttgtgctacacgtcatttcttttaagcgtatatcaaacttttcttcgattttctgcaaggaaatagaatattatgggtttcttggggagttttattctccatctagaacttgcaagcttcttgaaagattagtaaaatataaatgccctaatttaaatggtatttcagacttatacaatatctctattgaacatattgctaatgaaatttgtgatggaaactatttattatccgagtatattttgttatgtatatgtagtaggcaaaagttagagtttaaggcatatgaagaaaatatctcagactgtatttcaaaattacctcagattgtattgcatatatctatgtgtaataaagagtttgttgaaaggctaaattcatttttgttgaaccatttgccaagattaaattggataaatgtcgatatttcaaccctgaataatggtcgtttaaccccatattttgatgttgaagaggacagatttgttacgggaattcttcaagttccacttttgagaaacttaatcgtaattaatgaaacttctcttgaagatggaaaattgtctgaaaaaggcttagaaaatatttccaatatttcattactgactaattttggatatgtgaactatggttttacgaactataaagtcccgataaagactgaatcaaactacatcattttaactagtaatgaaaagagtatttttgcaaataaaagtaatctttcgattagtttgaatgccaaatatgctgaagaaaataatggtattttgaatccccagaataaatctggaaacgtggttccaaattgttctgaagcaaacttctcctttgttttaaaattgtttatttctattgtaggcagttgtgttgatatgttagaatttgatgagcaaacacaagattatattgcggaaacatttgtgaacattaggcaaacatcaaatatttgcaatttaattcatgcaacttcattgcatacttggattatgcttgcgagagtccaagctctaatgaatggtgaggaaaagctttcaaaaaatagatttgaacaattttttagattggaaatagaaagattagaaaaattatctaaaaatggaaaaaaaaaatcctatcttgaattaattttataa

SEQ ID NO: 3772 - DNA, 990 bp, Cryptosporidium hominis
atggttagaaataaggagacaaatgctgctaataagccccaatataatcgaccattaccttccgatggccgaggacctccaagaaaacactttcgtgtatgcgtttttaacttagatgataacgcttcgtggagagatctcaaagactatgggaggcagataggcgaagtcaattactcggcagtcttccattatcaagggcagaaagttggagttgtagagtatctaactgttgaggaaatgaagagggcactagaagagatacctaatctaccatttctgggaaaatctatccgcgtggaagaagatattgggcagcttgaccgtgaacttgcagctgcaaacgggtatggcgctaagagaagatcaccgcctccattttcatcagggccctataatacgggaggtagagctcgcggaagatacccttcgccttcaaggtttagaatgcgcagcaggtctcccagacgcgatccatatgatagacgtgaacgctctcatcactatcctgatgaccgatatcgtagagggtatgaagaccgtattccaccaccaagggaggactactataggagggatgaagtaaggggcggatacccgggagagagataccccccacccccatatgaagaccctagagaaagatatatgcatgggtctgaacgctttgatgacaggtatccagggagagcggttccgtttgataggagaagcccatctcgcagtggaataggagttgggccaattggtgggaatggtagtatgaacgtacaaaggagtggtcattatggaggctccactagaggctactacagagatgatgatcgcgatcgagagcgtgatcgggagcgtgatcgcagatcagccaatgatcaatattccaactcttattatttaagggatgatagagatcctccaggttctagaccatcgggtggatacgtatctagtggagttccatctggtggccgtccgaacgttgcatattaa

SEQ ID NO: 3773 - DNA, 4020 bp, Cryptosporidium hominis
atggatccactcatttttgatctagaggagagccttaaatcattatctcttaaaaaagagtcatatttggaagcatatcaaagctttttaattattaaagagtcaattctttccagaaatggattttgtacggtccctatatttattaacctgacttttgaagcaattgaaaacattctttcaggaaataaactagataatatttactacgcgaacgcagatgtgaaaacacttactggcctattaactctacaaaagagaatcttgggaactttagatgtgaacattttaggaaccaattatttagctatttcgcaagtaattattaatcgattagttggcattttagttttaatttcaaaaaacggtcaggcaaaaattgaattgaatcaagccacttctatattgaaacaattctgctcagcctttgatagtatccaactaagccccaaaacgtttataaatttaatggaaattcttctagagagccgtatctctgaaaaacaaaagattcagatccagatttgtattattgatttattaaaactggttcaagataactcactcattctactttctattcataaattagcattacattatttatccattcatggacaaaggcagttggatgtatccaaggggtttgctttagaatataatgaacaaatcttaatcccaataaatcaactatatttttcactggttaatttccttgatcagagtcaaatcaaggaatatttaaataccttgttacagctctgtactttgaaacaatacagatttttctcaatttatgctttaaaatgcttgaaaaatcaagtaaatttattagacaaactaaaatttgagtccaggcacatttggattcccttatatacacttgaacatcttacctgtgactttaaagaagtaagggatgctgtgttgatacaaacttatttagaaacttgtattaactgtttgaaatacgtattatttgacacttttgaaaaagatattcaacagatgggtatagatgccttaattgatacattcattcactctttaaagcagtttatgtttacaactgataacgctattcactcaacagttataaactctttaatagatctatttttaagggcgaaggaaagtataacagaataccctgaattagaaaaaagcattgaaaaatatgctttattcgagctaataataacaaaattactacctctttgttcatcaatgttagatgactatagatataaactttcattgccagaactcttaaggcttctgataatcatgattgagtcatgggatgaattagtaatcatttactattattacaatacaatagaactattgagaattaaaaggagccgtgggatagagttatttcaagaggtaatttgcaaaactttagatatggcgtcagttgcattatgtggtatctcgaattatttatcttttgaatataaagacctttcaaatctaaaggaagaacttaggcgaattgtagggtcgattacaagagcattcggcccaaatttagtattaaagaaaaggcctttatcatttgataatgttgaattagcagatcataattttgcaataaagagcaattcttggttactccctctactcagagttcatattaatagaacagaactttctttttttattgagaatctcctcccaatagcactaaagctcaataaatattgttccaaatacaaagatgcagaacctaattatgctagactttatagtattcttgaagaacaagtttgggctttgcttcctgggttctttgatgaaccacttgattttattgagacatttggaaatagggatggaaacctaaggtcgtatatgatacaattattggaaagacctggtttgagagaccatatatgtaatgcccttttaagaatttctaggcaaacttttattggccgcggtctctcaaatgataatgaagatgaactctactatgcaaaaaaaatgagtaatattgacaatagaaaatattatgttgcaatgaagacttggaaagaaaacacaaaagctttaaatatgcattcaaatacatttttgtcgcttttgatagtcagattcttaaactgtaattcagaaaacgctagagaaagccaggtaaatataataaaagaacaagaatctcaacattatttaatttgcatccaaaaccttgtgccattttgcgatgagtctgttttacaaaagaacttaaagaacttttatatcgtttgggaaaatctcgctcaaggcgtagaatcctcgagattaccactttcatgtggcaaaattattgcactattagacgtcgcaataattatgtttaaacgcattagttttgataaggtcaattcaatcctttcttattttcttcggttattaaaagttttattaacgcgtgaatctaagaattacttcaatgaaagatctcaattactaagaaggctttacaaaggactcaaagtgggccttgagactcttagagatcgtactagtacgcctttaggtttaaaggatcagctttcagaaatatggaaaatcataacattggacagtggaaaatgcccagttaattctttgaaacacagattgagttgcttaagagtatttctgcagttaattaaaaaaatagatgaaaaagagtttgctctatattttggaaaggatcaaattattaaccatttaattccagaaattttatttagtattagagaaccaaattttactgtgagaataaatgcaattactttattaaaatccttaatagaatgctgcattgaaaatgatcaattattggagattattatcgtaaaaatgatcacactttctcaaattaacactggccaaattaataatgattacatagaaatttcatgtataatctcattatctagaataatttttgattatggagatgtaatacagaatcgtttgcaaactcatggcaattcgattttgcaattaataatcaatttcatcgttcattcactaaataacgccaatccattaatttattttaatagcctaaaatgcattcgaatatttcttttacgcctaaacgctgatttaatgtggaactatactcagaatattatttcaaatatactgaataaccaatgttctttaaaattccgtatttatgttagaaaagtcctaatctcattaattaaaaggtttggagcggaaaagacttttcaagtatttcctcttgagcacaatcagttatatagatatctaataagggaaatgaataaaacatccaggaaaaaagcacgaaaaaataatcaagatatatttaataacatatgcgacgaagttgatgagctcgaaacgaaggaatcgatctttaaagaccaagaattcttccataacattgaatacgacgatataatttcaagtgatgaggactcagaaagtagaaagaagagttcctttggaatcaaaacgagttacaactctcaaataaaacacagcacttcgaattatcataaagatacaagtaaatctcttacaattattgacgatggctacggaaattttgttaacccaacagatttattaagttcagaagcgtcatctagaattctgtgcactatctcaaacaaaataactaacaggcattgcaacgatgatgacggaactgtagaattcgataaagttttgaataaagttattgtcaatgaaaaatccaggccagcaaatattgatattaacaaaagtccagaattaaactttagtccattaaaatgcgaaggtattaaattttataaaagaacgtccactaaaaagaatgataatcaaaagaaaagaaggcaacatataactgttaaaagtgcgaaagaattcaaaagtaagaatgcacaaggcgatatagcaaaaaatggaatgcagccattcgcatatttgagacttaatccggcactgtcgaaagaaaaacacaaactaagtgcaaccaagtccatttcaaccgttttcaaaaaaaaagtagaaattaggtaa

SEQ ID NO: 3774 - DNA, 1092 bp, Cryptosporidium hominis
atgcctaagctgcacgggagaagaaaaaaaacaaaaactcataaaaaggaacttgtcgaggaggaacttaagtctattccaaaatgttttgtattaagaaagggcaaagttgttaagcagttaaaaggtttagtaatggacttaagatatcttatgtctccctggagcgcaattaaattgcaggagaataagcacaacaagatcaaggattttgtcagtattgcaggcccattggggatatcacatattcttgcagtaagccaaactgcttcaggtgcctatatcagattaattgtattgccttctgggccaacagcaacatttaagatcgaagatttcagcctaatgcacgatattagatcttcacaaaaaaggcctagaagttgcagttcggattatttaacatctccattactcgtattaaatgggatcaagaatctgccttcaaacgactctgctaaccccatacctttaaatttacttcaaacaatgataaatgggatgtttcctgcaatagatttgacaaaaatacggataagatcttgtaaaagagttgttcttatcgaatattgtaaagatagtgaattatttgaactaagacattatgcaattatacgccgtccagctggagtttcaaagccaattaagaaattactattaaaaacaaaagaccagaaactttactctatagggagaggggatgatatggcagattatgttttgtcttcagaaaatggagcttgcgcctcagatagcgaagttgatgatgaagtagaggtaaagatacccacttcaagtgggaaccgcgatgaaaatcaaatgggtttgtcggaaagaagtggtatttatacaggaaaagtttctgtctcattaaaagagttaggtcctagaatatcaatgagattggttaaggtagtcgatgaagtttgtgatggggctgttatttatcatcgttttgttagaaagagcaaggacgaaataaaagaattagaaaaaagggaaatattattaaaagaaagaagaaaagaggaaaattccctattgaatagctataatgaagacaataattcatgtagaggcacatgtgagtaa

SEQ ID NO: 3775 - DNA, 1002 bp, Cryptosporidium hominis
atgcttctaaacaccattgtaaaatgcttcaaacgacatatattaatttcgccgcaatactcagcttttcttgtaaataacttagatctcaggtttctttactcgcgtttctattacgacttccagcggaagctaaatcgagataaatactttattttgcttaataacaactttagaaattttcacaatttaaatcaaagtgtatcaaagctcaacttatacaggattattactaaaaatctacttggaataggaattacaatgtattttgggtattttgttgctaagaaaaggtcaatacgtctttccgatatatgcaataaattcgagagatttaatgattggagctatgacttattgcaaaaccaaattaataggttcgttccacctgatgatgagcctctgttacccgacttcgaacagttgggatacccaagaaatttacctactcttgtgcttggtctacgtgggttaatatgtgaaattacccattctaaaaaaaatggttggggaattgtaaaaaggcctggcgtagataagttttttaatatacttaaaaattattatgaaattgtgatttggagtgatgaatcattcccaattcctcatgaagttctggaaaaatggaatttacccataattgggatcttgaacaaaaaccacttttcaaagactaatggtaagctattcaaaaacttaaatcgtcttggaagaaacctaaatagagtaattcttgttgataatgaatcgtattctgcaaatattcaatacgataactctatcgtgctccctatatttaaaggtgatccatatgacaacgaactcaactcaattattgacttattaaaggcagcagccttacaaccaggtgacataagggaatatttaaagagattcaggtgtaatgatacaaatattgtagatcagtttaacaaatacagaaaaactgtttcagaaaagagtgaattacgcagaaaatttggtaaattttttttgaaataa

SEQ ID NO: 3776 - DNA, 975 bp, Cryptosporidium hominis
atgtcaactctggatacttactcgaggagctatgatgatcttttggttcatcaattaatgcttcaagatgtggagagagtagaagcttataaacgatcattcgaggaaaacaaagagttgttcaaaggaaaaatagtgttagatgtgggatgtggaacaggaatattgtctatgcttgcagcaaaatgcggagctaaagcagtatatgctgtagatgggagcaatatatcatttctagcaaaaacaatcgtagaagataatgaactatcagaggttgtgaaagtcattcatggggttatagaagaaattgagctccctgtaaatcaagttgacatcattgtttctgaatggatgggtttctatctgttacatgaaggaatgcttgacagtgtaatttttgcaagagacaaatggcttaattctaagcatggcgtaattttccctgaaaaagcgtcgttatatgtatcattagtagaaattgaagatttttggtataaaaacattgaaggaataaataatattcaaggatttgattactcttcaatgaggaggataatacattctagttacttgaagtcgcctttgatacttggcgtagaaccaaaaaacgttgaaaacttttcctttgcgcgtatattaagtttggatctcttaaaaataaacatcaatgatcttgatattattaaatcacagtttactcttaaagtaaaaaaagatacagaattcgtccatggctttatagtatggttcgatatagaattccctgctcacaactctaataccactatactttccacatcaccttataacaaacctacgcattggaagcagacaataatattatttcaagattgtatagaagcaaaagcaggactaaatttaaaatgtctttcaaagctcgagaggtgtgttaatgaaagtaaaaggtgttatactatttctattgaagtccaagatgcaagtattgagttttaa

SEQ ID NO: 3777 - DNA, 2811 bp, Cryptosporidium hominis
atgggcaatttattcggaaagtgtggctgtagggatttgacaatatgtaacctaaatgtattaagacctgctcactctcaggatcgtatttatcgcaaagaatataaagttccaaattttttaattgatcatgttaacttggatattaatataaaagacgacgtaactgttgtttcttcagtaataatcatgagaagaaatccaaattcatcttttagaggtgacttatcattggatggcgattgcttgaaacttgtttcagtaaaactgaacggcataattttagaaaagagtctgtataagggttactttcaacccgatggccctgatggtaagcttgttatttcaagtaatttattaccaaataaagatcagcagtttacactcgagacagttgttgaaatttttcctgataaaaataccaagaatatgggattgtattattctgcaggagtttattccacgcagtgcgaatcggatggcttcagaaggataacatttttcttagatagacccgacgtaatgtgtaagtttagggttagaattgaaggagataaaactaaatctcccgtattgttatcaaatggaaatttgctagaaaaaggtgacgttcagggctctgaaaatcggcactttgccatatttgtggatccttttcccaaaccttgttatctttttgcggttgttgctggagttttgggaagattggaggacaagtttataacaaagtctggaaagactgtcaggctttttgtgtacagtgagcccaaatatgtagataggttgagattggcaatggagtccttgaagctagcaatgaaatgggatgaagaccgctttggcttggaatatgatcttgaaatttttaatattgtagcagttgagtctttcaattttggtgcaatggaaaataagagcttgaacatttttaactgctcttgtcttctagcatcagagaatatcacccctgactattttttcacaaacatcctttcaacagttgggcatgagtactttcataactacacaggtaatagagttacgtgtagagattggttccaacttactttgaaagaaggtttgacagtctatagagaccaagagttttctcgtgactgtattgataggttatctgaacagttaggagacatagaggtgttgcgcaactaccagttccaggaagactcggggccgcttgcacatcctattaggccagattccattgtttcaacaaataatttatatacaagcacagtatataggaagggggcagaagttgtaaggatgtatgagactatccttggtcgtgagggattccgcaaaggtattgatctttactttgctcgccatgatggccaggcagtcacttgtgatgacttcagaaaagctatggaagacgctaataattataatttcacacaatttgagcgctggtacgaccaagctggcacacctgaagttgaggttgtttctattgatcacaacaaagcggagggaacatgttcaattacacttcgacaacgctgtagtcctactccagagcaacctaaaaaaagaccattttatattccagttatagtggggctaattggaaaggattcatgcaaagaaataagacagtcggaaacactaattctcaaagaacagcaacagacatttattctagatggagtttgggagacaccagttgcatcgatccttaggggtttctcagcgccagtaaatttaaggtttaaaacacctcgttcagatgaggagttggcatttctttttgcatttgatacagacgaatataatcgttttgatgcagctcaaacattatataaaaaaattctgatccaagcatctaccaactcttcacaagaaatttcgcctagttcggtaatagagagcattctttcacaaactattctcagttgttttgaatcgtttatttcaaaaattaagacgtctaaaaatccaaatggtactgtttctccaatggttgcgtcatacacgcttagaatcccgagttattcccaagttttggcttctattgcagaaccaaacttcgattttgttgtcgagtcttttaatgcattaacaattgcctttgcatcgaagtttaagactcaaatagtagatttattccaagttcttactgaagatttgtcggcgttgccttctcagagcccattcattcatggcaaaggtgtaaatgttgaagctattgcaatccgtagattattaaatattttactagactttattgcaaaacttgatcctagccttggcactaaattggcttttgagcaacacaatcgttttgattatatgacaagtaagcttggtgcaatatcagcactacaaatagcagatcataaatccagtgaatgtattcaagctttggattctttgttacttgcaacttcagatgacgtttcgaccttgaatcaatatttctccattcaggcaagttgtcttatccctgataatgttgagcgtgtaataaatatttactattctaacccacaatttattaaacatcgtgaaaacccaacaatcttctcctctttggttggcacttttgcatcgaattttgttgcgttcaacaggaaagatgggcttgggtattcttttgttgcagatgcgataattttaatggataaagtaaacccaatgtcagctgcgtctgtttcgagagcatttacaaaggtcttgaaacttgatgagggaagacgcaatcttcttaaggagaatgtcgttagaatacttcaatcccccggtttatcgaaagatacgtctgaaatcctaaattccatcgatttttga

SEQ ID NO: 3778 - DNA, 2796 bp, Cryptosporidium hominis
atgttgtcttcctggaagtatgatgtaacaaaatgccgggaagtgttgtctattttgagacaggctgattcttctgatagtagtgtacaactccaagtaactaatgccttgaattcctttgtaataaatagccctgatgcaccatgttactttgctcttatattttctggtatgaatagtgagggtttagatgtgcgtcagagggcagggcttttattaaagaactatcttgtacaatatggaataccttcttcttctgaatatatagactatctcaaagttacatctcttaatgcattaaatgactcccagaggttaatcagatctactgctggtacaattgttaccacatttgttaatacagaacaaggaaaacctttactggtagaatctcttcgccatttgtctcagttgttagatatggccacaaatgatagcattgatggtgcatttgattgtcttataaaaatatgcgaagatgagttggagtcttgtttgggtgaaaattcaggtatattggagcatactcacccaagactcatttcttttcttgacgcgtcaagacaattaatattacccaagctttttcaaatatctcagggtgagcatttaatactaagtaagaatgagactgcagtacatcttagtttcaagtgcatcactttatatgctcaatatcacctttttagttctggtaatgctctacatgattttttcacgcaatattggcaagtaattggtattttggcaaaacaggaaagtaggcagataagactactatctataatgggaattattacaattttggaggatgaccctggagtgatccttgacggagcaggagttaatataattattgattttgtattgtgctgttgcgaagagaccagcggtgattcatataatctacggcttgaaagttttgagttttggccattgtatcttagaaatgaaaagggaataaatattcttagaccatttctacctcgactactcatttgcttacttgaaaattctatatttacagattttgattatattgaaatggacccttctcattttgaggacaaaactgaagatgaccttcactctataggccctaggtttcatcagggacgcacggataactctgaatcaaacgatgacgaggtagagctcggagcatggggaaaccaatggacagtaagaaaagcctcagctcttgcgctggaccacatatcggtaatatacggagatgaaattttgggagagctattgcctaaaattgaagcaactctccaagatcccaactgggagaagcaggagagtgcaattttggtcttaggcgctattgctagaggttgtattaaagggctatcaccatttttacctagagtcttgagttatttggttaaacttacatcaaattctaagccactgatcaggagcatttcgtgttggtgcatctcaagattcacaccttggttagcgcttcagcaaggccaaccaattcttaatagcgcttttggtgcgctattagctagaatgcttgatcctaataaacgtgttgaagaggcagcttgctctgctacagctacatttattgaggattctgctcaatcactttctcttataccattccttgatgacattgtgaatactatatctggggcactgaccgtatatcaatataggaacttgcttattttatgtgacaccatttctacattatgtttttcagttggtcccaatgtatttagcccaacatttgaaaatagcctggtcccacttcttattacaaaatggaaatcgtttcctatagaccatccatgtttagttgcttcgatggatgcaatcgcaaaaatttttgctgtagtagggaacaaggcatctggatttgcagattcaatattgcaacactgtattcaaaacattctaatgtcagctctaaataatttaaagaattcagaagaagtttcatattcagtacctgacactgccgaatgcgctctagacttggttagttcgatcgtagaagcagtgagggagcctaccatcccaacattgaaaagatatgggtttgccaactacattctcatattttgccaagatgaaagttatccaaatataaaacaaagtgtatttgcttgtgtaggggatatagctaagtttggaggagacaacttggattttttaaagcctttattacctacattactgcaacttttagtgttaaatctttcaagtcccaatattggtatagctaacaacgcagcctgggccataggagaaattgctatgtatggaaatctcccagagattttcacagttattgaaccttttttagaacatataattgacatgctcgtttccagaataaccacgtcttgtaattcatcttcacacatagataaccttgcaattaatgcatgtattactatcggtagagttgcagtggtggcaccttcgagggttggaggaagactaggggtttgtgctgatcggttttttttggtactaactaatgttcgtaacgatcaagaaaaaattaatgcagttcaaggaatttgctttgctattcaaaccaatccaacttcactgagtgcctctagtatcaattcattttttgacttgttaaattctatgcagccagctctagactcaaaatcgagcttttcagagaatattcttcctattctacaaagcacactaaagtccatttatttggggcttgccgataaaaacacatttttacagattgtcaaatcccacaatggctatgttcagactctagtaacatcgtttttaagcagttaa

SEQ ID NO: 3779 - DNA, 564 bp, Cryptosporidium hominis
atggttagatatgctgtaagacctgatactccttccaagagtgtaatgtgcaaaggtagcgatcttcgcgttagttacaagaatacatatgagacagcaacagccatcaagggaatgtatctacttgatgctcgccaatatctattggatgtaattgcaaagaaaaggtgcgttccattcaggagattcaatggaggtgttggtaggactgcgaaggcaaatgaattcaagcttactcaaggaagatttccggagaagtcatgtagattccttctagatcttttacaaaatgcagagagtaactgcgacatgaaaggcttggatgttgaccgtcttatgctcgtctctgttgtagttacccatgctccattcaatagaagaaggacctttagagctcatggacgtattactcctttcaaaagccaaccatgcaatatccagcttatttttaaggagatagacgatactgttgaacaaccaaagaatattgaagggcagaaagttgtcaaacttacaaagaaacaattagctcgcagaaaattacgtgtaggttcaaaaaattag

SEQ ID NO: 3780 - DNA, 1689 bp, Cryptosporidium hominis
atgactaagataaatacaacatacagaaactcgtcgggaaaatattactatttcacgactgcaataaactatacgaatggaacaccacatatggggcacgcatatgaaatagtaacttctgatattcttgttagaattgcaaggctattcggctttaatacaagatttcaaacaggaactgatgaacatgggcaaaaaattgcagctactgcagaaaaaaaaggcatatctccaaaagaactttgcgatgaaaatgtaaaacaatttaaaaatatgaatgaaaaacttcagattagtacggacaggtttattagaacaactgatactgatcattatgaatcatgtaaggagttatggagacgttgtgaggcgaaaggagacatttaccttggaaagtataatggatggtataacgtaagagaagaaagttttatgactgaattagaagcaaaaatgctaaattatactgacccaatttcgggattacctttaacaaagatggaagaaccttcgtactttttcagaataactaattatcttgaatcaataaaaaaccacattattgacaatccagaatttatacagccggaatcgagtagagaaagtatattagcaaggttagaggctcttggcagcaattctgaggacttatctataagtagagctagtttttcctggggagttcccgttccaaatgaccaggaacatgttatgtatgtttggtttgatgctctaacaaattatattactggtttgaaatgggctgattttgataatgatcttgaggaaaattcgttatttaacaagtattgggaaaatacagttcatatcgttggtaaagatattacttggttccattccgtaatctggcctgcgatgctattaagtgtcggacttagcttgccaaaaacaatttttgctcatggatttgttaccgcacccgacggtaaaaaaatgagcaagagcttggggaatgttgttgatccattcgaacaaattgataaaatgggttctgatccatttagatattacttggctagagaagggagatttgggaatgatattaaatatcaaccttcttccgttttagactataataatggtgaattagctgatacttatgggaatcttatttcaagaattacaaatttaactcacaaattttgccagggagttgcgccttctttatctcaatctttattgttggataaaccagtagatattgataaagttttcgaagaatattatttggcttggcattgtttccgtattgatgagtgcacgcaaatagcaatggatttgtcgaggaatgttaataagttccttactgaccacgcaccttggaacaaagataatggcaagtctgatgaagagaggatagaaattattagaatcgtattggaaggttcctactatatttcaattctgcttagtccatttattactttggcatgtaaggaggttttcaatagacttggaactccagagaaaataatcccagaagttgatataaactataataacattaaacctggcacgccaatattgatcggtgaacctctatttaagagaattgtgaataaggaagaaaagacattcgaagagcttaaagcagagaaaaaagaaagagagaaacaaagaagatcaggaaataagaaattaagtgaaactaaagataagggaaaatag

SEQ ID NO: 3781 - DNA, 1314 bp, Cryptosporidium hominis
atggataataatttaggtatttataaaaggtatgtctcctattacatccataaaaaacagcatgtggctcttcgtagcctgacacaaaataccggcaaggctaactttagcaacaaaacaatttgcaaaatcatgttggttaaagaaagaataaacatctggtgtagaaaatatttgaatattcaaccgctatttagaacccaggacaatgtaataatatcttctcctgtaactgaaagctcactaagaagcatttacggaagaactactccaaatatcacaccgagcagtcactccgactatgtttcaggaataaatcagctttcgaataatcctctcataaacaatatgccccagcaagagcatgcttcagatgattctctcatgcaactagtatgtaattacccagagaaagctatttggtttctttcgtgcaatttattaattggaatgatctctttcatttctcttggattaatttcgacgggcttaacacttaagaattggagatcagatttcaacaatagcccttttctatgtatctggttattaattcatgggtctcttcaaatgttacagggaatattcaggttttactacaaaattatactagagagagaaagaatgaattcgaatagtacaagagtaattcaaattttacaagcagttaggcgactaaccacaaatagagcatggaaaataggtaaagtattatcgtttatatattatacttggtttatgtttggattttattggatcttatcagtaagaccaaacgttgaagcattttcaggtcaatcaagaaagtttgtaggaggtcttaacgattcacaattggcagattactcattgattactggccatagatcatacctattgctgggaaacggttcattatactcactaaaggaccttattaaagttgactgtagatctggaatatggcccctatatttaattataatgctcatatgtacattcaggataatatttatggtcagcttcttctactttatatttcctactgttgtttcaagtgagtattctgataataaattaagagcgtgtacaattaacaagctcgaatcccttcctgtgaagacatattctgaatggaaaaaattaaaagaaaatgaattaatgcttaacaagcattcatttctacaggataattgtatcatttgtttaaatgacttctcatcatttgaaatggctcgttgccttccttgtaaccatgttttccacgatgactgtattgacatgtggctactcagaaacgcagtttgtcctttatgccaagcatccttaaaataa

SEQ ID NO: 3782 - DNA, 408 bp, Cryptosporidium hominis
atgtctccaagagtgacttatcgcagaaagtgccgttacaataccccatctaacagagttcgtgttgtaaagactccaggcggtagaaacttgattcaaaatatcggaaaagtatattcgagacctaaatgtggtgattgcaaaaagcctttggcagggattccggcatgtgccccatatgaaatgaaacaccttaaaaaacgcgagagaactgttgcccgtgcatatggaggaactaaatgcccaatgtgtgttaggcagagaatcctaagagcattcttgcttgaggaacaaaaagttgtaaagagtgtaattgcagagaaagagcaacagaaaaagagtgaagagaagccaaaggttaacaagaagtccgcaggaagtaagcaagcctcatccaagaggaagtga

SEQ ID NO: 3783 - DNA, 960 bp, Cryptosporidium hominis
atgcaaggttatagcggactttcttttggaataaataatgtgaaaaaagtgcccatctctcaggcaaacccagttcagctttcaaatattctcttaaatgtgcgttataaagcattttcagagctaagcaacaaagtgtattcataccaatcggattaccaatatcaatataaatactatttagcaaaattatcacgttatgaagctttagaacacagcattacactcaaactatgctcaatgttacctgaagtcaggcgaaggatagacttgggttcgagtctaatattacaaaattactctgatgaggaaatatattattcgcattacccagtcccacataatatatttatggatgagatacctattttcaaggaatttactttttttctttcattgagaagatctttgttggaactcaggaaaaaaatttggagactttacagtataatagaaaccaagagttcagtaataaagctttgggagattgaataccaagaagcgatacaggaaaaggctgaaaatgaatatatttataacttaacatccaatgattttggaagaaacattaaggactatgctgaaagactcaagcaaaaaagatttaccgagttcagaagagctaaagagatgattgttttgaataatctagagaatagaaataatgaagagctcgagaagatatacagcgacgacgaaaacgatcgtattcggaaagatgatggctgtttgatcttaccaattagcaagagaagggttggccttcattgttcaatcaaatcagaaagtccaaacatggcatatagacaaagaatcaccaataaaaattcgtctaaaaaagggaacttaaaaggaggcgatgctacatgcaataaaatgaactccgtaattccagattcaaacgtgataaagaaggagttgaataaactacctccaaaaccggagggagccggtctataa

SEQ ID NO: 3784 - DNA, 573 bp, Cryptosporidium hominis
atgggagtgtactgtatagcatttcttgaagaaataggctctaaatataattatatatcggataatagcaatttatttattcatagcattaatattactgatatttgcaaggggattcaattccatatttcctatttttttctaaataaagaaaacccagaaatatacttgagagaaaatacagatatatttgataactggaactacataaaaagtacgtacaaattcagaacgccttcatatctattttccagaataaaaatgaatcacaacactacaaagctcaactatatatggaatgtgccagtaatggctcaaagtaaacaaattaaagagaaagaaattaaaaaaaatcgctcaataaaaatcagaaaattagcagatccaaacacgagaacagacttgatagatcataatgatgaaaatttggtaagaaaatactataaacgcgattcagattctttttcttcaaacctttctgagggaagcgatgaaaactggattgaaagcgttccatttaagattggaactcccaagaaacttcgcagatcaagccgcctaaaatcacattaa

SEQ ID NO: 3785 - DNA, 414 bp, Cryptosporidium hominis
atgttttgttcttcattagatgatcacgaattgctagccaaattcaatttcgttcaacctgtgaatttgactggggtttcattcaaattgttagagaaagatgtaatagaagggtttggaccaaaaaaaattaaacttttcgccgacgccacttcttacagtataggagatgcagaaatagaaaacggaacacaagaatttgagctgacaaagagccagctaattagtggagaatgcattgatttaaaaatggtcaagttcaagaatgttaatttcattcaaatttatatttccgaaaactacggtaatgagaacactagaattgggagaataaatatttatggtgaaaaaggtgattttgtagacattaccaaatggaagccatacagagaagagaaacctcccctaagctag

SEQ ID NO: 3786 - DNA, 3381 bp, Cryptosporidium hominis
atgttcaagaaaactttgattattcttgcactcctggccatcttggttggtgtatgtgcaaacaattatgtttcacctagacaagtcagactatctagaattcaaccaactcgtaccattgagcctgaccattccggcgtatatactaccccgaatttgaaaccatctgatttggaattgaagaataaaatttttggtacagaagattcaacaagcgatctttcttcagttattcatgttgttctcaaagaggaggccccagggtctttttctattcaaacatctggagctcaagcatttactaaggacgctcttttctattatcctctcatttctccaactaaaaggggaattgtcggtttttgtgaggaggatattaaactaattgataatattgagaaaacattattgcgtgatgccgagccaattataacatctttacctgatacagaggcaaagaaggtctattctcaagtcttgttttatatgaagtctctttgtaggacacagagggaaaagctgtctaacctaagcgcatctgtatctgatctttctctagatgatgaagtgaatgaaagtatatatacccgcgcattcgttattgccaaggaagatgacattcttgtttctactacgtttatgttgattgctcacgcctctccaaatcccattccaggtaaatcaccagagacaccaaggaatcttgatgatttaaaaaaccacttgaaggagcagcgctcactgattgagtcgcagctggaatatatcgagagaaatcatggtagaattgacaaaattccgatgttatatcaacgacagcatgctcaaagaactcgcgagaagctcgtttctgatatcaaacaagaattggatgtttttgaagatttattcgaagagttatcgacagctaacgaggtcacggacgaagtattttccaaagtggagtcccaatctcaaagaattgacgagattaatgcaaacagtcttgcattaggatatcacattgataagtattctcctttacttcctagatgggcaagagatcaaactaaagacccattcatagttgagagtgatggtagttatggcgtaataatgtctgagccaaataaagatcttttggatttccacaggtccgtcgttgtaaagagagcagaggaaggcgataaagaagcagaaagggctctttacattttgaggactgcagtttccgttcttgaacaccgcgaaagaacaacaaattattctgctctccaattctttactaccttagaatctaaagcaatgggtaccctttcaaagccttctatggttgttgaccctaacggagatttttccactaatgagtttgagtcggatgttgatgattcctctgctagagagccctccccggtggtaacaccaaatagaaagctagcagaagccacttcggacatagaagatgatgatgatgaaatgcctaatgttcaagagatattagatccacaagtttctactccagaggagatattaagcaaggttgcaactggtaaggcgtatactcccgctcaatgcgcttcaatatcatgcctttctggtccttcatgcatcagcaacaaggacggatcacctaaaatgtgctacaaggcgacatgtgttaagaaagattgcaatcacattgccattcatacggttgattgctctgatgcaaaatgcgaaaagggctcgtgtaaatgtggtaattgcgtaggcggtgaatgcaagcctggaaaatgtgtaggaggatcttgccattcgggctcgtgttcttcaaccaagtgtgttggatgcactacagaggttccaaggctcgaggggtgcgtcgcacgtcccgctcattgcactggagggtcatgttctcctgctaaggtcagaggtgctaggtgtgttaagcgtgaaatattaccaaatcatcactgtgcaaaggaggagtgttctaaaggcgagtgtgtcaagggtgaatgtaaaaaaggaaagtgcgttgctggtgattgctcacataggtgctattgcgatgagtgtgttgctccaaaatgtcaacctggatcttgtacaccaggaacatgcacgactggttcttgcaacgtaggtgaaagccaaactggatgtgagaagggttcatgcaaaggcggatattgtgttgggcctaagtgcaatgggaatgaatacgatggatttaaatgcaagggttcagaatgtactcctgctaaatgccacccatcttgcaatggatgcagttgcactacagccaagtgcaccggaggagagtgtacccctgcgagatgtgtaggaggaaagtgcggtcgcgttcactgcgatgggtgctctagttccctttgccatcttgaaggtgctaaatgcgtccctgctagatgtaggggtgttaaggctatccctgcccgtatcgttgggtatgatggaagaactgtaggttcatgcagcagcgattactataaatcccgttgtgtaggtaagccaaattgtaaaaagccagattattgcgtacgcgaaaaaccagaggaggtctgcaccgcaccatcgtgtaaaagtcccggttgtaaaggtactaactgcgacggctccaagtgtaaaggatctgagtgcatgaggccagccactacaactaccacaagatctaccactactactacgagatctaccactactactacgagacctaccactactaccacaagatctaccactactacgagacctaccactactactacgagatctaccactactaccacaagacctaccaccactaccacaagatctactactactaccacaagatctaccactactaccacaagatctaccactactaccacaagatctaccactactactacaagacctaccactactactacaagacctaccactactactactactactaccactactacctcaagacctaccactactactaccactactaccacaagacctaccactactaccaccactactaccactactaccagatatgccacgactagcctaaggacttctactactaccgtctcatcacctatttctacaggtccatctcgcagaatattagcccaggtaccagatttaggttccgagaaagtaccagaatctaagaagccagaatctaagaagccagaatctaagaaaccagaatctaggaaaccagaatctaagaaaccggaatctaagagtagttcttgcaactgctcaagtggccgctgcgcaaaaagcagctgcacaggttctgtatgcgcatatgggtgtgcatatggttgttccatgggctgcggcggcaagaatggaaacactggaaatccagtaaaattggcatcagaggcagaaaacagcatcgattaa

SEQ ID NO: 3787 - DNA, 1569 bp, Cryptosporidium hominis
atgctttaccttaatatttttatttcaacctttattactattaatttggtcaaaggatcaaagttgaccggctataaattagagcctgggatagaggcagacaatggatggcaaaaattaattttaggcgtaaactctgcatatgatagttcttctggagatttacttttagattctagaacctcttttgtgaatgattacacaaattttaaggaagctacaatatctttaaatagggatgtttgtgacgaaaatccggatataattagttcctcaaagccctcaggcaactttccaacgcacattccattagaaagaaaatccgtttcaagcttcattagaagaggaatttcaataaatatgactaattcagattacaactcgaatattcagtacccaagagtcaaacatttcaagtatacattacccgagcttgtatttgagccctaccagcgattaatgagctttgcgatagaaatatgtatgattccatctatttggtatttagagatcattcactgtatgcatatgggcatggctccattctttacaggtatgctcatgagctatagtttacaagatattataggcgcatcaataatgtcattgggatacaaaaatgaaaaattttccatttataactgcaaaaattcagtatctattgttgcagataaccaagtatccccatattatgatgaaatatgtgagaaagttgaagcttgtatcatttcaagaccattcagtaatgggcctttttcaaagttaagaactgaacttcaagaaagaatagatagatcatacaaattaattaagccattagatagttttttagaccctaaagcttttgcaaggtttgcaatattaacaaccattttgaatattcaaaataacaagtttctatcaagtatttctgcagaaagaaattttcttgtaatcagatcgatgctttcatctttggggtattatgctctttctagtgctgccaaactgcaattcgtatctgagatttctgttgcaaaatttttttcggttatgataccaatgtggctttcaatgaaaataccgagatataagaaaaggtgcgtacaacagattgctgcgttttcaaagacaaatataaaatcgtatgaattacttacatacttttgtcaagaggtgatttcatctggatttatttatgaaaataacgataaaccttacattgaattggaaagaacggactcactttatcctcaaagagtattgcacactcattatcctcattttattccaaatatttctgaaagaaaactttacacagagtatgataattcttgggctgtatctgttactgatgcatttaaagtaccttctataatggaaaagcccaatgaaggtttttcaaaaatatattattccagaaaatacaaaaagactagaagaaaagccactcatggacaagatattgggccatctggaaaaaacaatagtcgcacattaagacaaaaatttaggagccagttaacgaaagtttttttctcaaagaagacgagaaactactttgaaataatgaataaagttagagaatga

SEQ ID NO: 3788 - DNA, 1671 bp, Cryptosporidium hominis
atgagagctatattgttcttaatattgcctttagtaattgttacaataagttgttgcaattatattgaatccgcttcaatagccgattcaacacgagaattttcggctaaaattgatgaacaagacaaaacttcaaaggtaacggactccaaaccaatcagcgcagattctactccaaagaaagatgaagataagaattatattgacgatgataaattgttaattggccgaaaatcgacttggaatagatttattactctgattgttgatcatgtaaaaccaggagaaaattgggagagtgcattgtctactaagtcgaatgaatactttggatgcgatagccctcaacgtattttctgtagtgaccattatgaaagtgaagttatttttgataaattctttatccctacatcagctgttcctgttcaccttccaacagaggctaagcccaatcgaattacggattacattaagagaacttttgatttgaatttatccgacactattaagttgtctaacttccccagagtaaggcacttcagaagaagcttggttttattacctccagagccataccaaagagtaatgacttttgctattgaacaatgtatggttccttcaacttggtatttagaattaattcattgtatgtaccttggcatggcaccaaagttttttggaatggtttttagctattcattacaagatattgttggcgcagcattgatgagtatcggctataaagacgagcgtttcataatggaaaactgtttttatgcagtatcattaatagttgatgattatatttctccgcattatagggaaatttgtattgctgtgcatgcatgccttgaatcaaagcattttgaacgatatttttctaaacaaaagaaagaattcgaaactcgaatagcaagtacgtatagccatattccggaaaaactggggtttttaaagccgatggaattttataggtatgcagttttactttcaatatcacttatcaaagataaaaacgttgatataaaaatctatcctgaaagaaattttctcccaataagaatagcactagcaagtttggcatactatgcgatatctactcatcaaagttgggtatttgagtcagaaaagaaggtcttattatttttcacaaagacaattctgaatatgctttttgaagtatcattgctttcaatccctggctgtgtcaaaaaactagctaaattttctcataaagccaaagttggcaaggaaattatttttgagttattttgcaaggagattttttctgcagggtttgttgctgatgctacaagcgaatcctatgttgatcctaatttacattctatggctgttatgcctcagaggatactgcatccttcatatagttctttcgttccagactttacagatgacgtgaaatattctgaagacgaatcttggataaatgcacaaatcgaagtaagtaaacctaaagttgtaagaccgggacgagtacaaaaggtatttgaatcaaaaaaactaataagaacattccgaaaagaccactacaatagtgggattggacctaaatcaatggatgcttccttacgtaagataaaaacaggaaaagttacgaggattggctttaggagttttacaaataaattgacaaagaaaagaagtaagtag

SEQ ID NO: 3789 - DNA, 1512 bp, Cryptosporidium hominis
atgcgttgccaacaactaatttttttactctttatgttcatacgaaatgttaaatcatttgaaaatggtttattacggctagtaatagagttttctcaacattctttgaatgggtcattggatgactttgtttcttcaagtgcagaaaattacttctcgtttgaaaaccctcaacagtcagtatcttgtgacagagttttttattcaccgaggcaatacatagatcaaaatccaccttcttcagagtttattactcatattccgcgagagagtaagagtccggcacattttttgttttatactgaagatagtccttttagatcacgaattaatatgtctcaaacacactttccaaggcgtaaacactttaataagaatcttccgaaattgccacttgagccgtaccaacgaataatgacttttgctattgaaatctgtatgattccatctatttggtatttagaattaatacattgtatgcatttcgggatggcgccatttttttcaggcatgttaatgagttatacccttcaagatgttatcggttcagctattaaaacaatgggttacctagatgaaagctttacaattgaaaattgttatagatctgtttcatctgtaacagacgaacaaattaatgcaaactttcaagagatttgtgaaagtatgagtcaatgcctgctatctaatcaattttcttccgacccatatattcgtttaaaagaagaatttcagcaaaggattgataatgtttattctaatattgaaggccaagaaaaggtggaacaacataaaaattatgcaagacactctttgttattatcactgtcatctaaaacaataaatttttcattaccagatcccgctacagaaaaaaattttttaattattagagctatgatattaagtatgacttacttagttaacaagttcattccagttgaagagaatactatttccgaaaggatgtccaaaatcacaaaatttatatatagcatgcttttttctcaatttaagtattatatgaagatgtgcttaattagctttcctgcgatattaggttcaaaaagcaaaaattttcaagaaatcattgagctttactgcaaggagtttttgtcttttgggtttattgatgaaacggttaaaatagaaggggatgatctagaagcatttaataaagcaattctgccatctagagttttagatccggcttatgcttctgtaattccttccttaattaatggagcaagctctcaagaagatttatcatggctaagttttagttcagtaggaagcattgaaaacattggagtcgaaactggtaaaaagaaaaggcccaagacaactaaatatttcaaaacggcaagtaaaaatagtatcactaaaacgagatctgccgaaacaaatgccaaaaagaaaagcggctttacgaaaattacaaaaatgtttactaatcgcaagacaaggatttctggattaatcacttcacatttaggttcagctgatcagtaa

SEQ ID NO: 3790 - DNA, 300 bp, Cryptosporidium hominis
atgatgagcagtattattctaaatatcttaaaaacactcattatatttgtattgattaatattattggatcagactcaggtgcagtatcgaacccaaccaaacaacaaaataaatttactaaattaaatcaagtatttaagagaaaaaataaacaatattatgctatttcaaaagatggttttctcatatttcctgcactaaaggcaatttcttgcaagaatattccgcttttgaaaaatgttaatagctttaataatgaatatgacgaaggtaagttatttattagtagctttagctga

SEQ ID NO: 3791 - DNA, 1167 bp, Cryptosporidium hominis
atgcaccaagaccattttcctcaattatcacgttccctaagtgtatttactttggaccaattaatagagaaatcatttatacttcatggtcttgagtatcagctcagagtgagaaaacttattcaatcgattctttggaaaataattaaatttgcccataaatcaaatataaaaagagagaatatgaatcccaatagacttttttcaataatcagagcgtatgtacttacattgtatattagacattcgagccaaattattccaggatggtatttaaataaatttccatcggcaaaaaattcattatcatttgtatatgtgaaaaatgaagattatactgaacaatctgcttatataaactactgtgcaagaaaattaaaatggtggttagacgcattccaaccaattgtatcaccgattttcccgaatatggataccaaggatgaggtttcaagatccgcatgctttcaagcaggaagagcaggatttgtaagtaacgaagagtttgacttctcaaatatgatcgaggaaggtactgaaagtgttgatttgttgaaccttcaacttcccattatattgaaaaagtcagaagaggaaataaagtatataagaaataataacttaagaaaagctcaagaaaatagaaagtggactagttgccatgagtcgtatccatattcattaaatggaagaatgttccgggagactattcatgaaaaagataaacttaacttacaaaatttagctcaagaaggcgaagtaagccaagataaggacaccttattagatgaagttaaagatctattaagaagaaaaaaaaatggtgatgagctatctattaaatatgaaaatatctttgatacaaataacaaagaaagtaacaaaaaaacgtctttctccccagttgaatttatagctcaattaaagcaagataatattgacttagaatctcgcgatgtaaacacgagcaatatttcctataaacccagcagaagcataattggagatcaattaattcaaccgcaaagcactcattttttaaaacagggtgtttatggaaatgccatggatgacacaaattctggatttgaggaggatgaaatcgaggaatttgaagatgaagatgaatttgagagtgaaaacgataacgattattctacaaagtaa

SEQ ID NO: 3792 - DNA, 1146 bp, Cryptosporidium hominis
atgaaaatatcaggaaaaactattgtatgtagagagcaatttgccaaactagctttcatcactgttagaatgaaatcaaatttaatattagtttctatacttacttttttgattttttttaattttgtaaattcaagctcgatagatcatgcccaagtcaagcatgtagagtccataagagatagtatatttgaggatatattggctcagatgaacctgacaaatgaaaagattttgaaagatgagcaaatgaacttatattatatttattttaatgaaacttcagcatacgaacacgaaaagtgtgattaccaaataaatacacttaaatttgtaaataaaacacatacatgttacattcttggagataaaaataacaagctatttgatgagctttcatttataataaatcaagatagaaattcaactgatgaaatatacctaaaagatctatacaatattaaaaacatatcaaaaattacagataagttggaactcgagaatactaattcaaaaattaactttggcattcaaagccagccaaacttccgttcattagcgagctttcatgaacttaatcacaacgaaattaactacagacgaaataaattaaaaagaagatatcttgacgatgatatggacgatagcaaactttcaaaaaaagaaaagaaaaaaagaaagaaaagaaaaaaaatgcttaaaaagagagagaaagaactcagagaaaaaagaaaaaaatatagatcgcctttagataaattgagatctactatgaaatggatggcatgcatagagatatcattggccgtttgtagttgttgttttgctctagtacaggctgttgtacttccatttatttcccctattccgtttggatcgagaatacaacctatgaatgggcaaccaataagaggattcgaagactacggtttctacggaggctttcaacaaagtaatggtgtttataatgggttgcctctaaataatggaaatataaacggaaatcaccttagctgcaatggcaattgcaactgtaataacggaataaaaggtactttagggaatacattaggtattagtggaagtataattggaaataatttattcagtagaatggggcaattgcagagaaatggaaatgcataa

SEQ ID NO: 3793 - DNA, 1617 bp, Cryptosporidium hominis
atgagactaacgcttattatattatttattaatacatttattccaattctttcaaaaaagtcctctaaaactagttacaatccagacaatatactggtaggggtagataatcaaaaaaacgatcatatatacaactctcaatatagaataagagtcagaaaaatggacccgttctttagaacagttgtaattaaagggattgaacccaattttcctaatgatattaatgctgatggaacaagccctctttctgagaacatatattcaaaacttccaattaggcttcatgttccaattattccaatcgacaattctgtaaaaattagaagaatgccagtaatttctcaaagttcccaaagacttcctttagaggcaagcgaaaggttattctcgtatgcaataggtatctgcaaaataccttctttgtggtatctcgagctcatatactgtatgcataaaggagttacacactttacaacgggtattcttacaagctatactctccaagatattattggtgcatcactagcatctatggatcttccaagtgaaagttttagtttagctaaatgtaaggcctcaatatctctttttagtgacatagcaataaacaaaaaaaattcggaagtctgcagtatgatgctgacgtgccttacttctaaagaatttctgaggaataataaaaatcaagttaggaaattagaaaaagaaattactgatgtttacaaagataaaccaccgttctttagaggccaacaacccagatcttatgcccagaaaatcattgttggaatattaatggcaagaagggaaaaaggttatgggcctgccgctagtaaaagtgatggaaaaaagataaaatttcctgataaactattctatgtgatacgatacttcaactttataatgattctaactgaatacttaattagacagggacttaaagatattgatgcatttgagatttctccaaaggcctatatgaaaattggagataaaagtttacttcagccaactcccattaaaatgattgcaaaatgcgcacgtctgattattaatgctcatttatcaaacaattcagtggattatttatcttattttgataagacaggcttctgcccattctcaaatgtaataatacagcacgcatgcactgaattagtttctatgggatttataaatagtgaaattgaaattccaaagaatatttcaatagacgagcttgaatatttagcataccctcaccttgcccattcaagagaaattgtcaaagaacagccgaccaaaaaaataaaagataaaatatcgagtcaagtaaaaagtgctgacttgagttcgaagagtagaggagctttcaaacgaactattaaacaaaaaaaagctttagaaaatcaatctctcaagaaaaaagcgcaagttcagttaagtgataaaggagcaatattgaataaccgttcagttgttacccatttaaatattccaaaaaatcttgcaaacaaaacatcaaatgaaagtaaaaaaacagagatagaaagctatgctagttcaaattcgacgtcaaatttaggatttaaaaaacagctcgaagatattctttcaactatagatattgactga

SEQ ID NO: 3794 - DNA, 735 bp, Cryptosporidium hominis
atgcgtgcgcagaaacttaggaataaagagagaaaaacaaaagaatacagaaatattctggaaaatatagaaagaaataaagaaagtttacacaatcaaaatattgagctgctaaaaattgaaaaaagaattcaacagctttctgtagaagatagaatggaagataaagtagagaacaaaatagaagatagtaatcagttggaagccaaacctgaagaacttcaagacagcgaggcatccttaaagaaaaaggaacgaagaaaagttattattgctgccatattggaagaggctaagagaagaaaattagctgagaaaaataaagaaactgcacaatttagtcaaaataatacaaattctgaaggaagcaatgtagataaaaaaagtgtagaatccaatgaaggcataaaacccaaggaggaactccaagattcagaaattaaagagatccgacgaatcgcaaagatgttggtatggctgcaagagaacaatcccaaaacatcagcaagcgccgaaaccagaggcgaaagaggggcgtctgccatcaaaaaccttagaaaattgtatatttcagacggagaacatttcaaaaaagttgccgagaaaatcaaaaataactttgaagaaaaggtcttcgaaaataagcaaaaagaaagcagtaaacgcaatgctccaagaatagacagtaactcgaattcaaaaggggaaaccagtcaaaatactaaacaagattga

SEQ ID NO: 3795 - DNA, 1044 bp, Cryptosporidium hominis
atgtatgagcttcactatccagatgaaaatatagattctgtaaaagatcccgaagatttgtcaatccaagaaaaacaattaaattctaaacttatactagtaaacgaaatcccatcaggagaaatgatgtatgcagagaatttttcttatgaaggagagcagcattcaaataataaaagaaaagaaaatgcattattatctactcctgagcaaatagaatacttcgattttgaggatctgaaaaaggatgaaactaaaaaattttctgaagagaaaaatatgaaacttaatacgaaaaagaaagataataaaaataccaagggaaaaacaaagcataaaaagatacttgaaaaacaagacttctcaagtccaaaattgagtcctgaacccaaaaataggcttgatagatttcaaaattccctcactattcctataggttgtaaagataaaaataaaaccttgccaaaaaaatacagtaaagaatatcttaagtatggatatgatgaccttcaatttgagattgatgaaaatatttcattgaatcccactcttccctcaattactactagcatgcaaaacaatcttttgaaggaaggtgtaggttataattctagcttaactctcaaactgaaaaaaacactaaaaaaaaaagactctgaaggttatagtgagctatttggcatttccagcgaaaactctgaagatggcaatattccaataactagggatactcaatttttgcaaattattcagcacaaaatgccaaaaagaagtaataaacaacttggaagttctatgaaacctaaattacttaataccaaggacatgctacgcaatgaagcttctagtgaaactttcgtattagacagaaataaaggctctgatgaatgttattctgagatatttgagagcagtggcacaaaaaattgtgagcaaactgcatgtgttaaaatcggggacttaatatgcactcctcaaaatgatattgatgtaaaaaaaattaatgtgccaaaatcaaatctaccaaaaagaaggaacagatag

SEQ ID NO: 3796 - DNA, 270 bp, Cryptosporidium hominis
atggctggaggcagtttaaaaataataaattgtttatatttcttgttggtttcactttatctctttagatttgtaatcagtgaatcaagttacttaaatgatgttgagatcatcaaaaataagatcccaaattttattgaaatagtctcgaagaataatattgaaatgagtgaaggggatatagagaaggttaacgagaaacaaggtaggatagggctctttcaaaatactcctaaacaaataagtggcattagaacgcctactaggtaa

SEQ ID NO: 3797 - DNA, 129 bp, Cryptosporidium hominis
tacagttttccaaagatatgtttcaagttattcaaagcaaggaaaatctataatttctacattttttcccacattaaccgcgccacaacagacttttttggcggttttgtggttatttttttagattaa

SEQ ID NO: 3798 - DNA, 753 bp, Cryptosporidium hominis
atgatggagatcatcaccgtagatagtttacaagagaataagtatatttatagcggctctgaatctacgaaaaataatagttttgaatcattttgctcgagattttttaaacttaactatgggattataatactttccgtattttcgatgctagttactatattcggatcattatttgagtcaataataaaaatgtattgcttcatgatggtcaatagactagtttgcacagtaatgatcttttcttttctgcggcacatttggagctttgacaaatcaagtattaaaattatattttctcttcacttaataaatcagtttaactatcttggagtatcaatcgtagccatttctacaaaagtcccatcgatttctactgcatctatactgaactcttttaatattatgaatgtactttcaacgatttgtttcgcatcaattttcataatggaaatagtaaacttgatttatgtttataatcttttttttcaggcacaaaaaaatttaattattttaaaacaagaaatgaataataatgatataaagctaaatctatgcacctacattatatttggttatagccttgttacagattgcatttatataatgacctcgattatagtatacgccaaatttacattatttcatggacattatatagagatttcattaagctcaatttctggtatttgcatttttatttttgcaactggattaattttaagcatttctatcgttaattatttgagataa

SEQ ID NO: 3799 - DNA, 4398 bp, Cryptosporidium hominis
atgacggagaagacgcatcacatggaggagagttttctcaatgatgaggatttaaaatcagatatcgaaataccactggaggaaacatgcaactgcccaaaatccaccccagaacaattggaatataaaaatagtgtatttattagtgacgacttattttattcttttaaattagataaaaatatgatagatgaaaaaaagaaaattgatgaacagcccaaagttggaagtctttttcagaaacgagaaaatagttcaagttgtatttttggaagagctattaattatattcgaaggaaaaggtctcaatctaaaattgcaaatgacgcaaatcaggtcccttcaaataatgacaagaataatggatcaattttattttctatattaaagtgccttcatggcacccacttatttgataagtacacaaagaaaattggtaaacacatttctctggttgcagctgtgtaccctagatctctgctgattatagggaatgtaatggggctaatgtttggtttaatagttgctttaggtttgatgaagttatacccatttcatcttgatgtaaatggatctcttgatttatttcttcctacaaagtcgattcacaacgttcataaagaagagctacgaaagttgtttggcccagaaagtgtaaccgtcccaattttatatagtaataaggggccaccaggatcatctcttttagattacgtaactttaaaacaaatttggagaaatgaaatgtcaattcaagcaataaaagtagtagacaaaaaaggaaaagaatggggctgggaggatatttgttatcatcaaccaacaggatctgtggttacggggataccttgtgttgctttgtccttatttggtctttttatgataaatgaatcatctgggattttttctgagaaggactttgatgaagcgtttacaggtgattgttgtggcggaattagtattgccaaatttgcagcaggaaacttattaaaacagtcttattttccttatcaatacaaatatgatgagaatctccctgagtggccattcgagattcataatacacaggaaatgctttctatatatagattaaatacaactgttcctgaagaggtaagaattgcatgggaaaacaaagtcacagaccatattaagagtgtacagagacgtaataaacttgtgagtatcattaatactgaagagaagtctaaaggcaacccaattaaattaaaaaacagaaagcttcaagaaaacgagaattcagataactttacagcgactctaagcaatggattaaaacaagacacttttggctattctacaagttcagaaactttgaaggatgtaagtatttacccaaacaattgggggattgttcattattccttggagtttgtttcgtctgaaaccacagaattggcaaataaagaaactccactattgcttgcaacattcgccttgatgattatttttatggcagtttgcatatccggaaaatttccaaaaagatccagggtattattatcttcaactgttgttatgataactgtatatgctactgtgggtagttttgcaactggaatgatatttggagtgccaatctctcctcttacgccattatttattcacatgttgctgggagttgttgtaagctacatgataatttctgtaagaacttatatgaagactcggatctatattagagtaccgtttcattatttacctttattaaatcctaagtatgttcgagtttccggtaatgaagtctttcttgaaataacacaatatatttacaaaccatggatgggattcttgtatttagaagcggataataataattctagcgaaataattcacggaaatagccatagttatggtagcacaagcgttgggttaatttacggtcaaaatcaatcaagtaatgaaatttcatcttttaactcaagctctgtgtcgaattcatattcaaatgagagaagtcaatctgaacagactgaaaaaacttatgttactacagattttgtggtttcaaaagaaaataaaattccatcaaataaggtatcttcagaccaggatctataccatgaatatggacagaatgactgtgagcacacaagtggagtggaagataatgctgatgaaattcgcgttaccaacactggtaaaattattgattcaagaaatgaatggtacctatatcctgaatatattgagagaaaaatgtgggataacgatacgcttctcaaaatcaggctttccgtttcaggttccgttgtatttagttcaattacccttacttgtcttacatcttgtgcagcgctatttttggggacggtagtagacttcccaatcgtgcgttattattgcattcatgctggctttggaatactctatttatttattttccattggttgattttccttccttcttttgtattagatgaaaagagaatatatcgtagaaaatacgatgttttcccatttttgaaatttaaacttaataataaaaggtcgaagtatttattcattcctgaagaacctaagtttgttggaagtaacaatagccagcaaaaattggaaatttcatccagtataaatccatttacgcgtgttgcttcgccatctaatgtttctctttcagcatcaaacgactccagaaaaggtacaattctttccatatttactaggcatgtgtacaaagtaaggagcgaagttgtaaaaaattatcaaagatacaaaacatggtggggagataaatctacaaatcaacgcaagcaagagcaatttcatcaaaggaaaagcaatattgaactcaatgagatgaacaatatggtgtttaacgaattatcttctaaagatacttcaaataaaatggatcaaccccacttaccttataaaaataatagaaacattgcgattcagaatgcaattgatagtattgatatgcatgatatttggattggaagattaatggtggaatcttctaaggccgatgtaattatgagactaatgtgcaactttacatttaggctgtttgcatgcctgttcttcattgtggtagttatactgggaatattgtttggaaaaaatgttaatacagagtttagtgcagttagatacctccccccgaactctactttacattattttgtagaaacattagcaaaatcatggggttctgaaccgcgtcagatgtaccttgtattcccaggaagtgacaaagtatcatggaacaataaacatgtccgtgaggaattcattaatttggttgataacgtcttattaaaagatccagcaataatgacaccgattgtaagttggattcatgattttgaaattttccattttggaacaaatactccagaagacccagaccacattcaatcttttgttagagaatgctctccagatttggacaatccacagccacctcctaatgatgctcccgaagaagagttttacaagtttctgaatgaatggagaaataggaaggtttttaaaggagatgaatctcaagaagatactatttgtgtcgtatcaaaactcagttcaaaacttacagcttctaccttatctgaaagtgcacctttcatcagaaatattattccagaaatgcacgatgaaaccatgcttgtattcaaaaatggaaacccttcagaaggaattcaatcatttagaataatgactatgataaagcatagtccttcgaattcgcaatataactttgaaacaatgaatcggctctcaaatttaatcgaaacagtttttgagaaagattttcctggtacatatatttacagcgattggtttttggaggctgagagagatcttaatatcttttatattgtctggaaacttcttctttacataacacttggtgtatcaattatgctttgcattattcaaaaccctttaactggtatttttataggactcgttgtcggagggatcaatattacagtaatattgattatgtatattactggacttatctttgatattgtagctttcatggttctagcaacagcagtatcattttcaattgaatatattgtacacattactcatttgttcctactaacaaaaagaaactccggagtcgaaaggattcgagattcacttttagatatggggcctaatgttatatatgctgtaatatcgaccttccttggtgttatacttctagcattttctacttcagaatccttcaaagtttttctttggataactacaattgttctttgtgtctctgcaacagcaggaattatgatagcaccggcaatcctttctattgcacttgattttggaaactttattagagattactacaacaatagaaagaggcagcaagaactagatgacacaatacttgagataaagtcaaacaatataatttag

SEQ ID NO: 3800 - DNA, 900 bp, Cryptosporidium hominis
atgctatacaataatgaggataactattccgatatagatattggagattcattggatattgtagttaaagaaagggtagacgaggttgggctatatagcttaacttgccaattatttttcacatcaaatgaggctagattaacacaaaagaagtcatacaaatttgcagtgctttctcctttcaatatttctcaccgattatacaatttagatgaaggtgctatggataagaagaccatttttgttgaagtttcactagaaaatatttcacaccaaagtattacccttagtagtatgaagcttgaacctataaatataaaaaaactacctgaactaatatttgaactggaagatgtgaatttaaaaaataagcataacgagcctttatatatccaaccaagatgtaaatacaacaaaatatttaaatttacgtttcgcagtagaggagaatacaataatttaggaacgagtagtagagaggttctagaacttaagcttagaattggatggatttcagtatcatatggagatggatggcttgactcttataaaattgatctaccaattctatgcgatcaaaacaaattgaataaagagaaaaacgcaattattcttaaagctgaattaccatcagtaaataataggcaggaagaatttaaagtttttttatatgttactaataacttaagcattgatcaaaaaggcgtgagcattagattggactttgaccagcttctaccaataataatattaggaaatgaccgtttatatttagaagagctaaaagcgggggaaacagttacattggagctggattgccaggcacttgtatcgggagtttataacctgaatggaatttacgtttttgacgagttagaagataaaaaggtaagtgtataa

SEQ ID NO: 3801 - DNA, 1008 bp, Cryptosporidium hominis
atgtttgcccaatttgggagagatcctttatgtattaaactaattggaattactgataatagtagtacagatcactcatccgatttaattagaatggttactattcctttaataaaaaagatgattccccaggttggagagatatctttgagcatcattaagagaagtgtgtcacagaattctccaggtcaagtacaattgaatatagctactatcaaaaagattgaacctatattaatggatgggccaattggcagaataaagagaattagaggaatttcatggtacacaggttcagcatctgctcaaatagcaattaaaatgatttctaaggccagaggtattttgaataagtttattcctgatgtatggatttactttgacaaaccaaaaaaagactctcttcaaaatgatgaggaaattacaggttttgggatgactttagtggcagaaagtattaaaggtattacaataggttcaaattgttcctttatctcaagttcaattgatgtccaaaaaatgttgaatatccctatggagtcttttgaagaagagcaagtatttaattcagataatattaatgaatatcaaattccagatttgagtagtgacttatcagttaaaggcaaatactccaatgaatctcgcaatgaaacatcaagttcaattcaagaaattcaaaataatgaagaatttgagagtttaacggaatgggaaaaaatcggatggctaactgctagtaggctacttttagaaattgattcgcaaagtaatgttgacacaagccaccagatatatccacttttatttatgtcactttcacaggatactgctacttctaaactcaaactatctaagctagcgcctatgactattcaatttatgagagacttgaagacctttacaaatattgagtttacaattaaagaagataccaaaaatggtctattcattatactttcttgtacaggaataggcttctctaactttgcaagaaaggcagcttga

SEQ ID NO: 3802 - DNA, 585 bp, Cryptosporidium hominis
atgaaaatgccgagttttatttcaacaatttacattttaatcggattgttaatgaaaatagaaatttcctactctaagtttgaatttttaaggagagaccatgcatacaaaaatgaaatatttgaaaaaaataatcaatccatttctcaaaataaagaaaatttgcatcattatttacctattttcaattttagcgaagagtttgtcgctccaaatagaacttatcaatttcttgaattatacaaagaaatttctacaataaaaagtgctaatagcgtttcattaaaaaaggcctatttagaccaagttttgatcccaaagacagatgcaaaggtggcgaaacttaaagcagaaactgcatatattgagacaaaaaatgcagcaaagaaaaaaaaaatgagccaagtgaagggcgactttgaaaaaaatataacattttcgtcattaattggaaatcttctaaattcatcttcccagattaatggtactcagatattgaataatatttataatgaaacattttactatctgaataataaaaatattagcaattccacagaaggaattgtatatgagttcgcttag

SEQ ID NO: 3803 - DNA, 8178 bp, Cryptosporidium hominis
atgaagaaggaagaggaaaaccttccaatttattcctcactagaagaatttatagaaattaatggaggcgttaaccttattaaaaaaattctagtggccacaagcggacaagcagcaataaagtgtataagatctatgaggcattgggcatatgttacatttgggaatgaaaaagcttttgaatttgtagtaatggcgacgcctgaagatatccaaagcaactcagaatctgtgagcgaagctgattactatgttgatatcccgatgggcccaaactatcataactatgcaaatattgaagtaatcgtttcaatagcagaagaacatgagtgcgatgctgtctggccaggatggggtcacgcctctgaaaacccagagcttccaaaagctcttttaagagctagaagaaagattatttggattggtccttcagcagaatcaatggaaactgtagggcaaaaaatccaatcaaatattattgctcaatccgtacaggtcccgtgtgttccttggtcaggagatggaatttctgttagtgtagatagggatgggcgcttcacaggtattgtttctgatgagcaacttcaagcagcgtgcgtcaatagcactcaagaatgtattgacgtttgtaagcgaattggatttccagttatgatcaaggctagctcgggaggtggaggaaaaggtatccgactttgcagttccatggaagacctagaatcaaattacagacaagttataaatgaagttaaaggtagccaagtatttgttatgcgagcagttaataagtgtaggcatttagaggttcaagtgctaggagacaaatatggtgacgtgttcgcattgagcacaagagattgcacaatacagaggcgtcaccaaaaggttatagaggaagggccagttacaattgtgagtcaagagatcgttaaggaattggagttatctgcagagaggatgtgcaaagctgtgggttattcatctgcaggaactgttgaatttctatatgatattgaacgttcatgtatagcttttctagaagttaatgccagattacaagttgaacatgttgtctctgagggggtagctaactgcaatatacccgcagcacagttacaaattgctatgggaattccattgaagaaaattcgcgatattgaagaatatagaaagctaagaaagcaggggaatgcgcctccaaggcatattatcgcagcaagaataacatctgaacatgctgagaaaggatttactccaacatgcggagacgtgtttgaaatatcttttagatcttcgcaaacagtatggggatacttttcagttgcttctccaggtcatatccatcagtactccgattctcaattcggacacatttttgcttttggaatgaatagagaagaagcaagaaaacatttaatcatgggtttgaagggcttaaccatcagaggtgagattagaacaaatgttgaagcggtttgtagaatattagaaaatcaagatttcattacaggcaacacatatacacaatggctagaacatagtgtttatttctcttcaccgttaactaaaaaagtttcaatgcagtatttgaatgcagtatttgcagctgcatgtttcactgggctcagatacttcaaagaaagtgaggatacatttgtgaggatgcttgagcaaggacaagctccaaccagtatcaatattcagtatgaaatgactctagttcacaaggggatgaagtttatatgtgagagccactttattggtcctgaacacgtcagaattatgttgaatggtagttctgttacagcgaaggtgcgtaatatttatccacccagtatgcaaaatgggcgtgactcgtgctatttaatatcaggaggttttgatggtagaaacaggaaggttttctttaaaaaagacgctgaagataacttattggtcacatttgatggaactacttacacattcctaaaagagcaagaccctcgtcaagttagagctccagttagtggtaagttggtaaggtggttaatacaaaatggaggtcaaggtgaaaagggccaggcatatgttgaaatagaaattatgaaaacatatatgcagctaactctttctcatagcggaattctagagcatgctaaacctcaaggcgcttcattcaatgtaggtgatatcctagcaatgttagagctccctagtgaatttatccctcctgctttggagctatacccgctaccatttccaaaaataggaggggtaaaatctccaaagcttgctcttgagactttttgctctggaggatttagaggaggcccgagaatggtagctttagcaaactttagagaaggaaaacaacagcttctaaatgcacttaatgggtttttcccggcctttgaggatgttagaagcgctcttgggatgttctaccatgttttagacccagtaatgccatttattgaacttcaagaagcttgcgaagttgccacaccacttatcaaagttacagttcgaagaaaaatatctgatttgatagaagatgtatttcaaacatttgaacaattaagtaaaaacagctggtatgaacagtttgatagacaattgagcgcatttatttctaataattcttgctttgaatctgatgtaatgtcagaccaatgtttgaattcattcgaagataatgatgatatcgaagatgaaggacagccaccaaaagttcttcaagataaacgccttagttctgatggttctgaaatgccatcaatgctgctttcaaacaaagctgatgagcttgacccaaaaaatgcgagctttgcacaaaataagaaggaattggccaaagaaatatttgtaaatgaggctgagcaaaaaaaaagttttgaaaattctcttggtgctaatatatatttgaagaaccattcaaaaaatattagatcggcttctgatttagaaatatatatattggactgcttaaagatagttagtgatattatagaagagtctatacaagattcagataatgagaatatttccgtcgacgaattcgtcgctataagaaatcagtgtgatccattaattcatataataagaagaaatgaaaaggggagatggatgagactaatgtacgagctgcatgaaattattctaaagtatattgaaatagaaaagttatttgaagaacgctcctcacttgtcccggcacgcattatcccaagccttagaacggagtatgagctccctgaactaatgcaaatgggccgttctcaccaacaattgagagtgaagaatgaaattatggaggaaatcgcaaaagaaatggctaacaatccatctttacttcagtgtactgctccattcagagatacaatccatcaaatagctgaattgacatcaactgagtacacaaaggtggcaggagcttttagatacgtattacttatgaaagagaatgttacaacaacgactcaaatacagtctgttgcaaaaaaaatatttgagtatagtcaattaatttcattagctcagacacacggccaacatcttatttcgattgctaatactccttcttcacctcttcaatacccaataaatgcaactccatcattatctacttggagtggtattccaaatttaggaaatagccaacagacctccttgtcaaatattattgcagacttcactaatttccctgatttcacacttttggcatgcattggccacccaaatccaattattggtaagttagcttttgaaatatatatacgtcgtcattatgaaagatgcggcttatcattttatgctataaagagcagaggggaggcatgggatagctctgtggatattagcaccgttgggaatagcagtatgctaatgacaagctgcccagaccttaagggagcagttccattaagaggagaaatccagaactttaacaatattttgggggtgtggacacataatgctttaacaacatcatcgtttttccaaaatcaatgtgatcctttaaggtcaaatactttaaatatccctgcaatacaaaataatgtggatcaatataatcaaaatgaaaacaattctaaaggtagaacactaagcatattagaatcaaataatacatcaaaaaatatgagctcaaagtgccatgtaaaaggcgcaatacatattgaaaatagccgttggaaaagcatgctaaatgcatttagtgggcaaagtttaagcagcattgcagatgacttgttggaggagtctcttcccattcaaaccagtattgggctttattttgaatctatatctgatttccaagacagatttgaacagtgtgttgatgaattgaaaatcttacatgggtttttcccccaaatttcttcatctgtcgattctattgtcatgttagttatcttgtctagtttttccaatggtgagatcactactgagtcggaagtggcttcaattaatgatgaaaatgattcctcttccattgaaactcaatcaaactcaagggacataatagagattcttaaaggaactattaacaagcaccaagaaaaactctctaacaataacatacacatgatttcatttacaatagctccttattccgatcaaaacaaacctgagtcactttctgcaagcttagtttatctaaaaactcctgttcattaccatttcagatctaaaaagggaattccaatttataaatacaattctcaagatctggaatctaacttatctttacaagatagcctaatcaatcaagctgaaagtgttgaaattgaggatttggagaacaactattttattgaagaaccatttattagaaatattcctagtactttactttctacacttgaattgaagaggctgcgttactttacaataaagtcaattccaacatcaatttcggggataaatttatatgttggtacacctagagaactgtgttccggttattctgttattggtaaacgcaaagaagccgaaaataaggaaaacaactcttcattgaaaaatggaaactcaaatattagtaaatctcacgaatctgattcaggaaaaaatttcaaactttctgaatcaattacttcggaaaagtctaattattcgggcccccaaaccaaaaggatttcaacaaaggaaatggaaggtgaaaatctgacaaataaatctaacaagactttaggtgcaaaaccagttacaagcaaaatttctggatataataaacagagaagatatttcataagagtattagttcaacatgaatgcagtgagttatactttgaggaacaggaaagatactttatagcagccttaagtactttagagtcttggctatcttttgaccaaaattattcgaatacaagttcaagcacagtttcaagaggtcatacaggtcttaaccatcttctttttacttctgttggggttttaaatgataaaaactcaggctatattacaaccagcatggcagaagaagcagcaagaacattagttcagcgatattcacaacgaatacagcagagttcactacaaaccatggagttccgctatattcaaaggtcagtatatcaaaaagatagtaacaacgttgttgtacccgttcgttttgtggtagataacccaacagggcaagcaattagattacgcagttttgtcgaaataaagaatcccacgaccagtggaggaaaagtgtttgcagctatagactctaaacagtcgttcttaaacttcgtatccacaagcagatctgacaaatctttcagcctacctgggcttcaacagtctaaaagcctaaaagaaatctctaatcttaataaagggtctaaaattctaacaattaatgaaaatatggttccaaatttggctttatatcaacatgaacacatttatgacgggaagcctctggacattcctcatcctttaattggaaaaattgatcagaaaagatatcaggctgcagagttgaatacggtttatatatatgatttcttggatctatttgaagaagcaattaagagtttgtggaataaatgcccaaaatactttgttacaacgccttctagtgtttcgctttctaaatcaaacataaaatcagcaagagcaaacggttctactacagcaggaatctcaactaattgtgaatcgggctttgaacaatctagtggaaagacagcatttttgcccaataaactcttagagtatgttgaattggacatcaataaggattcaggagaactagaatgtgttagtagagagcctgggaataacacctgtggaatggttgcatggtgtattactatgcatactccagagtacccaaagggtagaagagtgattcttataggaaatgatattacttatcaaatggggacctttggcattcaagaggaccttttgtttcaaagagcatcggaatacgcaagaagtttaggaatccctagaatatttattgcagcaaatagtggtgctagaatggggctagcgacggaggttcagaaatgcatgaaagttgaatttgttgattctgaaaacccagttaagggatacaagtatctatatgttacggaagaagactataacaaatttgatttgcagaatagtattaattacgaagtactagatcatcctaaagatgggaaaatatacaaaattactgatgttattggatctcagctaggacttggagttgagaatctctcaggaagcggaggaattgcaggtgaaacatcaaaggcatctaagtcgatcatgacgattacatatgcaactactagaacagttggaattggtgcctatttagcaaggcttggccatagagttattcaaaaagctcatggagctccaatagtacttacaggatatcaggcactaaataaggtcgcatcaaaagaaatttatagtagcaatgatgaattgggaggtacagagattatggcaaaaaatggtgtaacacatctcgttgttaaagatgacttagagggttgcgtagaaatacttaaatggctgagctatgtacctgaatgcgtcggaggaaggctaccaataatggtggatccaacagatcctatatataggaatattacatactcttgtaatagtaatactgaagacccaagactaatgcttactggatgcatagactcaagaggacgttggctatctggtctttgtgataaagattctttcaaagaagttatgagtgattgggcgaaaagcgtaatagtaggtagaggaagaattgggggaatacctgttgggttcattttagttgaaactagagttactgaatacattcagccagcagatccagtaatgccacacacaagtgaacttagagttactagagcaggacaaatatggttccctgattctgcatataagactgcacaagcaattcgtgatttcaatatggaagaacttccattgataattcttgcaaattggagaggatttagtggaggccagaaagatatgttcgaccaagtcctaaagtttgggtcttacgtagttgatgagcttgtcaattataaacaaccttgcttcgtttacatacctccaaagggagaactgcgcggaggagcttgggtagtagtagactcaaatattaatccagaattcattgaaatgtatgccgaccctacagcaagaggaagcgtcttggaagctgctggaatagttgaaattaagtttagaagcaaggcgcttaaagaatggatgatgagattagatccagaattactttccctacaagagaaagatcaactacttcatcttaaaggctatccaatagactcttctgaaagaagctcaataaaagaaaagattaataaaagatgcagcttacttcattcagtttatcacgccgctgcaattcattttgcagatttgcacgatacttcaaatagaatgaaagctaagcaagcaatccatgatattgttcagtggaagaatgcaagggtttttttcattcatcgaataaaaagacaattgctgcttttttctttaaggtctgaaatttcccaaaagcttggaatttctctaacagattctcaaaatgtggtctttcaatgggcaatacaagacggaatagatccaaataataacactcaattcattcaatggatttgccacagtgctaacattattgaacagagaatctctcaattatctagctctgatataaggtag

SEQ ID NO: 3804 - DNA, 840 bp, Cryptosporidium hominis
atggatgaggaaaaatcaaaaactgaagagcaaaatggttctgtatctcagaatacaaaaacaatatctttgaatgataaggcaattctaaataatcaaagcccaattattgtcagaaggggagatctttcagaaacagcacttgaatcttcattttcagaacctttatctgttatcgatgacttgaagtcaggatgtaatttgtttgagaagaaaagtccaagagatgaacaattacgtgaaaaggaaacaaagcaggcactaaaatcagttatgaagcttcagaatgaaatctttcacattaataattcaatagtttctcaggaaaatgcatataaaagttctttattttcgaacaaatacatgggtaatatttttagtagtttctctccttttattaaaggaattaataaatttactttaagaccaaaagaaagaagccctgaagaggtattgaaaaatattaagaaaaaaaaaaaagaatttcaaggaagatgcaattatattaagtattctactcagtggtatctttgggcaaaaagaagaaacgctgagacttactctcaaaaccatttagaaaatacagatcaatcatcatctaatatatctaatggagtaggaaatccacctttaggaggaacttcttctacaaatatatcaaataatgctaacttatcttgccaaaataatattgggcaagtttttcaatcaaaccaacttttattacaaaaggaaatccagaacgttgagcaatcagttaaatttaggcttgcaatacagtctgataagccttcattcaccttcaatagtaatatttgttctagtcaaccttcggtttaa

SEQ ID NO: 3805 - DNA, 276 bp, Cryptosporidium hominis
atgttggataaatattccaagtctattttgaccaaacacggccgaaagggaactttgatcacttttaacatgaaaaaaaaggaatcatttgttaatggattccaaaagagaaagaaggagagaagagacaaaagtatagagaaaaagaagttgaaggatagacaatttagagatggtgtaaagaaagatgcaaaggatgtaatgaaaaaacatattaaaactgtcgagaaaatttataactcaagtcgtaagttagtaaaaaccgcaatattttaa

SEQ ID NO: 3806 - DNA, 1206 bp, Cryptosporidium hominis
atgaatcgattaactgaaaacgatcaggaacttaagactattcttgatggagttatgattaatgactgtattaaaccatttaggagggtttcagaaaaattagaagagtttgaccaatttgcaacagaatatggaaattctttagattctaaaattaatcagatgctaatttcattacggaaagatgaaattaattgcttaaaattagaaatgaggctagaaaaaattcttgagttagttactgagcaaatgcgtaaaggcaaccatgaagttaagggagacaaagcaccaactaaagatatggtaaaaacagaagaaataaacaaaaaaatcaagaaaagtgatgaaaaacaaaaagaaagtggtgaagaaagaactcttagcagttcaatgaatagtatggaatctgttcctgtcgatcctttgataaaaagaactcttgaattcgaaaatactcagagaaaggtatatgaaaatcctaacaataccaaaggatgtagtatgcatgttgaagaagaaacctgtgatgaaattagtgtgaaaataagtactgatggttctgcaagaagtttactttcgaaatatattaatggcgaaaataagcatgggaatgaagtcagagaaaaagatccaaatgcaattagaagagaaaaggttgataatatcaaaagaacagtcaagcctatagctcgtgatagcggtaataaaggcaagtgttgtgctttttggaagaaatggtgctgttgttgtctatcagataagggcccaacaaaatcgggaaactattataagatgtctatacaagaatggaaagattttttggcatcaattgaacctaaagataagagatataaggactactgtaacatgttagagaaaagaaatgattcttataatgttgatatcgaagggttaccccctttgattgttgaatattcatctttaaatgcaaaggctgggggaaattattatggaagtcaaatgtacaacatgggccaaaattatcaatattattatcctgtaaataatcaaggttattataattatgggcaatactattatgacgctagaagtcaggcctctaatatgtcatatgttaacaacaacccaaattatttgaattttaataagaaaggtaaaaacatgcaagaagatgttaaatgtagacaaatggtgcatacaaagatgggaataagaaatggttaa

SEQ ID NO: 3807 - DNA, 1431 bp, Cryptosporidium hominis
atggccaacaacaaaatttattataagtttaaaagtgaaaagaaatttaaggatcttacacatgaatttcctgctttagtttcacatgttaggtcaaagctcagggaaattttagatattggagaggatatggatatcttagctactcaaagcgataagaatggtcgtgtttcgaatgtatacctttcagattatgaaattctaaaagagggaatatatttaaacgtggtaaggctccctaaggacttagcaaagcctcttttagaagcagcaaattcgaaaataaagaacaagccttcaactgcatctcaagcaacaaattccgcttcttcaggtactgctccatcaaatacctcatccatgcgagaacaaaccatattatctcctccatccaccactgatttagcccctaatagcggtaattttacaaaagtaggagaaagcaaggatgatgatcataactcagttttgaatagtacaaatccgtcgaataattcaaagaataattcgtcggaagatgcagctattttgttagtaatgcaacagcatggtgagaaattcaaacagacagcagctcaaagaagcgaaatgttagaacagtttaaccaaagaggatatccaaagtctgtaacttcaacaggaagcagatatggagctggaaatacaacaggtacaaatttttctgcgtccagccaatttagaagtgagccatacaaaaaactgggggctattggaacaggccctcttaatactggatcatcaaataattattttggtgggcaaagttacaatgcgaactttggaccttcttctgtgtcggttaattataattacaagaatgcaatggctaatacatcaacagacgttcctgcagattatatttgtcatatgtgcggtgaaagggggcaccatattcgtgtttgtcccaaagttaacgaaggagtatctcaaaaaaaaattagacctgctacaggaatccccagaagttttctaagagctattaattttgacgaagaaggtagactctactcagaagtttattgcctccccgatggtacgtttgctgtgctaaaggatgcaaaacaactttcaagtacggctttcctgactagaacagttgaagatactattggaaaacatatgggtaaatcaaaggaagacacaagtcttgtccgagattcattaacttgtcctatatgtgcgaggctcttcagatacgcagttttgactccatgctgtggtgaaacatactgtcaggaatgcattattaactttattagaaatcatatggatgctgcatcagggatttcgccaaacacaatcaagggatattgccctcattgctcaactgtgatttctattgctgatcttgagcccaataatccaattcgtaaaagtgtaaatgttgctcttgggctgcagcctatttaa

SEQ ID NO: 3808 - DNA, 813 bp, Cryptosporidium hominis
atggaaagcatagtgaatacaattaataacatttcaggtaaaatctgctgtcttaataattattttttgagagatgaggaacataaatctaatgaagtgtaccaagatgttaatgactactattcttttttcaatacaaaacataatttaattaataatgacgtttttgagagaagtttgtttacatcaataggccatggaaatgaatatcttgaactttcaagaaataataaactatttggctcgccagtatctcttaaaagctacgttcaaaagtcaaaaaatcaaataaagcagcatatttttgagcatcttgaaatttctaaatgtgataatccaattaaaactggctgtcatttcaatgagccaattaactattacaaggctagtgaaatggaaagaagtgttattattccaaggtcaaagttcgtttctcatagttcaaatcctccaattaataaggattttaacgtgcaaaactcgaataaaattaaaattccatatgaaccaaatacttcgatcactagactaaaagcaaataaagcagaagagaaaggtataaaagaataccagatctctaaaaaaaattatttagaaattcctactgtgaatagactgcaagttcagagcaacccactcctttcaaaagtaaatgagaatcaaattcaaaaaaccccctctatgccaacaattaaacaatataaacctgcatctagatgccctgaacctattaagcttgacaacaagggtttgaataacgagaataataaagtattcctaacaaaatatgggggatatttgcttgggctttag

SEQ ID NO: 3809 - DNA, 1374 bp, Cryptosporidium hominis
atgagaactctaaatgaagaaaaaagcttacttccttccagatctacaattaggaaaagctcaaaggagagctttatatcccgattatcagagcaggtcttaattgggatggaaaattttattgaaaaaaggtataaaaaggggtcaatgacttcttcattttttgctttggtaaacacaacaatgggagtcggaattcttggattaccctgggcatacagtaaaaatggacttttacaaggaatctttatgacaataatatcaggcatgttttcaacgcttgcatgcattcttctttccgaaatatcacttaatgaagatccaacaggtacaatgatgcctgtaacatactattcgattgctgaaaaaactttcccaaagctaaagtcgctgatcgatacatctatactaattatgtcacttgggtcgtgtattacttatcttatggtcgttgtagctgtaatacaaaccttgtttgggggttttcttgctccatatctatcagaatctaatacgagaactgcaattttgttatttgttgtgatctttattatcggtccagccagttatcctacatctcttgccgagcttactatcattaactggattgctgtattttcatccctctatgtcgcagcagttgtaatattcagcttccttgttggccttccagaacttacaacaatgcttgagaaggttgaactcatctcaactaggagaccaatttttatgctccagacattcccgatatttgtgttttctttcacatgccaccacaacttcctcaacgttgcaaatgagcttgcagacaagacgttatacaaattggttttctcttcagttgtttcacttggattttgtactttaatctacatccttatgggttcttcaggatatatgctgtttggaaacactctcaagtcctctgatatcctcagtatgtttggtactcaatcactaactgttgttattgctaaaattgtattggtatcatcgcttgtattttcatttccagtatcttgtcattcattcagaaagtctcttgccattattattaaaagtggagaagatgcagaagggtcatcaacaaaagatcgtcacttacttagaactctcacctttattttcctttttatctgtacaactgttacatattttgtttctgaccttggcctcacatacgaatttgttggactattttgctcaaatactgtatgttacttccttccagctgttctacatctcaagttattttcagactccccttggaacacttcaaagatcatggctgtaatcctgctcattttctctatattggtttacccactgtgcttctctgcaatcatatatactcattttttctcagatcattga

SEQ ID NO: 3810 - DNA, 1311 bp, Cryptosporidium hominis
atgatggttggtctcttgaaccgtcaggaggacgtctccccgaatcttgcctttggctcagtccctataactggccctatttttgatgaggagctgcttcgttggatagctgaagctgaataccttggtgtttccagggagactgcaattctaattgctactaaaagaagagcacttaatctgaacaaatctgggggcagtttggtagtagatccacaaagcaagggtattcatctggcttccgagaagtctctctcacattctaataaccctttgcaattgcctatcaccgttattggagcagaagacgatgagcataataagcaaaactccaaggcgaattctcccccaggctctgatcatggatcgtgctctgaaggttatatctacgaagaaagccacttaaacttgggatttcaagcagaacagcagcagaaacctagtgttgctctcaaaaactcttcttctcagacttcttcaactcaagagactattacgactaagtttgatggcttgctcgaccaggttattaacacaactattgctcatataaactttgacgagtctaagagaaagaagaagaagtttaaaaggagaaagaagttctctcaaaagaacattctaagcgccacctgcaatagtgataatgcatcaaattcgatttcaagccagtctattaatactcatctccttaaaacaattgtagaaaaggactcgaatttgaagatgatacttagtgatgataacaacagtagtgtagacacaactatgggagtggtgaactccggaacaaatcaagtagatagattaacgactcactgttctggcttggatgcagtagtagctgctcatagcgataacccgtttaataataatgatagaaattataatatcaaggttaaaagaaagaagaggttttatcaaaggaacaataataatgttggttcgtcgtccaacaagcataatcctacgcaaaatacgcaggttacctcggcgcttaatgatttccctgagccttctagaataaaccttaaacacaccaagagaaattttcatagaaatagaaagagtttggggctgcatccaaatcctatctctgaaaaggctactgatagcagtaataatgccatagcgttatcaaatcctgaacttagaaacctaacccagcagcctaaaagcaacggaggatacggtagacgtgcgaataactctgaaagaggccgtataagaccaagaaaatcagaagctgtagaacatgtccgtgaacaacttagaattgcctttaggtccagaggagtcttggaaatataa

SEQ ID NO: 3811 - DNA, 2181 bp, Cryptosporidium hominis
atgagaattcttaaaatattacagatttacactattctatgtattctgcttgctaccgagccgtctaaagcaacagtctcaagatctactctcaattgtaaatatcaattaatcccagaatttattgatggtcttggatatggaaatcatgaattgtattattctgaaactagaggaatccgtcatgaaccagaaaataagattattttaaatattagatatgaaagtgtgatttctgtatctttagagaggtcatttgacagtgatttagacttctcctatttgcaaattactcaagcaaataatgagaaattagttgctgaggcaaatttaacatggggagtagcaggaaataatacgaggctttttttaaggactaagttaattccatctcaatatttaatagtgatcggttctaattttgtcaaaaatgaagatgatttagagaaaattgataattcgtattgctcaccaatcaattttgaatttggtctaactactcctgatattataaattcgattagctcattatctctcaacgatccttttaaaaagcctcttattaatttgagctcagacgagaaatacgaattcataaatcaaattgatgattcttttgtggtaagaacaaccccattaggaataaactattcaagtaagctttacaaagctactattttatggtcaaaactttttgttattccatcatcaaggtcaaaagaagaaaagctgcttaatttgtacattgagctcggttttaaattttctagaatgccattacaattagttattgaacctttaagagttgagcaggctcatcgtgaattagagagtcatcaagttagcgaaagtcttcgtagcagggtattttttggaactccaatttacaatggccagctgtttaaggaaaacatatctcaaaagtcatttcgaattgtagttattgcgccttggatggaacacattcctcgctttgcaaaatttgatcttaagatagcagtttctttccaaacacattcagaaaagctttctgacgagattctttccagccaaaatgtctgtaatctaccaaaattaccaacaataattgtacaagatgggctatatgctgaaaagtttcaagatttgagaaagcccaatgctatttcgtcaagctacctattgtttggcccaaaaattaatttacagggaccattcgcgtccttaacatttcataccaaccatgctattaatatcaaaatttctaggcctagcatactttatttattatcctatcatgatcactctgacatagccatagtcctatcaaggtcgcctgagatctcagaagaagatgaagatcttgaatttttctccgacgatatctttgattcaaacgattccactggctataccactaaacctactctctgcacttcaaaaaacctaaaccatattggggtaacctcaaaggaaatgaatcttatatattgcaaaattaacgagccaggagattactatctgcacattcacagctacaagatcagcgaaacccagaattctgtttctctttgcaccccatttcattttcttctcgaaatattccctgtttcatctaataccagtggttgctcacatccaattaatgcgcacgactttaagttgcagatatccccgaacccaaataataaattaaaaaggaactatattactcctgatatctctactttgtcaattagttccacagttttaggtatctcgaaaatacatacacaagaatttcgtgtaaaggatatgtctccaacctatttctcaattcaaatacaaattcctgagcatcctctttcactggtattcattaatgtcttattcaatgagaaaatatggatgacactaactccacataatattcacaactttttttcatcagttgggccattagtcgctggaacttataaattgcaaattttttcagctatcccagataacttggacatttatgaattggaatgcatcaagtttgatagtaaaatttctctagttcaactgttaaattttagtggattagagacaagatctagtagtaataactacaagttctccaatgatatttatgaagaaattaattctgaagaaagccaggttccattaaggtgccaaattatttcaaatgacgctttgccacaaaaagatagaccttaa

SEQ ID NO: 3812 - DNA, 1275 bp, Cryptosporidium hominis
atgtttttctcttcaatgccatttgatatgggtggaggatttgatggaagaatgggcggaaggatgtctcgcgaggttgataacaagaaattatatgagatcctagaagtcagccaagaggcaactttaagcgagattaaaaaggcttatcgtcgccttgcaattaaacatcatcctgataagggtggagaccaggaaaaatttaaggaggttagcagagcatacgaagtacttagcgacccagaaaagagaaagatatacgatgaatacggtgaggaaggattagaaggaggaggaggaggagcagatccagttgacttatttgatgtaattttcggaggtggaagacgcgcaggcagtagaggaggtggaaagagacgcggcgaagatttggtaactcacctcaaggtaactttggaacagatttacaacggagcagtaagaaagatggcaataaataaagatactatctgtgcagattgtgaaggtattggtgggccgaaagatgccatccagtattgtgagctttgccaaggccaaggtgtcagagtgcaaattagacaaattggaccaatggttcaacaaactcagtctccttgtaatccttgtaaaggaactggtaagaccattccagttaccaagcaatgcaagaaatgcagcggtagcggatctgtaaaagaacgaaaagttttagaggtcaacatcgacaagggtattccaaatcatcataaggttacttttcatggagaagcagacgaaaagcagggcgaaattccaggggatgtagttttcgttctagatgaacaagaacattctgtattcaaaaggaaaggcggtgatttattcattgaaaaggatatcactcttgtagaggctttgactggtttcaaatttatcattactcatttggatggtaggaagctccttgttaagtcaaatcctggagatattactaagccaagtgacataaaatgcgtaaacaatgagggaatgccaacttacaagaatccatttgttaagggccatctgtttgttattattaacattattttcccagataagcttgacagcaaaactcaagatcttgtcaagacattgcttcctgctccaaaagcattaaatattgatgaagatgacccatcaattgaaattcattatacaagtaataccaagccatctgaggtcaaagaccgcatccaaaaagaggcgtatcaagaagatgatgaggatgggcatcacggaggtgctgaaagagtatcttgccgtcaacaataa

SEQ ID NO: 3813 - DNA, 444 bp, Cryptosporidium hominis
atggaaaggtatgcgccgataaaagagtgggagaaagaatcgtttagtgcctctagttcgaataaaaacaatgtagcaaaacagacaagaattaaggaaaataaaagatacagcagggtggaaagcgactatgactttgagtcaggattaaacaactggacgcaggacgacaactttacgagaccaacaaatacagacagtagcataaatattctagaaaatgcggtttcacagttgaagtcagtgggttatggaatccagtcagaaataaatttacatttggatatgttgaatgagatgaacttgaacatggattctacaaatagaagaatccgaatttctcaaaagatccttaatagattattagaaatggcaagtacaatgacattaaccattattgcattcctactgttcatattattaatcttgcagtgggttttatag

SEQ ID NO: 3814 - DNA, 537 bp, Cryptosporidium hominis
atgattgaagataggaataaattagagaagctactaaggaatgggtactgttatattcatggaagagacaaattgttaaggccaatcatagtttttagagctaaagcttttttagatggggaagaacctgacaatataattcatgtagtttattattggttcgagttcgtaataacaaatatgctagcatggaacagagttgaacagtggagagttatcatggatctccaagatgttactttttacaatgcgcctatttcacttctcaaggatattgcaataaatctccaaaggaactacagaggttatctcgcccagatgtcgtttatcaacgctccaatcatattttggggattatggcaagcaattagtttggttctaccccagtctactagagataaaataacattatgtacctcggattataaatccgagcttctgaagtggataaacccgaaccaacttgaaaaaaagtatcatggaactgcttctgatgtaaattcattcagagagcctgtattgcctcctttgcattaa

SEQ ID NO: 3815 - DNA, 240 bp, Cryptosporidium hominis
  misc_feature (218)..(218): n is a, c, g, or t
atgacgaactctccatctccaaagcaccaaaccccacattctaatagcccaactcaccatgggcatactattaaagaagaccgtttggccaaatatagaaatggaagagagaaagatttaacagtgacgaaatacagaccattagaagtggtaaactttaatcctccaatagatgccattagacatggatttggagagaatgggatgagatatatttncgggagatcttcctttggatga

SEQ ID NO: 3816 - DNA, 321 bp, Cryptosporidium hominis
atgttaatgtatgaaatgagcaaggacatttacgatgactcagactcatttgtttcattactcaaagaaattatttcttcaaagtcaattactgatcctaatttaaactctgtttcttcatcactactcagcaaggggaaaaagacagttaacaacgtagatagaagagcttcaaagggaagaaagataagatatgttcctattcccaaattggaaaatttcatggcttcatctccatctctatattcgaactcctaccttccaggcgcagataatgaagaatttgtcgactgcataatgaagtcattattactagcataa

SEQ ID NO: 3817 - DNA, 849 bp, Cryptosporidium hominis
atggattattatgatgatgaattttatgataggaagaaccaaagcggctcagaaatagaccaagaagaaaccccagatataagtgaatttagtaaaaatgatggtagattgagattcagagcaaattttaatttgcctaaaaaatatgctggagagaaaatatctctatctgattttaaagaaatgagggacagagaaatttctattagagatgaaaactccaaatttggggaggttgcatatgattatagcattaatgatattactggatttgacaatattaatgaagaatactccaattttaagaataatattcaactatctgattctatttccagaaaggttgataaatataaagagttggaagctaacttttctattgtggataatactaaaatcatggataaaatgatatatgataaagaaagaggtgaaaatgtgaaaaatcagcgtaaaatatggtcagatatacttgcaatacgtatcttcattcaaaatgctttaaagttatgcaatcagcttcctccaactggattaatttcgtcattaaacgaagactctaaaactaagttaaatgaaattagaaaggaaatacttgatctaacattaatgaatcaagaattacaaatgtatcttaatcgtaagaataaaagactttcttcaactattttgaacgattcagcaaagtttggaatttattcacgactcaattccaaatcttctaataaaagaattaaagctgagatgaagttttgggataaatataatccagtactagataacactttcgaatggtgtatagatgtttgtgatgaatggaagaaaaatactcaaattgaggtaagttaa

SEQ ID NO: 3818 - DNA, 1449 bp, Cryptosporidium hominis
atggaggtagatttccatactctatactcaaaggcagccagtggttggtctcttttacaattggatccaaattgcgaggaaagccttagaaatgggaaacagttgtggttaaagggcctgaaaaacaatggagagaattgcaatgttccaactgttatttgtacagaagacgagaccttttatcttagacgtgagaaaagtagtaatgtaacatatttagctatcgaatctgaaaatggagaattaattgagatgcaaaatgatgagaactcttctaacaatgaaagctacaatgtaaataaactttcagtagttggaagtttgaacagcattgtagttatgattaaaattcctgctattatgaatcttttcgaggattacacagctagtcatagaaatttaactaataattcacactccgaaatgacttttaaaaagctatttagcacatctcagataagtttgatggagctatataattttttatttgattacagtagcatgatgtactgtgatatagagggaaactggtattcaattaacaacgaaattttgttatttttgttgagctctcttttacaaaaagggatgtcaatgaataaatctttcaggtatatgaatattaaagatgtaaaatacttgcttagagaatctttctcagagttaggatctctaggggaatcttcggaaaatagcattaattacaacgttttaaagcatgcattgagttttgacttaacgttaatccaattgatcaaacatattatcgttgtacctgcagataacaatttaggaaatttggttttcgatgaatttgttgaggaaaacattaaaaatcttctatcttctcctcgaatacaggatcatgcgtctctaagaaacattgacggcatgagagttaacttttcatataagagaatacagggaattcttgctacgtctattttaaaaaaacatcaagttctgaaagcaagagattacattgaggaatttcaaaacattctttcaaactatattcctttagaactaagtgaactagaattcgaatataatgacacaaacgcaatatcagatttagatggcgaaaaaaatatcaaggtagaaactgacttttactatgggttccctttaatcgaaaaccatccagataacacggggatcaggttcgatataattgcgggtcaagcatattacaatcatgaggatgatgcaattatttacttgcccagttcgtcccttccaattgacccacgtaataggctctcaattttgtttcgcaaaaagaagcattggcatatttcggagcttaatgcctacatttctccagttctacagccgagcattaaacttgaagcgttctgccttaaaaattgctatgtttgtgaacaaaatatttttaataaaaattatagacttttttacaataaaaatcttcctctcatgcattag

SEQ ID NO: 3819 - DNA, 405 bp, Cryptosporidium hominis
atgaaattaatattattattaatactgtttttggtacaaatttcttatattaaggttggatatggtttgaatgttgaaaactcaatacatattcaagaaagttctatcaacttaaaaacctctaccaaagattcattaaagtctaaggagtccccggtaacaaacttaaatatacctttggatggaaattcaacagatactaacatattgaatacattggcatcggttttgccacttaaatcaacttctaactcacctgatgatgcaaaagataaggaggcatcggatctatcttattttgagcccaaagtactttatacgacaatccctgtgatcgtcatatgtatggttggtattgcagtgttagcagaactatttggagacggtttcgaatcaggaaagtaa

SEQ ID NO: 3820 - DNA, 621 bp, Cryptosporidium hominis
atgggcctaattagtcgtgagattaggaggcttctgtacagtcctttaattgatctcttaagacttatcgaagtatggtcgaaatataggttggaactccaaaagtcagtacaaaaatactctgcactaaaaatagaatctgcatatttaaatcaaaagtcatgcctatgtttaaatatgtttagcttgaatcaaagttatatttctggaagtgctgaggttattcaggaccaactaaatcattcaaaaaatcttgcaatagaaaaaatgcaggaaattagtcaaatacaaagtgggattgatgaaatttattctcgtctttcaagttttactgaaacatataatgaaatgatttatttgagcattattggaggttcaagctctgggatttccgtcgatattgtattagactttctttgtgaatggaaagaatgcattgaatctgacataaaagttcaaaataaaatattcaacctaatagagaagcttaaaagttatcatacacgagatatccaagcatgcctaagttactttcaatgctcaccatacggagatattttagaaggcaaagaaaattatataaatttgaaaaaatgtctaagagaattcatcacacaatag

SEQ ID NO: 3821 - DNA, 1011 bp, Cryptosporidium hominis
atgcatcaaacaggagcaaggggagtaggcagttctggaattacatctgttcaatgcttgagtagaattctgcgagaatatagagaaatacagaaagagcctagctcttactggtgtgcgtttccaataaatatggatgaaccgtatgagtggcattttactattaaagggccggcaggaaccgagtttgaaggaggaatgtatcatgggagaattatattgcctcactcgtatccattttcgcctccatctttaatgatgctaacaggaaatggtcgcttcgaagttgggaaaaaagtatgtcttagtgctagcaattaccaccctgaactttggcaacctgcttgggggatcagaacaatgttagatgctttgcacgccttctttccaacgccaggagaaggagcaatacattctttagattggagtcctgagattaggaagaagttggctaaagatagcgttaattggcattgtaacacttgtcaggaaacgaatttggaagctctttctcgtctatctcccgaagatcaagctactgcttctaaagaatctttaactcatagtgaaaatccattaatccagcacattaataactgtataaatgaatcaaaatctgttgaaaaggataaaaaaaagaataaagaaactgaaaaaatctcagataaagatgatgaatacgataacactgagaatagccagaaatcagatatatatgaatcaagtagtttggatattacaaataaggatgaatcctccagcttaggtaatgagggtcagtcaagtttaaggtcttcttcaccaactcaacacttagggactgttgagatccctccaaatagacttcctccgaagatttcccagcagagcattgcttggagctttttacttataaaaaagccttcaaatattctcgaaggagtggcaactttaatcgatttactcattggtattttacttatcacaatatttatactttttgtcagattattttctacgtttatcttatag

SEQ ID NO: 3822 - DNA, 2091 bp, Cryptosporidium hominis
atgttagaggaagactatgataaggttgtgcagctttttttggagtggtttggaatgacatatctggagaatgaggagtttaaaaggtctaacaaggatttagagatgctgcagcaaatggttattccagcaataaataagatatttaagaaagtaatagcaacttacagcgaacttatagaattatgtacgagttcagaaaaaagtaagaaaatttctcaaaagagagaagaaatggaaaggatctatagacaaaattttagacttttagtatttacgacaaggctttttttactttttattcaagaaatgtgcggtggaattgttgaagaaaatgaatatggaagagagcaatcgattaagagtttcccaattaaggttattcatgaacttttgggttctcctggaacaaaagaatgtattatatttttatttgaattggctttgttacaagataataagctgctatccgatcaattgtttgactacttggtggaattcccaaatagtattcaaaaagattgttacttggtaagaaaaagactaatcgaatctactaatcgttcatttaatcaccaattattatcaataactaataattttgaattttctagttattttacaggattatcagataaggaggaatctattgtagtcgtgcttttcaaaattaggaacttgatgagaaacctctggaagattgataaaagttacttagacttaatggtttggtggcgaaaaaactatatggaattttttagctctatcagaaacattcaactctccgaactttatgatcaattggaaaataccagaattgaagacctcccgatttcaacattttttgaatctaatgagcattgggagctatcaactctttgtggagtgacaggttatgttctgtatataacttatcagtctatcattgatgggaatgagcaggttgaggaaacagtaacttcatttcactttgagaatcaaggctactctgtttctgagctagttaaagaagcaatcaaattctcaattatatccattctgcttgatcctgcaaactacaaacctgtttggattcttagcctgctacatctatcttcaactgagcacttctctcttacatattctttaaagtttaccagattaacaatcaatttgaatccctctttcaatgattcctgggtgttatactcactgctctggactagcagtataaaacatgatgcctgcaatttaataacttcaattgataattctgaattatctagctctgaaggagtaaaaaatgaagatttcttttgtgataccttaagaaaactatctcctatttcaattaccagtaaaattatttcacttgcatcaaataacagtcatcttaagattccactcaaatttatatatattggttacaacatttcccagatactaagtgacagagaaagcaatgatgatttatgttatggagtaatttctgatatattggagttaaaccggtggctctctcaacaacaaaagaatttaagggaaaaagaagtcgagtttgaaagaacacctagtatatctagtgttagtgtttctccaacaaataagagcaagaaaaataaagaagtcaaagctttttattcagatcagctaggaaggcctattccagaattggaatcaaatttttcacctttaatcactcatccacttttatttaggtttcagctactaatttggagtttgaaactaaaacaattccttaaccacgatgggttacatatatgtagtgagcatataattaatcagctcaacgacgccttcctactcgaaaaaaaaacatttgagaaagatatagatatactagacgaactacatatagatacacatgttaggtcttatataaaaatgctaatgaacaagttttctctcatactaaataattacaaattacaagaagttaaccccttagagacttcaatccattccagcggaatattacaaagtgatcatttaaagaatcaattattttctcaagtgaaatccaagcccttgttcgaaattgatattattgactggagaatgttattttcccctattcacagcttatattga

SEQ ID NO: 3823 - DNA, 1449 bp, Cryptosporidium hominis
atgaaagttgtatatctagtacttcatattttttttattcatcagtttgttgcaactgaagcgttcacatttaggaatcgaaaagaagatgtaagacgcgaactctttagtaactttactcaagaaattgaaaaggctcaatacctcttcgaggaaattgctattagaaacaacaacagcatgatctttaagttattaacttctcggagtgataaagaaggttactctccaaatattattgattcaaatttaagcagttatctaaatactccttctgaaatgatttgtcaaataaaaaatattccagagttttactataaatccaaggaagataaatgttatgttcttttgctttctggaggagcaaacagaggagcctggcaaacaggagttttgagaggtttattgggccagcatatcaccaaatacaacaatactattagatgggatgtaatagggggtgtatcaattggaggaatcttagctcttgctggattattccatgagcctggcgaagaattttcttatgtgaataatttgtggagtctttggtctaatattagacaggactatctttctgattgtacgcttcctatttggaaaaatatccttaaatttgctactcactatataggaggcttttttggttcaaaaaagaaacttagaaattcgatttgcgaccatactcccttatttttctatttaaatgatacttttggtcaccaaattgaaccttataaaaacaaaacatatgtaaaaatgaaacgagaaatggctaataatcatacattgaaaattaaaagaagagaagtgttggtatcagctgtgagatatgaagatggtgaatatatttcatggaattctagctccacaaaactacctgatttaattaatgctacacttgcctctacatctgtgcccggtgcattttcacctgttttaataaatggatcccactatatggatggtggggttgttatgaatatgaacatcgaacattcaattcaagcttgtttcaaattaggtcttgcgaaaagacaagaagatgtagttattgatgcaattgaaactttcccagatacaggaccaaaagttagtgatgaagagtctaacactgaaagccaagaaattacttttacaaagttgttgtcgagaagtttttccattcttcactctcaagttagaggattgaagctattaaagaatgtcttatgtaagtatccaagaattaacttgagatattatatctctccaactattgaagaatataaacaatttcccaaaaatgcatttgatggaaacaatcttacaggtattctccatatgttgagatctggtctgcagaaaggttggagcaacaacttcactagtgttaatgagtgtatctttgattctcatggcaatccatccaatattttgggatcagaacttttttcaatcgatgaatga

SEQ ID NO: 3824 - DNA, 1842 bp, Cryptosporidium hominis
atgggtaaatacgcatggaacttgcatagatggaagacgctatccatcttaattatcttgttcgtaatatctgtggatcatgatctggcacgtaaattaaacctttacgccggatccatcccattgaagaaatcggagctcctttcaacagaacagtgtcgccatgtttacaacagtattgaatctttgactataaactttttatttcgtaaggacaatgatatttgcaagagtagggaaaactctgagaaatcatggcagagaaagttactcaaggcggctcagcctccatacttggaatttcataatgagatttatccaacaaaaatgaacttagaaatggaataccttgctaagaataacagatctgctatgctttcaagcatgggaacaggagatgatcactctaaatgttttattttaggcttttctggctatgggaatagaggaatgtggtcagcagctgtagctaagggccttgcatttcagttctttgacaataacgttcctctaagatgggatatagtgtctggaatttcatctggtggatttaatgctttagtttcgtctcactttgttccaggtggtaatagaactgatacttcattccaaaatgattcaagtttgcttagcacaacaaactctgcacagaaactattcaataatacgtttcttttcaatgatacgagcagcagagaagatgatcttatttgcccaaataatgataaggacattaaacttgagttttggtttaatctcggaggaaataagaaaaaacagaaatgctattccaacccaaatgatattaatattagtgaaatttataattctggaaattctaaaagaatagaaaatgaattaagctttaccaattatctatatgaaatctatatgagagccaatccaaaagttattaatgataattgtttagttcctacttctcaagattcaacaagatggtggtcaaccattcttcatacctttactaattttgggaagaaacctattggtagtttttgtacgatgaaaggttggaaaaagttctatagtgattctatgcttaagtttatgaacaagaaaagggaagctctagtgagtgcttcgaggttttttgatggaactcttattcactggagccttcaatatattttttcccaaatatacaacagaaatatcgataaagaaaaaaatagtcactctactgaagcagatattgaatgggtagagattactaaagatgacgcttctatacttgcagatattgctacggctagcaatgcagtatctggggtttatatgccaatcaaagttaataacgactactatgtatggggtggaatgaggggagaagcaaacattgaagctgctgtagaaaggtgtaaagaaattaagcctggaattaacgaagaggatatagttattgactttatcactggatcatattatagagaagagattttcttatcaggatcatacgttgagctacttggaaaagaacattactttggtaaaatgtttagaagaattaaaaactttttccacagaacaaatgactattctaggccagaccctcctcaattgtttgaactatttaacagagcttgggaatttgtcaccgcttcatctagaggaatgtttccaattcaagcactaaaaagaaaatatcctaatgttaagttaagatttattattagaccaaaaacccttaggttttttccaaaaagctcttattttttccctgaaaccaaagacaagctcctgatcatgatcgatggatactatatgggatataatgcaatcattgttgattctgattcaatagaaataaaaaattcagtataa

SEQ ID NO: 3825 - DNA, 1845 bp, Cryptosporidium hominis
atggcagtctctacagatggagaaatctcattgatttcttcttttgcattggtatgctcagcatcaattggaactggagtgctgattctcagttacggagttatgcaggcaggacttgcgcttggaagtatttttatggtccttgcttcattatgtggatccttaaccgagtctataataattgtttcagcattgaagcttaacgcaaaaagtttgacaagtctgatagcaagagcagttgcatactctgtaataagaaagaagagacaaatcatgaagagaagatgtacatatacaaaagctgaaaaaggagaaggcacttttactaatgaatccaataatgaacatagtactggaaataaggagcttagtaagaaagctgtaggaagccgcaagaagttaggtaaaactgttgtagaagaggatcaagccacccttttaaattttacaagcgagaaaagtaatcaaggacatgctaattggaacgacgtatcagacatggaaagtacagtcagtgacttagactgcgtaagaaatgttttaataaacaattcattactctttgatgatttcaggcaggaattgaagaaaaaactgatttttcattccaggttattaaatacactagtaattattttgattggctattgtataccaacatactttatcctgttcacagattatgtagaggagcttttcattcagttgatacatatcctctctgtcaaatttgcagattcaaattccgcttcagggataatttctttcatcgactcaattaacaataaagtagctcttaatttcctttgctttattctggtattttatacatcgtatcaaccagacatttccaaaatagcaaaattgggcttcctttccctattttcatttataatctttctgctttcagttctttacagatacttcatttccccctttgatggagttatgggaactcctgctgagaattatgaaattggacctcatatggggattcttcaggcttttaaagtattcaactatgctatttattgcttttactcacatttaatttgtattcaggctatttcatccgtgaaaaatataacttacaaaaaggggatttttattgcaattggaacatcagcattgatgttatttatttgcctatctctctcaacagttctaaactttagttttggcactgcactccttccaaatccaactttgaattactctccacttgactcagttattgctcttgctagatttgtatctgcattaacaatgcttgtagtcattccaatgcatgtaatcccatttattgattcaattttgaacgtatacttccttgatagatttgctgaagagatggttgaagaagttgaagaagcaatgattttgtgcgatcgaaattcggaaacaaaaaaaagtagatacagtcagcatagtgtcagctcttactttacactctttgacgatagtcccaaatcacatgcctctaaatacgggaaaaaacaggtaaataaaaatatgcaaaatcattcttcaatcaaatcattctttaataacaaattcatcaactctaattactttagagtcattgcaacatttgtatttttactcttctgtatattttttgctctttcagcaaaaaatgctgctcagtatgttgagctctttgcaggatttatcgatactttcatcatcattttatacccactatatatttatacgaatatctggatgcacagaatgccactagttacaaatattctaattattggctatcttatattctacgaaatttgcgcactaactgctggcgtttatactgtgtatgaacatgttttccatattcattga

SEQ ID NO: 3826 - DNA, 1284 bp, Cryptosporidium hominis
atgtctgttcaaaatactgaggaattagtagactatgaagaggaggagactacaacaagaattgaggaggagtctagagcggatgagggatctaaggtgggtagaggtaattatgtagctattcacgcctccggattcagggactttttcttaaagcctgaattaattagagccataggtgatgcagggtttgagcatccttctgaggtgcagcatgagacaattccccatgctatcacaggtgttgacattttatgtcaagctaaatcgggaatgggaaagacagcagtttttgtattgtcgatcctccagcagttaaatcctgatgaagagagtaagaatgttgaatgcatttgcattggacatactagggagttagctttccaggtgaagaatgagtttgatagattttcaaaatacctcaagaatgtgaagcctcaggtagtttatggaggcatccccatacaaaaggatatagatatgctttcaaactctacaccaaatattttgattggtacgcctggaagaataattgcgttaatcagacagaagaagttagtgactgagggtattgctcattttgttttggatgaatgcgacaaatgtctagagtctcttgatatgagaaaagatgtccaagagatcttcatgagtactccaagaaagaagcaggtaatgatgttcagtgctacaatgacaaaggagattagagatgtatgcagaaagtttatgcagaatcctgttgagattttcgttgatgacgagacaaaattgacattacatggtttactacaatactatgtaaagttgggtgaatctgaaaaaaatagaaagcttaatgatttacttgaccaattagagtttaaccaggtgattatctttgtcaagagtgtttctagagcccaagcactccataagcttcttacagaatgtagctttccatcaatttgtattcatgcagctcttagccagcaggaaagaatttcaagataccaacaattcaaaaactttgagaaaagaattatggtagcaaccgacttatttggaagaggtattgatattgaaagagtaaatattgtaattaattacgatatgccagagaatacagattcttatcttcatagagtcggaagagccggtagatttggtacaaaaggtcttgcaattaccatggtctcttctcaaactgactctcaagtactcaacgacgtgcagagtagattcgaagtcaacattgctgaaatgccaaatcagattgatacttcctcatatatcaatcaatga

SEQ ID NO: 3827 - DNA, 1830 bp, Cryptosporidium hominis
atgattccagaagcaagattagagagagttatgccttccactgaaatcttggatgaaaatccaacggtttcaactgagtgctctaattctgagatttccccaattgcatcttgcaacagatatatttcaggaaaggaaaatttggagagagaaggcgtacaagacgattgtgtctataaagggaatttcttagatgtgcctaatttagactatgacgacaattcctctctttatatgaagaatgaacaagaaaatatagcgtcttgtatttcattggtttcaatgcttatgttctcaatctttctttgctatgctgacagaattataatgccatcttgtattaaaagcattagtgaagagtttcgatttagcaaatctgatcaaggttttattcttggacttttttatggaggttacatttggacccaaattattggtggatatatttcagatacgagcaaattaggtggaaaaggtgtattattcttcggagtaatgttctggagtctttgcatgatatttacttcgtttctttcctatctaggtattgctggatttatcatatgtagaatttttcttggagttggagaaggagtttctttcccagcattaaattctattgttggtcatcatataccttccaaatattcttcaacagtaatttccattatcattgcaagttcatttattggaggaggatttgctgcatttgttactcctccaatgatactatctttgggatggagaggcccattttatatatttggattgattggagttatttggtcgatcgtttggctttttttggatgtaaaaactcttagttggacaaataaaccgagaatttacgagttttatggcgtccagaagaaaaatgattttgaaattcagctacaagatatccaatttaagaataaattgtcattcgagattacccccaagtacaaagcaaatactgatctttttagccaactatctattggagctgagtatttgaataagcaagaacttggaaaaaaagattcttctattgaatatgatattgagaatctaaaaggaaaaaaaaacaaatatcgacaaattttaaactttgcaaaagtgattttattaaatagaagtatatttgctataattgttgctcagtactgccatggatggacccaatttggttttgttacttggatgccaatatacttcacagatgtatgcaaagttaactcagcatatcttgggtattatacaactcccccatgggttttacaagccttttttgtcatattctttggctttttagctgataaacttgtttcctcgtcagtcaagccaatctttgtgagaaaattatttcaatctgtgagtatgtttgttggggcaggatgccagttatcattggttattcttaatcatatgggattaacttccgcttcatatgcaataatggtaatttctttaatgttcattttcaatactatgagtggaggaggagtaaccgtgtaccagtttgatattgctccagagtttcctgctgttgtttacgcaataggaaatacatttggaacaattgcaggtctgttttctgtatcacttacaggacttatcttgaatagattcgaggtggatcttcaggttatagggcatgagctagatgaatctatgttaattgaaagatggaagtgggttttggcaatttttgcgattcacaatataattggaggactattgtttgtgttatttgctgatgaaagacaaatttcattaaaccaacaaagtaataagaacgctgatttggacctcagcatatctaaagatgagcatataaatgaaatataa

SEQ ID NO: 3828 - DNA, 735 bp, Cryptosporidium hominis
atgccaataagtattagaagatatttaaaaatcaattcattcattcttattttggttatttcaatctttttttcatctctggatgcaacaaaaaaggtaattgaaaataaatatgatggtaacaagcaaaaagaagagagtttaagccccggaattaaccaaccaattgaaaactcccagggtgaaaatctcgcactatttgaagcatatacaaaatccctcaagtttgtattagaaggaatgtttggacctgagtattctcaaataatatcaaataaaaagaattatgaaaatttacctttatgtagggaaaatgaacaaatggtaaataaaggctgcaatgtaatgatgtactcctgttcaaagcacaaaaacggaaaattttcgtgttacttctactattggagcttttgccagtgctctaaaccttggaaactcaagttcttaaattactttataccccctttatatgactgttatccttctgtcgcaactgaagaagattttagcctagctttaacctcacaaaacgaagaaaaaataccattagagaaagaattctctaagatctcagaagatttggaaattcctgtcggtatatgtggcactaatgtcgtatttgttatttggatactgttggtatcgtcatttttcacttgggtaatttatcgaatatataaatttggttgctatattaaaaaccaaattacactgtcaaataggaaaaggaggtaa

SEQ ID NO: 3829 - DNA, 1437 bp, Cryptosporidium hominis
atgggaagaaaaggatgtaaaagccacaattttgatagatttataaatcaatatgaagatgaaatggaaggatatgaagaagagcttgagaataatgatgatgggttaggcctatattcaataagcagagcattaaacttaaaggtctccaaattgggaaggaaggctactgtaatgataattggaaatgtttctgcgggaaaaagcacgttaattaattggctgttacaagaaaatatacaaaagacaggaatggctatagaaacttgtggaatatcatttgtagtttcaggtaaacaagttaatgaaattggcggtgaaacagctttaatgattttaccagagctcagagaagttgtggagaggaacccaactctacttccaagtttgtctgttaaaactttcccttctaatcaaggaaggttgcaaagtattaattttattgacactccaggattattagatggcgattcaatatattcttttgatattgataatgtaattagagatattgcaatgtctttgtgtgacttggttttgatatgtattgacccttcaggacaagctctgagtaaaaggcttttaagttttgcgaaatatattgcacaaaatgctcctcgcaaaacaagttttctattaacaaagattgatgaaatccctacggaggaagacagaattaaagtaatatgccaagtcacccagaatcttagctccagcattgcaatcaagcatggttttgatttaatccccatatatattgcaggtgcaaaggacggaacctatttgactttaaacacccttcaatctttaggagagtcgttttcaaattcagaaaatcagaatataactaatgttcgaactaaatctggtaaatcacatgcatcagacaaattatctcaagtaggtaatggcctccccactctaaacagaatcttggaagttgttgaccaaatcgaaaaggttgtggataggaaagtccaggacgacattgctacactactaaatgattgtaaaactttacttgagcataataagtaccttatatataaacaaacacaacttgagaaaaataaagaaaatttataccgacaaaaaaatttgtataaaaaatcttcactattcatcattttactaatgctaattatggctattttccaggtttgtaactattctggattcaaaatcttctctaatagtgaaaccatccaacaaaacggtactgctgtttcttttgacttaactccggaaaatcaaacaagtgtgtggcttttccttactgcttccttgcttacttcacttctattatacagaaatgtccaaaaagaacaacaacaatgtttccacagaagtctcaaaactctaaagaaatatctatccgtcttgaattcgattaattccaaggcagctgacttacacgattcttatattaacatctga

SEQ ID NO: 3830 - DNA, 1503 bp, Cryptosporidium hominis
atgacatcaaataacgagcgttttctatattctagtgaattcaagggagtgatttttgcaggtggctctggtagaatgttgggaccactggcaaagaatatttcaaaggcaatgatcccagtatgtaataagccaatgatatggtaccctttatctaatttgatacaacataggatcagagatatatgtatattttgcgaggaagagtttgagaattccataagaaaatatatttcagagacgttttcaaatgataccataattaaaaggtttgaatttgaagaaacatatcaacaaaatattaaaattattggattaaaggaagatgagtctttattagaatcaaatggtacttggagtattctatcagaatatggaaaagaatttttacgagattctgacttctttgttttaacttgtgatgttattggaccattagatttattaggcttagcaaataagcaccgtcttacacaagctgtatgtactatcttattaacagaaagtcctgatttatccaaaattaaaagttctggaaaacaaacctctaattcaaataatcaagctcaagcaaatccaattggaggaatttcagttgatttgcaaaaagataaaaatagaagtatttttgttatagatgaaaaagacgaagtaattctatctataaaagatttttattctgctaagcaagaaaatgaagttttcgaattaagcaagcttcaattgttttggcatcccaatgtatcattacgtacggatttggtagacttgcatgtatatctattcaaatcctccatttttaagatccttgaaattgcatccgggtcacaaaaaatatccacaattgaatacccagaagatggaattgagtcaatcagactagaacttttaccattccttgcgaaaaatcaacatgtaccaggttctgagctttggggcaggtccaagtttgattgttatcactttctagacgacgaaataactacatcaaacgattcatctgttaaattcactaaaattgaccttcctccgaaaatagaaggtacatcagtatcatatttcctccaaaagctccctcaaaattcttctagggtaaacactatcatggctttacatgattgcaatttggcggcaacgtctcccgcatacttccctgcatggttagctgaagaacatgatatagggacaaatgtggggaaagaggtaatcatcggtcaaaattgtaaccttggaaaaagtgtgcagttaagaagatgtgttattgggtcaaatgttgaaataggagatggctctaagattgtaaactgcgttattttagacaatgcaaaaataggatccaagtgtacaattcagaactcagtaattggccaatattctgagattggcgattcatgcaaaatttcctattctgtaatagaacattattttaaagtggaggccaactcaaaatcgcagggagagataatggaaaagagagatgaactcttcgagatcagtatttga

SEQ ID NO: 3831 - DNA, 2544 bp, Cryptosporidium hominis
atgaacaatacaattgatataaattttaaaactcgaactttctgctcgattgttgcaaaacagacaattactgaaccaaaacttgggatttctctttttgatgtaaacagtggattaatttcagtagcaaatatagaagataatgaacagctttctgaattagagtctttacttgtaaggactcagccaagtaatgtagtttactcagttcagaaagattgtttaagcttaaagcgtttacgtaatgtactagatatgaacaataattggacatgcgaagaaattgagttcccaaaatcatctactgttgaagattttgaagtcataatttctcctttattaaggaggccatgcagcaattatgggaaggagttagaaagtgaattgattagacagtcattgcttaacttaataagacattttcagttagtccagtctaaagagaataactctcagtgtgaaattaagttccttgtaactaaaactttcatgagaatggactctgcctgtgttcaatcattaaggatctttccaagcaagggagaaagtagtaaggcatcaacaaatttatttgggttactgaacaaaactagaactaaggttggtgctagaagacttgaacaatggctaagacaacctcttattgatgagaaacagatcatttcacgtcaagatgttgtagaattcttttgtaagaatgacttcttacgtcagaaactgtatggtattcatatgcgtaaagtttgcgatttagatcaaatagctgtccgatttaggacatttgcttctttaatggcttctgaaagctcaaaatctgagagagaagcaaagttcggtttagaggatatggtcaagttgtatgatagtgtaatgcaatcaggaaatattttttctgatataaaagatgcattggaggaaaataagaactcagattcttctccaagttttgttcagtcagtatatgacctaattcttgtaccattggagtcaacattgaacagatttaaagactatatccgattagttgaaaagaccattgatcttgaagaagcggacaaaggtaactacttaattattccgtactttaccccagaacttgaaaagctttcagaagaaaagaataggatacaatgtaaaatcgaggcccacaggaaggatttggatgcatatctctgcagagaacgtggatataatgaagggtctagagaggctgttagagttataagaggagaaggagctgatacaagtctttgttttagagtcactaggagggacatagaatattttcaagataagaagcgatttaaacaggttagaataaacaagaatgattatatttttaggacaaacgagctaatggacctttcagatcgtgaagaaagagttataaaagaatataataatgagcaagagcaagtacttgtaaaggctttatctgtagcttctacttattggtctttggtttctcggcttgcaggtattttggggtcaattgacgtgcttttaagcttttcaatgacgtctttatgcgcccagattccatttgtaaggcctaaaatggtcaatggggaatgcaatttggcaactgaaatgaaaatctcggaggatggatccactaattgtaattgccgattttactgcaaggaacttcgtcacccattaattgaagcccaaggaacagtttctactactggccagtttgttgcgaatgatgttgaacttcaccgtcatgggaatttattgagtataataacaggcccaaatatgggtggaaaatcaacctatattcgccaaattgctatttgttccttactggcccaaataggatgctttgttcctgctcaagaagcacagatacctataatggatcaattaatgtgtagagttggcgcttctgatgcgcaaatacttggaatttctaccttctttgctgaaatgattgaggcgtctgcaattctaaggagtgcaacggagcgaactttggttatagttgatgaactagggcgtggtacatcgacctttgatggatttggcctcgcatggtccattgcaagttatcttgttagtgagaaaaaatgttatactctttttgctactcattttcatgagctcagttcgcttgcatctagtaccccaaatgtaactaatttaagagtaacagcatctacatctaaagtaccatctctttctaaacaaggaagtggagttctaaagttcttatacaaagttgaaaaaggattcacggacaagtctttaggagttgatgttgcagaactttctggcctcccttcagaaactgtcaagagatcgagggaaaaggctgaagaactaactttggtcgaacaaatctacgtagcccctcaaagctgtcaaaacaaaaagaggcttcagttgattaatgttgcttccaatataaagtcaagtcttgaagccgtcttgaactcagcagagtcttgctctgattctaatttattcaaagaagcaacattaaattcaattcagaatcttagggaattactaaatataacggttgcttcctgttaa

SEQ ID NO: 3832 - DNA, 219 bp, Cryptosporidium hominis
atgtatgattctaaaacatactctccttttgacacctttaacctttcaagtcatattggaaagaaaaattacatagatcatattacattcagtcccgatggcagacttatattagttaaaaccaatttaggaaaaatcttcaccattagttcattcagaggagagctcttccaagaatataaaactgtaaataaatctccaagtaagttcttaatttaa

SEQ ID NO: 3833 - DNA, 348 bp, Cryptosporidium hominis
atgttggaacaatctagaactgttttgaatgatgatttgattaccaaatttaaagcatgccgtgtatttaaagatgctatcacgcctatttcaaatatggattggagtgaagatggcgactcattactcatttgtgaaagcgacacattaagagtatacaccatttcttctggggatatcttcaggattcaccactctaggaagaatagtatggatgcaataaaattcgctcatagtaacaagcaatgccttgtagcttcaaacaaaacagatggtgatgctactatcagactatgggatattcaagaaaatagatatattagggctactaaactttcatctgggtaa

SEQ ID NO: 3834 - DNA, 573 bp, Cryptosporidium hominis
atggagctagacagtgaatgtgctaaggagcaaatgattattcagagacaatttgatgagaagaaaaaacccatttttgatgaaagaaaagctataattgaaaaaatacccaaattttgggctgacactatttccagacatcccgttttccaagataacatgcatcctgaggattttgatattcttgaatatttaaaagatatagagttagaagataatctagataatgaagggtcctataaaattaaattaatatttgatgaggcagtatctgaatttatggaaccaaatattttagtcaagcatattatctttaaagataaccaagaaattgtaaacgaagtaaccaaaattaactggaagaaagagtccccaagatcaattattgaaaagaaatttattgacactgaagagaatgatgaggaatacaaaaatagtgttttatcatttttcgactttttttcagaaaatatctctgatgataatatcgatattggagaaatcatacgtagagatatttaccatgcccctctactatattatcgcgaagatgattctatatcagacgagtag

SEQ ID NO: 3835 - DNA, 804 bp, Cryptosporidium hominis
atggcttctctcaatgatattagtaaaggttcacaggggagccagttaatagatttaaatggctctgagaagagaaatgactatatggactacatgtcacatttgcaaaatagtgctgctcaattgagatatgaaaatagtgttttaaagaatgataatgcaaacttagtatcaaagttggacagagctgtgagtaagagtagaaatggagtagaaataccagaaaatgcaacaacagcagaaattgcagaggcacttgaaaagttgaatgatgaaaactgccgattaaagagagaaatggaacgtttgatacgatcaaatactagatatagggttgcaatgcaaaataaagatcctagcttaattccctctgaagaacaagataaaagtttttttaactctgatgactctggaggaaggttatgccagtgtgaatatatacttaatgaaattctagaagcagtttcttataagttagaaacttatgaaaagcatatctgggaacatagattagctactttaactagtgaaagagatgaaattgctgtccagaatatttcactggtagataggctagctgaaattgaagcaattattaaagtagatcatgttcttgctgaaagatttaatgttcctctagaaggttgtgatgaaaagaatcaaatattaactttacaccgtaagttgggctttgcattggatgtaaaccagcagctcgaaagaagattagcttttgaaacgcagctttcaagatcttggcaaagtaatatgcacacaattgttagtgaggtaagttttttctaa

SEQ ID NO: 3836 - DNA, 459 bp, Cryptosporidium hominis
atgaacgaaattctacctccaccaaaaatttcagctcaggatttgactggaggtttagtcagatcattttcaaaagctcaaaatggcaataatctattttctgctaataaaggagtactaaatgttaaattggataaagttgaggaatctgaagatactggtaataatactcaggtcaaacaggaagtacttcaatccgaggttaataaaaattcaagtagcatttctcaagaaaaaaacaaaagttctcatgaaattcgtgatcttgaggaaggaaatagtactcatagaagtcatcatagtagtcatcatagtagccatcataatactcaccgttctcatactcaaagtcattcttcaactcatagaagccatcaatctggatcgtccaatgatcatcatggccctaaatcatcaaaatctcattcatcatcgtcacattctaagaaagatagataa

SEQ ID NO: 3837 - DNA, 2229 bp, Cryptosporidium hominis
atgtatagagaaaggattgagaagttatcaggatggttagaagatcaagtagttagtggtcatgtatttgaaaagatgaaggaaataagaaatagaagaatcacagatgcaatgattttaaggccaaatttagatgataaccaagaaaagggcaatagtaatgagaaaaaaaatattaaaggtttaggagaaggagaagagttgggagcaatggaaatttatttgaatcaggatgcagaaaggcgagcaagacaattgattcagcgttcgggggtagtaccagcttcaatggatgaattgaagagacaaaatagaaggcttagtcaaattactaatggaaataatggtaaactagataaaaatgctaagaatgaagtcatagaaacatggttatcaagtggaatgatgccaggtgataatcagattgatttaccaaaagagtataatgagtggaaaatgcaaaaaatggttgaaaatttggctcctgatttgagattaagaaagaaattattggaaaattctttaaataagataaaagctgttccagttaatggagaagatttaccagaaaatatggtagatgatgaaaatgtactgcaaaagaactttgaaactagtgtgatgtttgctccacctttggcaatgcctgaaattaaagtaaaatctccaaaaaggatgatgcacagcagaggtagaagtcctgtaaaacatacatctccaaggaagataggaatagatatgaaagaaatagcaaaggttgtagtaaaacaagtacaagatactttggaagcgactattgagaatagtcagattgagattgaagataaaatagattctttaaatgaatatttgaaacaattggaggataaaactaatttgatattggaaaaaagcgagcaaaatagtccaaaattggaaattattaagagtgaatcatttaaagagaaggtggaagtagtaccaaaaaagcagaatttatcactattatcgccagttaaaaagaaaatggaggctccaattcctccaaagaagacaacagttgctccaaaatcaacagaagtagaaaaagaggaacgtgagcaatcgcatgagaaagtaagtgtaaaattttctcagtatttttcaatgtttaagaaaaaaatgttaaaaagttttaatagtatcaatgaattgtatcatgaaatgaaacctgattcaaatggagatatatcaaagcaaaactttaccaaatttttaattaacaataagatcccaggaggaaatatagaacatgcaaaattatttgatgaattaaaaagtcagagtggtttaattacaagattgtcattatttaagaatattcatccattatatgagagttctgatccttctttagaggattttgttaagttattagatgaaatatatgagggttgcgagattcccgtattggtttcaacatttaaagatacatttttgaataagaaaacttttgtcaagtttggtcaggatcaacttttgttgaatgaatcaagtatggattatatttggaaaaattatttgagttctggagaagtaggtattttcaatacttcagataaatttatagaaaaaataatgagtattcgaaaggagttaggattagaagatttggctaatgaaggtattaatgcagatatggaaatttctaaaaaggagaaagaagaagaagaagaaagagagagagagagaataagaaaagaaaaggagaaagaagaagaggaagaaaaagaaagggaaagggagagagaaagaataagaaaagaaaaagaggaggaagaagaaagagaaagaataagaaaagaaaaggaaaaagaggaagaggaagaaaaagaaagaataagaaaagaaaaagagaaagaggaggaggaaaaaaaagaaagagagagagaaagaataagaaaagaaaaggaaaaagaggaagaggaagaaaaagaaagggaaagggagagagaaagaataaaaaaagaaaaagagagagaagaagaaaaggagaaaataaggcaagaaatgaaaaagaagactccatcagttacatcattatcttctgtttcctcagtaaagtcaaaatcagttcagtcttctggtccatcatcatcatcttcctcttcttcttcttcatctgcttcatcatcggcttcatcatcttcttcttcaaaaaaggctcaaaaatgtttcatcaattccttcaagggaaatctatcagaatag

SEQ ID NO: 3838 - DNA, 1413 bp, Cryptosporidium hominis
  misc_feature (1413)..(1413): n is a, c, g, or t
atgaaattgaataagaaattatcatcaagtagtaatattaataagttagattttcaaactcaggaagatttgaatagttttgaaaaagatccaacaaaaagagcaattttaatgaatttagatccagaaacagagaatttaccactggaagatcgattaagaagtagaatcaaggaggtttataagacaggaattgctgcatataaagagatgtgtggtgataaatttggtaataaaaatgcaacattatctgaatttggagattttattgaaaaattgaatatttttttaagtttcgcagaaaacaaagaattttatggaaaaattacaaaatctcaaggtggttctttaactattggttcaatgtattcatatttatataaattagaatcagttaaaaatgctgatcctgagataataggtaatcatttgaaggagatatatggtaccattgaagaagcttttaagaaaaaggatctatttgatcatgaaactattgtagaagaagaatttattaaaatttgtattgattctggatataatcaaaatgcattaaaatcattatttaaagaaatgacaggaaatattgatggtgcatatgttgaagtacaagatgtaatacaatgtttacaaggtcatataacagcaaaagaagtttatgaagatgaatcaaatagaaattcacaatgggcaatttggagagttgtaccacaaagaaaaataccaattaatgaagataaaagaaaatctgaattaaatattgtagtacaagcattaacatctgaaaaaattaaagagtttaaaggaataggaagagaagaattattacatattgcagaaaatttctttatgagagaacaattatcagcatctagtcaaattttagctattgatgaaaaaggttattcactttcagtaatagtttctggagctgttgattctattgaatctttatggtatggcgaaaatatactagaaacatttaaagttggtgatgttgttggaattggaatgtttaaatcagaaccaagtaaacaatttttaagaactaatgaagaaacagtattatggaaattaagtccaaagatatgggaaattaaattaaaaaataaaataaatgaattaaaagatggtttcttagcaattgaagattattttaaacaagataaagtttttagtaaattagattcaaataatcaaaagaagttatatgataattcaatatttacaagatatccatcaaaaacatgtatatttaaacaaggagaattagccaaaagttttatattaatatttgaaggatctgtttcattaatagtagatgaagatttaacaaagattccagaaaattatagaaaaaaatcatcaggaacaagtattggtgataaatatttaatcaatagaatgaaatan

SEQ ID NO: 3839 - DNA, 1587 bp, Cryptosporidium hominis
atgattaacttgatattagattcaccaatatttgaatcaagtaaaaatggtattgaaagtaatatttattccaaaatactagagattttccaggatggaaaaatctgtaaacttgattcaacattaaaatatattacaactcctcaaaatcaatctcttagacgtccaaaaattccaaaaggaactcaagatgttactcctcagaagatggcaattaagaatctagtttttggaatgattagagaagtatatagagctcatggagcagtagaaattgatactccagtatttgaactcaaagatacgcttttaggtaaatatggagaagattcaaagctgatttacgacttaaaagatcaaggtggagaacagctttcacttagatatgatcttacagtacctttagctagatatattgcaacatctggtcttgaccaccttaaaagatatcaaattggaaaagtatacagaagagatgagcctcaaatggcaagaggaagatttagagaattttatcaatgtgatttggatattgttggtcattatgattcaatggttgcagactctgaaatcatcaagattgcaactcaagtattatcttccttttctaattggattgggcaattcatgattaagataaatcatagacaactcttggatggtatacttgaaatttcaggagtacctagtgagaaatttaaaacaacctgctcatctattgacaaacttgataaggaaccatgggaaagcgtgagaaatgaaatgattaatattaaaggcttatcagaatccagtgttgataagattggatcaataattcaattaaaaggaactccatttgatgttttagaaaagattaaatctaatcaagaaatgatggaaaataagaacattatgaaagcactagaagagctggaaactcttttcaagtatacaaagagttgtaacaactgtattaactatctttcttttgatctttctcttgctcgtggattagactattatactggagttatatatgaagccgtattaatctcaaatgagttaaatgttggtagtattgcagcaggtggaagatatgatcagcttattggaatgttttctcagaaaaatatccccgcagtcggcttttctgttggagttgagcgtattatgagtataattgaaaaaaaattcgagacttgtaaaacttacaatcactcctcaaaaggatctttcacggatgtacttatttgtaatattggtgattccttccttgaatatagattcaaaattgcgtcattattatgggataatcacatttcttgcgaaatttcccttacaggaaatggaaaacttagaaagcaactcgactatgcttccaataataatattccttattgtattattatcggagaaagcgaagctttaaagaagactgttcaattcaaattcatccataataaccaatcagaagcagaagcagaacaaactacttctatttcttcccaagaagttcatattaatgatcttgtttctcatatccaatcaattattttacaatttggatcaacctattctaaattctcttcagaattcaaaatgtaa

SEQ ID NO: 3840 - DNA, 2361 bp, Cryptosporidium hominis
atgcaacagatgaatccgtatatggattatcagtttgtgcgaaatcaaaatgacggttttctacgagatgatggaaattttgacaattattatgaatatgagcaaggagaatattatgatagcaacaatcaatactatgaggaggatgaaatgatagaccatgaaataaaccagaattttgttaatgaagaagttagctgttgcccaatggaaatgattcaccgaagacgtcattcattaagttataagccaaatataaagaaaggggtgcgaaggactgataaaagtaggataccaaaatttcgtaatccttgggatgtttatggcgaattacaacctagaagatcaaaagatctgccattaagttatgatgaggcacgatttatacgtgaaatttggcaggatactagagctcaatacgagccgagcgatggagaaattgaagaagaatttctttttgaggaagaatatgatgacttggatgctgaaaaaagaaggaataatctcgttaaaaatggtgcaaatctggtcaggtactcaagacattatgaattaccaactatttcaactattattaagtcttcaaatccagaacaatttagaagtaggtcattctctcctactggagctcgaataaatggaattaatagtcctaaatttaacaaagctaggcgtgggtccagaagccaaattaggggtccaacgcgacaacaatatgaagaaggagtgagggatgatttcaattttgacaaaggctatcaacttaacaaaaatcaatttgaatatgatagaaatctagaaatgcaacatattaataattttagagatagaagatctgcaaatcaagctgatcaaattcatggagaagtattcgaatcaaactatagaaatgctagaaatggtgaaataaatccaaatgaagctttaagggaatcctcaccaaatatgactacaatttcatcaggtcatagaaatactgtattaggagttccatcagagtttgaatattgtaatgacacaaataatcttccaatctcagcaggtggttccagaagggctacttctcctgatctcctttcacctacaaaaagtacaggaagaggccctcctccaaaaataggaatattggaacctgttgagacttctgaaggattgatttctccagttaatcaacacagaacttcagtattgaatactccaagaatgggtaatttgacatccaggtctttagcaagctctaggctaggattaaataaacatggtaatgaccggtctggaaattctccagagaaatttcctgtagttaccccatctggtaaacagaccatagtttttcatatgcttccagattgtgagagtaataactccaaggcaactatttttgctgatccagatactcaaaatgttgtaactgagttacatatcaagcctggcgttgatattaatgtaatatctactccaacaggacctgcaattgaatatgaaatttctgggggaagaaatgcaaaagcacacattaacttttcaaccaatacaaatccagattcttcaataagcattggggatattccaaagattcagactcctagggaatttcaagaactaaaccacgggtatgttgccgattcttctaattcaccaaagggtcataatcacagctatattgaccgctcaagatcacagagcaggaggaggtcctctctggaagaaaatggggtgaaaaatcattttaaaaacaatgaattcactccaaatatggacggaaaaagaacattcaataataatgaaaactatttgcagcattcgcatcatcaaaaatcacatgttaatcataatgcagataattatgaagtaaaaggagagactaatgcttcgaaaaataactccaaaatattaaatagtacaattgatgaagcaggaagaatcttttcagaaatagaaagggatattcaagatcaagcaagagatgttgtagatctaacaagagatatgccagaatattttgaatttgaccaaggaggtgtcacaaatattgaaactaatacagattttcaacatgctgaatcgttgcataatgcgcctagattattggaaaaggactctaataattgtgaagtttttcaaaataaacagcaaactgctatcagtaaatcaattgaaagtaacagtattataaacaatggtgtcacgaaggcccatccaaatccatttcttcctataaaaaaagttcaaaaaagaagtggcttctctggttgtataatgaatacattaacgtgtagtaaggtagaatcaaatgaactcaagacatttagagcattaaaccctgttgaaatggtcaatcgaagttccgaattttattag

SEQ ID NO: 3841 - DNA, 675 bp, Cryptosporidium hominis
atggaattatatcaattaattgctgatgaattaagatcattaggacgtggaaatttggctaatcaatttgatttagttaatagatgcttaatagaagagcaacaattaacaaatatacgtgaaagtttacaaagaaagagtgaagtattagcaaaaatggatgaaatggttacaactagagagaaagcattggaaatgattttatcaaattataatcaagcaatcaaaatggaagaggatcatattgaagaagaaattgagaaaattaaagttgatattttaagaaaactaaattttaatccaagtactggtgtacaaactgaggattcattatcatttacagatactattgttggaccattaatattggatcgaattttaggtaatgatgaaaatcaatcaaaaaatgattttaataataataataataatcataataatgattataagagtaattttaataaacacttttctattattgatcataataatagtgattatgcaattcatgttatgaaaatgtattggaaacctttaatggaatgggatttaaaatgttttgttaagatattaaaacaatgtccaagaatatctatttgtttgagagaattattttcatattttgcaaataccagatggaagaataatgaaacacaaatgagtatatatgggtga

SEQ ID NO: 3842 - DNA, 243 bp, Cryptosporidium hominis
atgcataaggttgtagagaaagtattatcatctagagaagaatatttaccaaaagaattaccagttacttacaaatatccaaaatcattatcatttccaggatatattgaaactttatcaatgtgtatagctaagggtatagtaaataaattatcaggatcattatggagtgagggagatataagaacagaagttattgaacatttggtattatttaatttatatgatacatcaagaatatag

SEQ ID NO: 3843 - DNA, 549 bp, Cryptosporidium hominis
atgttcaggttctttctacttatcagcagacaaggcaaaactagattggaaaaatggtattcatcttatcaacaatcagaacgtaaaagatttatcaaagaagttacgcaaatgatcattaatagacaaggtaaattatgtaattttatcgattggaaagggcacacacttgttgttaaaagatatgcaagcctttattttgttgcttgtattgataaaaatgataatgaacttcttgctcttgaaattatacatcattatgttgaagtacttgatcgatattttggaaatgtttgtgaacttgatcttatattcaatttccacaaagcttattttattctggatgaaattattcttgctggtgaaattgaagaaagcagtaaaaaagctgcattaagagttatttctacacaagattccatgatggatgaaaataaagatcatggtaatattatattaaatggaagttctgttggagttagtatttccacacctaatattgctttatcagctgttaatgctgctaaaagagctggtgctctattttaa

SEQ ID NO: 3844 - DNA, 1278 bp, Cryptosporidium hominis
atgaaagatgaatcagacaataatacaaaagcagaaatgaagaaaactattaatgcgatagaaaaaatggattggaattcaatgaagccttgtttaaaggaatgcattacacttttgggtcttttaatccttataagaatgtatagcgttagagcggagaattatatagcaaaaaaggagaagtctttagaattaagaagaaataatttccaggaatgtttggaattctccaagattctgtttgattattgtagaagaagtacaaaccaaacaatggatcaattaatttcaaaagttttatatttttattcgagaattcacgaaatttgtggagaattcacaaatataagaaatgatgttctggagagctacagaaatgctgtattaaatcataataatatgacccaggcagcatgtattaacttgattcttagaaactatgtcttgactaaaagatatgatttaggattgaaagcattggaaaagatggtttatccagagaacctttcatccggaatacatcaagcgagatatctttattactcagggagaatttactctgctcaacttgaatatcaatcagcttttaatagtttcacccagtctcttaggaagactccccagacaaaaggaagaggatcactaaattttgctctttctgttcagaagtttgcaattgtggttcaaatgctcatgggagaagttccagatcgttccatttttaattcatccgatttaagaaaaggactggtgccatatcttgagcttgtgaaagcagtaagatctggagacatgaaagagtttgatttaaatctccagaagagaggaaaaatatatgaacgtgatggaacgctttcattgattaaaaggctagctcataatgttattagatctgggcttaagactatatgttcatcttataatcgaatatatctggatgatattgctaaatattttggttgggacaattcccacgatgttgaaggagttgtgtctaaagctattttagataaggttgttgatgcaaagattaatgacgatattaaatgcttagagagtcaacaaaagtgtgaaacttacggctcagaatcaatgctcaataatctccattctcgtattgcttttagtcttctcctaagaagtaatgctatcaaagctatggaatatccgcagaacatgcctattaacaacgaaaataatgatgatgaagaagccaggagactttcacaggaagaaattgaggctgctgtcaatagcgttgacgatggaatgatttag

SEQ ID NO: 3845 - DNA, 2883 bp, Cryptosporidium hominis
atgaattgcttatcttggatattgaagcattatacaaaaacttctcatcatccagagttattcttgtattcaattgaagtatcaaatcgtttgattaagctatttagtaagcttggtggagaaactttagtaagtactcgaagaagaagaagggacaaaccaactaatatgaaagattttaatgacgaagattatgatcaagatgaagagctttcaggatttagtgaaatctattataatgaaaaaaccaagttaatgagtttagatgaaatgatggctgattattgtgatggaagagttgtttcgaatttaatgcttattgtaaataattattcaacaaatcattcaaatattaattggcatactgcaagacttgcaaggaaaattattacaactcgtcctccaggagaagtatctaaagtgggagaagatggtcatgaggaaccctttatgcaattattttgtggcttgttctttcaattatcatattttataacttttgcacaaatattaagtgataagagttttcttaatcattcaaaaactgataaaggagcacaagatattatactattatcaaggcatgtaatacaccaattttgggaagtagccaaggtgaatcagtttgtttttatggaattattgttttcaaagaattctgcaagaggacttggtttagcagatccagagagacttaaatccatttttaccgattatgaggaagggatagatgcagcaattgttaatagaatggagactacaggaaatgatgatgtatttgaagcaagaagttttgttaagaataagattaacaaggaaaagcaatcagcatcaaattggacaaaggaggatgatgaagaattgctttcactatatgctcaatacgaggaaaatcctaaatgtatttcaattattgcaagtttattatcggatataaagactgaaaggtctgtaaagaagaggttgagagatttgggtaagatatctaatgaagaagatgaagaagaccaagaagaagagaagaatatgagtcaaacaaaaattaattctgatatgatatttggaattattggatttcataatatttccttagaagaaagtaatgaagatgaatgtagttttgattcaaatattatattaaaggaattacttgagcttttagaggaatctcttactacaaaggaaatttttagtgatggtcaaattgatgaaattcccattgagatcccctcaagcttgccaattacattattggatgataaaaattataaattgattatgtcatctttgggattaaatgatccaagaaaagatcaaagtttatggatgattccaaaggaattaactatagaagaatacaaaaagaatattgatttgtttagagaatatatagaaaaggatatatttgaattagaggaaatagcttataataataatgataatcataaatataattcaagcaattctaactctggaattgagaatttgaagtattcaattaagaatttgaagaatacaatacaagattttatagaggattctgagttatcaggtgaaatttctaatataattgatcatgaaattcctatagaaaatggactattacatttgatttcaagtgaattaaaagtaattattggaaaaaataataatgtggatacttgggaaagaaccgagttggatgatttatgtttctgtttatctcaagaaagattgaatattttaggcataagaaaggagtttgataaggtttatgaatcattgactatgtcaaagttattacattttcttggttttaaaaagacaaggatttctaatgatgttgactttttggttcatttagatagaggaataagaaagaaagattctaatatatttaaaggaagtgaagaaaataataagactagcttatttgatgatgatttggaagatgatttattaggaaatgataatatgaatgattcttcaataaagggttggattcttgactttgagaagattaaacttaatgagtttaaagagagaagtaagatattccaagaattagtgattggaatgactgatataaagataaacataggaaaagatttgagtaggaataatactttttcaaaagagaccatttctaaaatttgtttgggaatttataatttcagaagaaatgctaaggatttgaggattttacatcagattgtagctgttttggataagtatttgtttaaacaaggagatcaaggtaatagtgactatttggtggatatctgtgataataatgatttaattagtattgatgagcatactattcagataatggaatctttgaattgtcaaaaagacgaaaacaataattggtctattaaaagctttattgaatcttacacatacgaaagaatccaagaattaagagatttattacttaaacttattgatctggaaattgttgaattaaaaagattcacagagaaagtcacaggaaagaaacttaaagttaataaggaaaatattagatcaatgaaccaaagcaataaaaaaaggaaagccaagacctttatagaaaagaatgaattagaggaggaagaagaggatgatgatgatgatgatgatgatgatgatgatgagaaaggcaaattggtctctgaaaaaattatgtatggaattgaaggtgaaattgcagatgatattatagatgacatcacagataaaattgatgatagtattaacgcgtatattattgatgaaagtgatgatagatggaagaaaaactgggaaaaccttgagaaaagaatgcttagtgtggaagatgaatgttcattaagtgaattagatgaagatattggtaagattgatcaaataccagataatttatttggagaggatgattaa

SEQ ID NO: 3846 - DNA, 870 bp, Cryptosporidium hominis
atgaaatgtttagataaaagaaacctaaacatttcttctattcaagccaattctttatgtatttcttcattaggtgaaatggttgctgcttcttgtactgatggatctattcaaatattctcaagaagtggtaatttatattcagaaactccttccattattattagagatgcacataattttgacaaaaatgcaaatattaatagtatttctgacatcacttttgttaaatacaatcaagatcaagatcattatttagcaagtagaggagttattgataaatctatcaaaatctgggatatcagaaaagctaataatcctcttaaaaccattaataatcttccaagtgatggaaatgaacactcaaaacttattctctccaaatgtggaacaagtatcgtaacatcttcaacattaattaaagatatggcttcaagtaactccaaaaatagaaatattagtaatcgtactaaaagttctttagtttcatttcaaataaattcattaattggttcagctgaaaataaaatccataaacaacttattaatataaataaccagttaattaccacatttgaatggtctcacgaaattaatcaaatatttgttgctctcaataactcaagtattattgcttattatgatgataatcttgaaattaatccaagtaataatggagttctttctgtttttggaaagaaaagaaaacaccaattccaaggattctccaatgcttctcttgaaacttataatattgaggagcttccggatgggtttatggaaacaaaaagtggagaaatcaaatttgttggatcaagctcaaagaagaagtctaaattatatgctccaaaacatcctaacttttcataa

SEQ ID NO: 3847 - DNA, 837 bp, Cryptosporidium hominis
atgactgaaagtaacagatataaacgtttaagagtatttacagcagcttttagtatgattgttgctggaatatggtggattttggcacttttttcgagatcgtatcattacttgataatttcctttcctataggtaattatctttcaatggatatatctttatggaatatttgggcatcttccgattgtaatccaacaatttttaatggtagattaaattttgatttttgtagatgggttatttcaaatatagatggtaattctattggtgaagttatgagatttctatgtttaagaggatatggactcacttcagaagaatcaaattgtacaacattttctaatttatatacagcttcagcagcaatgatttcatctattataataattgttgtattattaatttcagctcctacttggctattagttttatattttagaggatcaaaaaagaagattaggcccattgtacttactcaactattattagcatctgcagtttcattactttctttatttctctatacttctattggtgggtttcaggctgaatttaatggttttggccactctattaaaactaatcgtctttcctctctattctttaactcttctactttgaattcaggtttttatatttctattgctgcttcagctttaactatttttcttattccatggatcagttacattatcaaaaatattgaatctgaagaatttgactccactacttatgtttcagctcttaaacaaacttactataattatagattggaggatgaaattgctgaaactgagagattaatacataaactaagaactggtcctataatataa

SEQ ID NO: 3848 - DNA, 2145 bp, Cryptosporidium hominis
atggggagtggaagaaaaagaataaaagtagaagaaaatgggaaatcaattgaagttgataaagaactaaatccatggaacaatgataaaccatattcaaataaatattatgaattaagaaaattcagaaaatctcttccagcttggtcagaaagaaaaactttctgtaaattagtaaaaaagaaccaagttgtcattttagttggagatactggtagtggaaaaacaacccaatgcccacaatttatattagaatctggattaggaggaaatttaaagattgcatgtactcaaccacgtagagtggcggcaatgagtgtagctcagagagtttcagaagaaatggatgtttgtttaggtgatgttgttggatatacaattagatttgaagataagacaaatgaaaatacgagacttaagtatgtaacagatggaatgttacttagagaagcaatgtatgataacgatttatctcaatatggagtaattattattgatgaagcacatgagagaacaatttcaacagatattttaatgggatcgcttaaagaaatattactaagaagaagttttgaatcaaaaaatcctttaagattggtagtaatgagtgcaacattagaatcaacaaaatttcaaagttattttggtaatgattcaccagttttttcaattccaggaagaatgtttcctgttgaattaatatataatataaaaccagaaaaagactatttagaagcatcaatacaaaaagtacttgatatacatgagaatgaagtaccaggtgatatattattatttttaacaggagaagaggaaatagagcaggcaaaacaacgtctagaatttttaagttcacctttagaagaacaatttggtgaattagtaataataccattatattcatcattacctccatataaacaacagaaaatatttgataaaactccaggaccaaaatatccaggtggtcctacaggacgtaaagttgtaataagtacaaatattgcagaaactagtgttacaattgatggaatagtttatgtaatagatccaggattttcaaaacaaaaagtatataatcctcgtacaagagtagaatcattactcgtttcaccaatatcaaaagcttcagcaaaacaaagaatgggaagagctggtcgtacaaaagaaggtaaatgttttaggttatatactaaagaagctttcgaatcagaattggcagatcaaacacatcctgaaatattaagaagtaatttaagtaatgttgttttaattttaaaaagtttaggtattaatgatttagttcattttgactttatggatcctccagcacctgaaactttaatgagagctcttgaacagctttattttttagaggcaatggatgatgaaggagagctaactaaattgggaaaacttatgacagaatttccaattgatcctcaattggctagaatgttaataaagtcatcagaattaggatgtgcttctcagatattatctttagcaagtttattaaatgtaccaaatatattcttaagaccaagagataaatcaaaagaagctgattatgcaaaatctagttttgttgatccagatggggatcatttaactttgttatatgcatttgagtcctttagagaagtattatataaggatgagaataaagcaaaaaaatttgcaaaagagaatttcttgaattatagagcactaatttcagcagaaaatgtaagaaaacagcttgaaagaacttatcaaaaacatatacttaatacaagtaatcatattagttctgataatgatcaaatttcaaaatcaaaacttaatatttctattagaaaagcaattacccagggattcttcatgcaagcagcttgtttacataggtctggacattatactacagttagagataatcaagtagtacatcttcatccaagttgtgttttaagttcaaaaccagaatgggtgttatataatgagtttgttctgacttctagaaattttatcagaacagtaactaagattagaggtgaatggttacttgagatttctccaaaatactataatcttgaagatttcccggaatgtgattctaagaagaagcttgctcatcttaattatttttctaataaaaaattctaa

SEQ ID NO: 3849 - DNA, 624 bp, Cryptosporidium hominis
atgccagcagctcctccaatgccagcagctcctccaatgccagcagctcctccaatgtcagcagctcctccaatgtcagcagctcctccaatgtcagcagctcctccaatgtcagcagctcctccaatgtcagcagctcctccaatgtcagcaactcctccaatgtcagcagctcctccaatgtcagcagctcctccaatgccagcagctcctcaaataccagcggctcctctggtaactgcctcttctccagcaatatctcctccctcacaggttttgaattcacagtttgtatcaagtccacctcctccgaaaccccaacaaggattattcccacaggctcccagaccaagctcatcatatatgtcaggaggagatgccatttctggttcagggttgccaaaaacagtttcctccacattaccaccaccaccactacctccatcatcatcttattctgccccaacttctattccaccaattataggaggaaataatccagtgcaatctccacccatgaatactggttcacctttcggtgcatctttgggaggagctgcgcctccacctcctcctcctccgcctcctcctcctggtataagaaggtatcctggagtacaatag

SEQ ID NO: 3850 - DNA, 693 bp, Cryptosporidium hominis
atggatttgggtgaactgaataaggaacaaattgaggatgctcgttctgtttttcaagcgtttgatactgatagaaatggccttgttgataagagagaacttaaagctgcattaagagctttaggctttgatgttaaaaagaaagatattgaattagtctttactggatgttttggaaatagttatttaagtatgagttctggttctaataataaagcattaggaaattctattggaccctctcatatgaatgaatacttgccaaacattggtgggaaagactttgaatttgatagaggagtcaactttgaagagttttgccaaattctagtttatttaatgacaagtcaaaatctatttggtgttggagcattctacggaacctctgatccttctcaagaagtctctccagaatatgttaaaagagtcttttctttatttgatattaataacaccggaaaggttggaattagaagtctaagaactcttgtttcacaaatttctagagaacccctttctttaagtatgagaaattctattgaagctacggataccaccatattttcagatgatgatcttacacaaatgatcaaacatattgatagagatggtgatggatttcttgattttgaagatttttatagagttttccaatattgtcattcaagtacacaaaatgacataaatttctaa

SEQ ID NO: 3851 - DNA, 1374 bp, Cryptosporidium hominis
atgttttcaaagtcttcactttgggctttatttgtattattatttgggtatatttcttttataggcggatttgagccatggggagctcaggctccatatccatctgagctgtttgaaccagatttcattagacaagttcttaaagaggagttaccacaggatattaatgaaactttgttagaaaaatatgtggaactttggacagtatatccacataatttgatgacaactgaattccctgacgtctttcctgaagatttatcattgaaaattcataataagttggtagggaggttatttcttaatgaaacaaagtttgaagactatgataaagataaatgttatgtattggttttaagtggaggttcaaacagaggagcatgggaagttgctgctttaagaggattagttacaagatatagagatgaagggaagatcattaattgggatgttatttctggtgtaagtgtgggagcaattggagcctatagtgtattatttcagaaatcaatatatgaatgggttaatgagctttggaattattggtggacagcacaacaaggaatactttctgattgtcaggtacctcttgaaaaaaatattggtaactggatacaaatgttattaaaaaaaatgattgatccagatgcagtttttcaacatttatgtggaattgcagcaccaagaaagattcttaagaataaatttggttccaataagagaaactcctctagatcagttacaattacagctactagaatagaggatggattatcaaaaacatggtatggctggaatagtactgatgatgaacttttggatgcagtttttgccagtttagcttatccattagtatatagaccaatatatgtgggagggagttattatatggatggtggaattagaggaaatgctaatttgattgatcctattagacattgcatggaattcaaaaatgttacaatagataaagttgttgttgattttatagaaacacaaccaataaaaccaaattggttatggttttcaccagatatcaatattcgttatcatattaatagagcttttgatattttacattttaatattagagggctttcaaaacttaaagaagctgttgagacatttccacaagcaactttcagacattacttgactccaagtagttggaatgattttcaattctggccttctctagcactagacgttaccgatagaccaaaaatgatacaaatgatgaaaatgggactttctgttgggatgagatctggaactattaatcaaacacagttgttaatgtataatagaacaacaattcgaacaaaatcaatagtttcactaccttcacttaatattacttcgagtactttctaa

SEQ ID NO: 3852 - DNA, 423 bp, Cryptosporidium hominis
atgggtgaatcaagatggatgaaacaaacacattccaaaattagagttggtcctgagtaccaagcagtattaccagatctaatagttcctgaaaagaaaactcaagataaaaaagatactgagttaggcgtgcctaatggaactaaatcttcttctttttcttctccctcatcctcatcatcttcctcttccagcaatactgctagatcttcaatcggtacccatcagaatcataaattaaaaattactacgcaaagctcggctactagtaataaatcttcaagatctgaaaaagatttgtcacaagacagtaaaatctcaacttttgaatctagcaataagccaaagagctctataaagactcagaaaacaatatcaaaaactaaaatcaataataaaactagctcaaaatcttcaaaatga

SEQ ID NO: 3853 - DNA, 1491 bp, Cryptosporidium hominis
atggagaatgaactgtgtagatcacgaacaacacgttgggcagatgtggaggcggaggaggatgatttagatatgtccttacctatagaacgaacaaaccaaacatctactacatctgtttctgatgttaacacgaccttgtcatcatcaaatatgaacaattcaaatgataaagcggattcaaagaagaaatttaatattagtaataaccaaagtagttcgtataacaataataataataataataataataataataataataataatagtaataataatggtagcaataacaataacagtggaacagcaaggcaaaataaaaaagtagtcaatttacctagagaggcaccttttatagccaaggttacaaatttagactactcattacaactgaaagacattcaagatttcttcaaaaataacagaatcgaggatgtcaaaattaaactcccaatgaggaatggtaataatgaaggcgttgcaattgttgagtttgaaaactttgatgacttatccaattctgttaataatttggatgggctttgcattggatcaagaaatatccgtgtaaatgcagtaatccaaaaaaacaaaatggatgacaataaaacaatacatcgtggaaataataatatttctagaaatggaggcaatcatagcaataataacagtagctattcaagcggaaattctcaaagtaatagtggccagagtaactttatctcaaacaataatagaggaaataaatctcaaaacatgtcaaacagagactcatcaccagattttaccatagttagaagaatgaatccaactaaatccgacgaatctaacccgaagaatcaatcctcagctaactctagctcttcaaataatacttcgtcttctggatctaagccaaccagctctgctcagaaagactacttctctgataaatcaaaatctgtctccaaatcaagatccaacaactcctctgatcaaccccactcgtcatccaacacacatagtgaaacctctaataattcaactaataaaaacaccgtaacatcatatgaatccgaaagaggtggtggcgccggcggcaacaggcgctggaactttggcgcctccaaggaaaaaggaaggtataaacaatcagggaatgaaagtagtcagttcaggacagtgaagggtagttctggaggaggaaggggaaacgaaagtatgggtagagattttgttggtggaggaggtatttcacgtggaggagggaatagagatggatcagattctaaaagaggtggaagaggatatcaaggaagtgggggtgagagtgttggtaataaccactctaatgctagtagaggagcaggaagcggtagcaatagtggtggtgtatcagagagtagagtgtcatcaggttcgaaagggaaggtattttcacataaaggaggaagtaataatacgagtatagaaacaagaaatagatttgctgcactagatgaaagttga

SEQ ID NO: 3854 - DNA, 1113 bp, Cryptosporidium hominis
atgttagcttcaactggtatacaaccttattttgaagcaccatccatactaatttgtccaattactgtacctgatgttaccgaaaatcatatatttaataaaagaggagaaaatggtgaaattgaattcctagatgacaatcaattctttctagtattaagaagtcaaggtatattaggatataaaaaagcaccagtaagaagatgtggaagaaattgtctttgttttgaaactagtcaaggagattttacaagtttagataatcaaactcttgataaacatcctattgaagatacatttattatgaaaactagtaaaactagaggaaaatcttcatcagatataacagaactgaatttatcaggaagattagatgttgattatttagaactttggatgtttcataaacatttagatcctaataaaagaattgttaaggttggactttatggaaataatactcctttagtacatggtgactttccaaaaactgcaacttggcatataatgaaacttggagatgttactctatttcttttacgtttaattagattcagatcagaagaatttagtttatatcatattatggatttaattttattcttcttaccaaataaagttaataaacataattcaagtttttatatgtacaatatacattctggtcactttattaatccatctttaaataatgaaaactttgttaatgctattaatagaattaaattagctactagagaagatattaatattgaacaagattcaagcagcttaacagtattgcatcttgaagcttctagtaaatttattaaagaagtatataagattggtcaatctatgtctattgctgcattttttggctgtttggttatacttattgttttagttaataatgttggagtttttaaactttgttttaaaagaagaataatcaatgaagaagattcaaatgatgaaattaagcctaaattatgtgtatctgctcctgttaaggctatttcctgttatcttttatctgaaaatcatcaagatgatcacaaatacaaagtacataataatcaagatgaatgtaaaatgccaataaaccttgaaaacatcaacacattagattaa

SEQ ID NO: 3855 - DNA, 3273 bp, Cryptosporidium hominis
atgaataatagaaataaaaacatgaaaggtggggtaaattttagagaaaatttgaaatatggaacttcaggaagagtttcatttcgtcaaggtcgttttaatgaaaatatatttgaaaaatttcaagtaatacaaataaattcagaaataaatgatccgaaagaagtgagtaagttgattagaaatccatggattcgtgaattttcagagtgtgataattggcaggaaggtgggataaaattaaataaattcaataaattaaaaatatctttaaaatcggaattattaatatcatcatcaacaatatcatcaaaattagaattgagagaacaaattattaatgatttaatgatattaggggatgaaatgttgaatagaataagagaagaaacatttaagaaaataactcctgataaagatacagtttggttaagaaatatggcacaagatataaaagctacattaaaagatagaactgaatcatgttcaatattaatacaacaaagcccaatactttatataaatgaaatgaaggtattacaaggaatattagggaattctactaataaaactggttttttgaaaatgattgatacaattttaaatcttttggttcaagattctaattcattatttccaaaatctagacaactcaattttcttcaaaatcatgaaaaattacaaccattattaaaagatcatcatgaaattactattactatttttgaatttgttcaaatatattttgagaattttcttaaacaatggtatttatcatttactaatgtattattaagaatgttagatgatactttatggacaataagaaagaagattattacagtaatatatcatttatcatcttcaattatggagcaaagatattttttagttaattctttagttcataaatttggagataaggaagataaagtagcttctcattcaacatttttacttggagagttaataaaaaatcatagagattctgaaactttaacattagttttaaatatattatctgatcatatttcaaagaatttggatatttttcataaatcattaaattcgaatccaaaaattcatacaatcaatcaagtcacttttcgtaatatatatcgtctaatattattcatttctgaaattaagttgagtaaaaattataattatttttcattggatattaatcaacaaaataataatattacaaattatccaccaccaattaaaattcttaaattatgtctttcatcacttaaagttattgtagaatcaaaaacatgggattatcatactaaaaataaaaatcaggtatctatagtaaaacaaccattgtatagattattaagagttacattaaattgtattaatagatcattaccatatgcagaagttcaaatcaagattattaatgatgaatcatcaaaacaattattacaagaatttgaaactaattacattccaaaattatattatttatgtcataatatacaatgtggatcaatacgtattgtaatacttggtgtattatatcgtatttcaaatatattaaatatattatcagatcgttattatagattattatattcacaattattatatagaccaatatatatatcgaaaaataagaaattacttgtatttttaatatggaaaatagtgaataatccagaaattaattataaggtatctttatcgttattaaaaagatcaatacaaatttctatacataataatgatatatcaatgttgacatgttttttgattattttagttaatgttattaattataatcaatttcatacaaatttgattcaaggtaaaaataaaaaagataaaaaaaaacattctcaagaaatttttaaaaatgatgatcttgagacaagtaatataaaatcattatccggtacctttaaagaaattatattaaaaagtgatgatataattatcaatgaggatgaagatgagaattttattgatattcaattagatgatgatgatgataaaggagacaaaaaagaaaaatttaattataataatataaataataacaaaaacaataatcaaatagtaaattacatgcaaaaagatgacgtgtcaaaaaaagttttatatgattttacaaaaagagatccaaaatatgcaaacagtgagaatattcatttttgggagtttgaattactaaagacatattatcatccattaattgttgaattggtttataagagtatattaatatgtgaggataataataataataataataagagagaatattttcagagtatattaagatttttggagaattttaaattaagtaatcagatacaaacaagaaataataatatgaatatagatggagataaagaaaataatccaatagtaaggatttttgagttatgttcattatcattatttatgcagattttaagttataatccaatagatttgaatttaatattattaaagagtattacaaggaaaggtgatagtggtaataataataatattaataataataataataataataataatagtaacacgagtgaatttaaacgtataagtaattttaaaaaatgggataataaacatattccaagttatttagacttttacaagatttatttccaagattctatggttaaagctatagaatcttataatttaaataattcagattcaatagaaaataaaggtggggataattttgttggtgatgaagaggatgaatttgataattttgaaatagattatgatgaaacttctggtaaaatgattaaatctaatagtaaatatcgtcaagaagatttattagttgattctttagttgatgaattttctggtttgaaagatagagaaggtttaataggtgaagaagatgaagaggtggataatgtggataattttggagaagatttggataataatgatgatgacattgatttacttgatggtgtaaatatggatgatatggatgattttgatgattttgaagactttgatgatttggatggagaaagtgattttgctggagaggagggtgaagaggatgatagtgaggatgaggaggatgaggaggatgaggaggatgatgaggatgatttggatcttataatgaatgatagtaaatctagaggaaaaagaaagttgagtaaatttgaaggaaaaaaagggtttaacatgaaaaagttgaaatcaaatggtaagaaagaattactaaatacagtaacatatgtagatgctgatgaaatggaggaatatttaaagtaa

SEQ ID NO: 3856 - DNA, 2199 bp, Cryptosporidium hominis
atgattagaaaggaagaaaaggtacgtggagatattttaaataagacgattaataagagtgataataataataataataatattaactataataaaaatgagaatgaacttttatcttctttaaatacaaatattacaccattaatgcaattaaaagagaaattgaaggaattaaaaaataagccaagagacgaaatatttacaagtttaaaattgatagagagagattttaaactaatacaagaattgttcacagaacatgtgaagagattttcaattatttatgatcaaggaattggaatgaatggaatacaaacaaatgaagtaaaagaagtggaacaaaaacaaggagaaatagaatcaaaaagacttgagaaacaacttatccaagctgataattcaaatatttgtcattctaatttgatgatgatgaataatatgaatgaaggagtatcttctatagtaattaattcacaaattaataaatcacaattagaacaattacaacaaaactatttacagaatttgattagtaatcaaatacaagttaaaaataacatgatttcaagtaatcttaatgttcctacaggtataataaattcatcattatcttcttcttctcaaataagttcaaatacgaattcaaatattacaacaactagtagaaatattatttcacatccttattatattcagaaacaaccaaatactagtaaaaataatctatcttcatctttagtagaagctactattaataggaactctggtgttaataatcaattcttattgaatcaagcaataggattaggagtaggggttggaattggagttgaaggagttggaattagtcctcaagttgctcctggagttggaattagccctcaagttgctcctggagttggaattagccctcaagttgctcctggtgttggagtaaaccctcaaattgctcctggagttggagtaaactctcaaattactcctggagttggagtgaactctcaaattactcctggagttgaagtaaactcccaagttgtttctggtgttgaagtgaaccctcgaattgctcctggtgttggagtgaatcctcctacagtcgcttctggagttggaattagccctcaaattactactggtgttggagtgaaccctcaaattgctcctggtgttggagtgaatcctcctacagttgctcctagaattggggtgaactctcaaattgctcctggtgttggagcgaatcctcctacagtcgcttctggagttggaattaactctcaaattactcccggagttggagtgaactctcaagctgtttctggtgttggagtgaattctcaaattgtacctggaattggagtgaactctcaaattgtacctggaattggagtgaactctcaaattgtacctggaattggagtgagtcctcccacagttgcttctggagttggaattagccctcaagttgtttctggtgttggagtgaactctcaaattatacctggaattggagtgaattctcctacagtcgcttatggaactggattcaatcttcttcccaaacccactcctggagtcaaagcgagcccccacactacagtcattcccagaactggagtgaatcctcccattgtcacttcaagcgttggaatgaaccctcccacatctattcctggagtcagaacgagtcaccaccctacagtcactcccggcactggaatcaatccccagtcctttccctcaggtgtcagagtcactccgcccacagcccctggaattggagttcatcctcctcctactatagccacttctgaactcagaacaaaccctcctaactatacatcaggtgtcagagttagtccttccacaatccccaaaattgaaatcaatcctcatcctacaaccactttcggtactggaaccaatccccagtcctttgcttctggtatcagagttagtccttccaaaactcccggaactggagttaatcctcctccaattgtttcagggatcagaatcaatcctcatcctactacacccactcctgatatgataagtatgaaccctacacccattatttcaggagttagacttaatcctcatcatacaacttctggagccggaatcaatcctactactactgatcctaatactggaattagagatccctttctaccacaaacatttaaaaaataa

SEQ ID NO: 3857 - DNA, 267 bp, Cryptosporidium hominis
atggcttatacatgtttggaagaatttcataatacaaatatagagaatattgttgatacaagtaattctcaacaagaacaagtatcaaataggcctttagatacattaaaaaaagggaattctaatgaaaaagatactaatgtattagagtcaccaaacatgaattctctatctggaacgacttcagatgggatattattagaagaaggaccaattaagactaaaagattaagagaagatacaagttggattcatccaagagaatga

SEQ ID NO: 3858 - DNA, 255 bp, Cryptosporidium hominis
  misc_feature (9)..(9): n is a, c, g, or t
  misc_feature (55)..(55): n is a, c, g, or t
atggtaganttagagcaagagaattcgactttaagtcaccagattaaccaatggnagactatggcatatagatatactcataatctgaagtttcttaatagggagagtactggtggtcagataaaggatgagtctgatgaattgggaatggaatcacaaactgattctgttcatcgtaattcaatttatgataatgattcttgtactgataatcatttggattatcgaattcctgcagcccgggggatccactag

SEQ ID NO: 3859 - DNA, 894 bp, Cryptosporidium hominis
atgaaggaattaatagcccaaagttctcatacaatagaatattcaggcacgagtccaagaacagtgagtgtatctttaaattcattggactttggactagattcagataactgtgttgaagaggaagaagaaagagtggacgaggtagataaatatagaagcaacttttataatgaatataatcaattaaagaggatagtagagaatatatatttggcgcttgaagatcatgagattgggtggtcattagaggaagtttctataagggaaaatttggataaattatttggagagttagaaaacttgaaagaagcgaatgggaaattagtagaaaagaaggaaatctttaatactgtaaaaagtacttggaatgaagaaaggagtttgcatataaaattatatgatataaaaaaatctcttaactacttagctttgcagctaatgctcggaaaagaacaccagattagtaatagaggaagaaatctagaaattaatcattttactaaatttaggaatactctacagaagtttggattaagctatgaggaatatttagaatataacacattaagaaggaaccgtgataagcaagaaataataatgcatgactatgaaagaaggatcaatgagttaaaggaaatctataaaatacgagaaagttatgaattagctcaaaactcttgtaattattacactcaaaatcaagaatatgataatgataattctaattgggaagtaaaactagagggaaaaaatacgatggaatttttatctgagaaaaacacacgttttttaagtgaaggtgaaaatataattaaatttttgaaaattaaaaatgaattccaaaataaaataatttcaaatatttgcacaattattggtatcactttttaa

SEQ ID NO: 3860 - DNA, 693 bp, Cryptosporidium hominis
atgtcagtactacctcctcaattgggatcagctctacaattaggagcagttatgcaagcaaatgcaaataatgcaagtcctggattagtgactcataggactcccagccattctgtgccaggaggacaatccccaactgtctctcaaacgcataatattagtcaacaatccggttctagcatattagtaccacaagctcatttcgaaagtaattcatcttccaatttattggtggatatattatgtgaagtcgcagattttagtgttgatttagctttaagactatctcaaagaactggcacccaatggagaccaagaatactcaaccataataaacatttgaaaagaccaataactagacaaccattagaggatccaaataaaccaaaaagacctcataatgcttatacactttggtgtgaacatatacgccaaaaagttcgtgaaaaagacccaactagatcattacatattaaagaccttgcagaaatgtggaaaaatcttcctgagctcgaaagatcaccatgggaaagaaaagcacaagatgttaaacaaaagtatcttgtagatatggcagcttatcgtacaacttctgggtctcctgggcaccctcaagcttcttcaggaacacctccgcctaattcaatgcagcaactttctggaatcccaaatcaaagagagttttattcgtaa

SEQ ID NO: 3861 - DNA, 2649 bp, Cryptosporidium hominis
atggccttttctgttatatttttattaaaaaggacaattttgttggtaattatttcaataattttaaaatcaataaatacatatggaattgaaacctacagtgacaatgatcaagtaccaagtggtattaaatttgactatataattgttggtgcaggtgcaaatggactaataacagcaagaagcttactagaaaaatataccagaaggggggatgaaattagtattttgattgtggataaaggaagagaatataaagaaaatgaattgaatgatgaaaaacagactaaagataataaaaaaaataataatgaaaataataaaaaattgaattcaagttataatcctataattgataaaaacgacattaatatatatacatctgaagatggatatatgatatttgattcaagtattgaaggaggaaagacaagttatggcaatactccatttattcccgaagatgtatatagtggagaatattataaatcattaggtttaaattttgatccacaaagattacaagaatcctttgaatttgtgaaaagtgttggagatattgtacaaccaaatgtaagaacatcatgggtaatagctttagagagagcatttaatgaaacaggaacattccacgttggagatgcaaatgaagaagatttagcaccagaagattcattatttgaaaatgagatgacagaaagtggatatgtaagttcatttggaattcgagataacaatttggaatggaaaacagatattgaagaaaatgaatattaccaagattatatggcaaccaataaagataataacctagaatctttcaataacggtgctccagagtacttcacatcttctcattatgttccatatacattcttaacttatggatttagaagaagttttgaaagaagaagcgcaactagacttttaaaaattgatccaagattagttaatcataaaaaattatttaagatacttaattttcatgtggataaagtcatattttcaagtttagataaagatcaaagagaaaatgacaagtttgcggaatgtattcaaggaaaaaggttaactggagggtataattattcaagaatgaaagaagaagtttattcaaaaattgaaagatactgtatcaaatctggaaaaggaaaaataatactatcagctggtgcattaaatactccaatgatacttcaaagaagtggagttggaagtaaagaagatattcagatttcaagtcctggtataaaaaatccaattattgaaaatgaatatgttggaaaaggattaagagatcatcctagtttgagtatatttggtttctttagaggattaagtactgatcatgctcgtattcctagctcggaagcactcttttcaaagcgtaagtttggagctaaatgcaagaaacaggaagaaagggatgatattatacaaggttgtgagtctgtgagtatttcagaattcgaaggttttactaataatattagtgaaatttttgcggaacaaaacatcggtaaagaatgttcagcactaattcgtggtgtaactattcgaattccaaatccatatagtgaaggggaggtattatgggatgaaaataataagagaccaaaaataaggttgggactattggaagatattaatgatttattaatattggaggcaggttttagaagattcgttagattatttagatctataaatatatcaactttattagtaccaaataatagtactcataaaagagtgaacttgtttggtgaccatgtagaaaggaaattacttttaaattttgcagactttggcaattctaataataattatacaagtacttcaagagcaattggaacagaaataaatcatgagaaatgtaatttgagcaatatatcgctttattatgcaagccagaatcaaaattatgggcacattaaagaaaaggaaaatgattcaaatatgaattttaataatctagaaactgagaaacaagaaagtgatcagaaagaagaagaggaagaggaagaaaaggtagctaatgtgcgaaaaggtttggagatctttgataaaagaggtgacttatctaacgatcaattaagaagtaataacggtagatttaattatttgaaggaaatacatgataaatttagatttcaaaatgaaggaatgcactcttcatattatagtattatgcataaatttgataaatcacgaagagatgaggaaaaagatgatataactttgatgaaatatgatgcttcagcttcaattaataatagaattgattcaaggtataatttttttggtcttagaaaaggtgaaacaatcattaatgagagggaagatagaagtaagaatgacgagccaagtttatggaagtccttaccattaattcttccaaaacttccaagttatcctgaacaaatcagagaatatataaagaagaatgtaaaacctggaaatgaatttgttggtacaactgctatagggcaagttgtagagacagattgtcttaggttgattggggctgaaaacttatttatattagatgaaggagttttaagcaagcatacaagttcaaatccaataggaacaagcatgatattgtcaagatatgcaatcacaaagataatgtatgatatgtgttaa

SEQ ID NO: 3862 - DNA, 3957 bp, Cryptosporidium hominis
atgcctcacttttactctttaactctggagtcccacgggtccatcttgtcagcaatccaggggagttatagtgcagcaaaggcccatgaaatagttgtgaatagaggcagaagtcttgaattgttgagattggatgtgaatgcagcccaaattcggagtatttgtttgatggatactttctctctggttagaagtatcagcaatttgagattgattggatcaggcaaagatctaatagttgtaacaagcgacagtggaaatattgtaattttggattttaacaaagacaaaaaccaatttgaaaggatccactctgagccatatggcaaatcaggatgtagaagaattgttccaggtcattatcttgctgttgatccaatgggcagaagtataatgattgctgcaattgaacgacagaagcttgtttatactttaacacgtaaaaataaggatgcagacattctagatatttcatctcctatggaggctcacaaaagccatatggtttgttttgctttagtagcaatggacgttggatttgataatccaatgtttgcaacaattgaacaatcatattctacagaaaacgaagaattacagcaaacaaaaaagcacttaattttttgggaagttgatcttggtttaaattatgtttcaagaaaatcatctcaagtaattacagatagctctcatacattaatctcagtaccaggtgggaatgacggaccaagtggagttttggtttgtgattataaaggtattatatattgtaaagtgggccattcaaatatattttgtccatatccattcagatttggagattcttcagagtatggaacaatgattgtggcttcatctttacataaacttaaaggtttctttttaatactagtgcaaacagaattgggagatatttacagaattaatttaatacacaacgaagggattgttaaagaaatgagaatttattattatgatactatacctgtatgtaactcgttgcttttgttaagatcagggtttctttttgcatcacatgaatttggaaatcatacaaattatcaaattgtttcacttggggatgataaaactgatccatgtacttcttctttacctgactctaatgatttaaaaagagtttattttaggccaagaaattgtcaatgcatacgtaaatccgaggaaatactatctttaagcccaattactgatattaaagttatcgatactaataatgatggtacaccacaaattgttgctacttgtggtagaggtccaagatctacattgcgtgtatgttcatatggaaaaaatgttgaagaaattgcagaaaatccattacctggtagaccaagatgtatatggactttaaagaatggtattgatccatcactatcaggttcacaagctgaagctgctattttggataatatacatcattatataattatttcatttattgatcgttcgcttgtacttactattggtgaacatgttgaagagactaatgatacattattcactttaaatgaaactacaatgtatgctgcttctatgatattttataattcattccttcaagttttggagacacatgtaaagttgattattcaagatagaatttatgactggaaaactcctgattcaaggaaaattattgcagctgattctaatggtcgtcaagtttctttggcattagaaggaggtttaatagtaattttggaattaaatgttaatggtgtttctggaattaccaatacgggaataggaggattagttgaagtgtgtagaagagaaatcacttgtgaaattatatgtatcggcatacaacaattatcttattcaggccagatgagaagtgattatgttgttgttggtacatctacagaaaatgccttaagactttataaaattgattcagcagaaaaaaggctaaagcaaacatgtacccagattttacctaattcaaatagtataccagaaaatgttcagttatatcattctaataaatatggccacttaattttatttgtaggtcttacaactggtgtaatattgagttgtaaagtggatgcaagcaatggttcaattagtgatccaagaagtaaatatttgggcaacagaggagtaaatatatgtagaattatgagagaagattttggtggtgaaatgagtctagtatgtatgtcaagcagaccttggctagttgattcccagacttctggtgtaaattttacaccattacaatatagatgtattgattctatagctccattgaatacacatcaagttaacaatggttacgtagcagtttcaggatccaccttgttaatatttcaagttactcaaggatttggtgaatcattttctcaaagttcaataaatttgagttataccccacgtaaattattaacacttccttcaccacaattgtttactggtttagagactttaatgtcatcaggtactttagatattccaaaggatcaaatgattgcaatagtggagacagatcataattcatttgattttggtactaaaaaagagattatttcagcacttcaaaaactttataacgataaacctttggagaataatacagatgttaaaatggaggaagtagaagaagatgaagaaaaacaaaaaaatgatttaaaagttaaggaagatggtgataatttagtaatggatattgctcaagatgaagctcaagattctgaaaaaacaaaaatagaaaaaatgctatcagaaattggtataccaggtgaaagtggtgtactacttgcagagagtgaagttggaggattttttgcaggagaaggtaaatggggtggctgtgtaaggatagttaatttaaaatcaatggaaactatacaattaataccacttgatacaaacgaaggatgtatttctgcttgtgtttgtaaatttgatgagttagatttgccatgcttagtgcttgggacagtatatggaatgaaacttaatagaggatataataataataataatagtaataataatactgattcagcaaagaataacgataaagaaaatcacgattcttttggagcagcaataaagatattcaaatatgattcaaactataattttgaattagtgcatataactcctattgaaaattcagcaacagcattaactggttggagaggaagattattggtaggtattaacaagactttaagggtttattcactaggaaagaagagacttcttaggaagtcagaatatagaaatattccacaaggtttaacttggattaaagtagttaatgatcgtatctttgctggtgatatttcaaatggtgttttagttttcaagtttaataatacatcaaatcaatttatacttgtagcaaaagacccaatgccaagatggttaacttctgcatgtgaggtattagattatcacacaattgcagtaagcgacaaatttgataatattattgtatcaagggtaccagttgaagcttctgatgatttttcctttgtaacttcatttactgataataataatagtcaatcatctgcgctaatgagaacacaccagattaacactgtagctcaatttcatcttggcgatattgttacatgtttacaaaaatcgcaattaacaccaacatctgcagaggcaattatatatggtacagtacttggtagcattggatcattatctcccatattaaataatgaagatattgagttattatcaaaacttgaaatactattacgtaagcaaaaatcaactttattatcaagagaccatcttatgtttaggtcatattattctccagtacataatgtaattgacggtgatttttgtcagacttttactattttagatagcaaaattcagtcagaaattgcttctaaactagatgttactgttgaggaaatctacaaaaagcttgatgattataagacaaggttattttaa

SEQ ID NO: 3863 - DNA, 297 bp, Cryptosporidium hominis
cttattgaaagattatacagattattaggattagagtctgttgttttagaaaataaggatttaaggggaactgtatgtattgttacaggtggagcaacaggtattggaaagaaagtatccgagttttttgttaaatgtggagcaactgtaataattgcagatatacaagaaaataaaggcagagttacagcttacaaaattaatacaaataactcctctacaggattagcaagatatatgtatattgatttatctgatgaaaagtccattcgaagttttgttaaaagatttacatag

SEQ ID NO: 3864 - DNA, 240 bp, Cryptosporidium hominis
atgggtttgacattctgtcaaacttttcagactgataaagttgatgaaggaggaaattatgataattttccttggtcaacctgcgtaaatcctggatctgtaaatactgcaatatttccaaaagtatttccatatagtttaatatactattttaaatggttcttgcttgatacaaaaatggtgagtttaatttttattcaaatattttcaataattttcattttttttattattatttaa

SEQ ID NO: 3865 - DNA, 372 bp, Cryptosporidium hominis
atggatccaggattcacagataatagtagtatgggtgcaggcgaggggagtaatgacggacatcaaattgagcagaagccagtaatagatcaaggaacaggaggagcttctgatgatagtcagtatgtaacagtcaaggtaagaagtccagatggggaacaagttttatataggattaagaaaaagactcgtttacaaaaattgatgaattctttctgtcaaagaactggccaaaatgaacaatcaattcgtttcttatttgaaggtgagcgtttaaggccagaaatgacagctgaagacgctggattacaagagggagatttgattgacgcaatgatttctcaagttgggggaggaataagaagaatgtaa

SEQ ID NO: 3866 - DNA, 663 bp, Cryptosporidium hominis
atgaatcctaaagtattaattgaatttggatgtggagtaggtaattctttaataccattattacaaatttcaaaggatttacattgtattggatttgattgttcttcaagagcaatttctctgtttgaagaaagatggaacaaaattttggctaatcttgaaaatgatgaaaaaaattcaaaaatatgtccatttaattgtttaaaagattcagataagccatgcactagatttagaggatttgtatttgatatagtacattctgatataccaacatacatttgtcctgagagttttgcagattttggcttattaatctttgtattatctgcaatacatccaaaacatcaccaggatgtgattacaagatgctcaaaatctctgaaatctggagctactttactttttagagattacggaaggtatgatatggcacaactcagatttgctaaatcaagtaaatctaaaatcacagataatttttatgttagatatgatggaacatttgcatactactttactattgaagaaatagaaaaattatttgttaatgcaggattcaaagtaatctcaaatcactattgtcttagagaagttgttaatagaaaaactcaagttactatgcaaagagtttggattcaagccaaattcaccaagatctaa

SEQ ID NO: 3867 - DNA, 2037 bp, Cryptosporidium hominis
atgaaggatttattagattcagatggagaatctggaaatctccatgataccgatactttaaagattaatgaagattataaaagaaaatatgatgaaagaaagagaaaagaagctttatcaaaagcaaaagaactattaaaaaatgatagagaaggagaagatgatgatgagagctattctgagtcagattcatcagatgaagatgaggattctgatgcagaacttttggacttaaagactcaaaataaaatacttgaaactttggataaaataaaaaagaaggaccctagcatttatgataactcacatgtaatatttccagattcatcagatgaatctgatgattctaatgaatctgatataaaatcaagtaattctaatactcaaaaaaatagtaaaccaatgacttttaaagattacgaaagagagattttattaaaatctcaaaatgatgaagaagataatgaaatagttaaaaaaggaatatctaagaaattaggttatgataaggaacaagatgagctaaagaaagcatttcttaaagcagcagaaggattagatgaaagtgaagatgagttattttctggaactctgattaagaaagataaaagtaaggaagagcttgaagaagaagaaagaaatttcaaatcatttcttacacgtaatatagaggaaggaggagacccaatagaatctttaaatagatattggggtcctgaggaagatttggatgaaaatgaaaagtttttaagaaattatatattaaatcaagaatggaaagaatccaataatcagaaaagaattaatgatgaaaactcatcgagttatacaattcagacagaaatggatgaagaggaagacgagaaacatctggaattatcaaatgaatttgagggtatatataattttagatacgaagaaccaggagctaaccaacagattatgggatactctagaaatatatcatccctaagaaggccagatgaacgtagaaaactgaaaagaaaagaaaaaaaagagagaaaagctgaggaaaagctcagaatggaggaggaattaaaggttttaaagagtatgaagaggaaggaaattattgaaaagcttaaaaagattcaagaagtttcaggaattagccgtatttcagatgaaaagttggatttggaaggagattttgaccctgataaacatgataaatatatggaggagctctttgatgatgattataatgaaaagaaggaagatctttcattatgtgagattttggaaaataatgatgaaggattgaatgaattaagtgatgggaatataaaaaatgagaaagaagccaaaaaacataaaaagaagcttttaatgaaagaaaaccaattaaatgacgaatcagaaataaagccaccatctacttatgaagatgatgactatgtatggtggcaatgtgatggttgtttgaaagagattcttccaaataagaaaaaatttgattgtaaagtttgtgagaactttactctttgtaagtcttgttgtagaaataccaaccacgaacatcctcttgaaaagagtcgtgtaccagagccaattaataaagaatttaatgataatgaagaagcggaaattgatgaaatgaccaattctaacaggctgaatttgagatatggagataatgaaaagattaatagtttgttggatgaatattatagtctccactttgaagatgttttagacaatggtaagatgccagttagatttaagtatacaaatgtcgaaaagaatgactatggacttagtgttgaagatattttatcaatggatgataaagcattgaatcaacatatttctttaaagaagctggctccatatagggttgataagaagagaaagtattcaccaccagtaaatacttcaaaggaagcaaaatctttgaataatatgaacaagaagcatcataataagggtaataaactcaaacgaagttattcaaataataagaattcattaaatacatcccatattaataagcatcgtcttgaatcttactattaa

SEQ ID NO: 3868 - DNA, 753 bp, Cryptosporidium hominis
atgaaaatgagaattttctttttgattaatttactatcaatagcaggattgagccaatatgctcatgcaagattaacccgttcaacatcagattttggtttattagaaccacaatttttacctggtacaatcacaactttaatacaaactgcaagaaaaataatcggtgcaaatgtcgaaccagtatcagtaattggggaaggtaaatcccagacaagccagaaagattctgaaaagctttatagtgaagcagtttcatcagctgtttcagtttaccaaaaagcaatgaatgatgctacaaataataaattaaagcaaagagatgttgttactagtatgccagtagttgattcaccaagagatcctgtctgttctgtaatgatttcaggtgaattagctttagctttggatccaagaaatattttcgatgtcgatcttcttggagtaaaaattactaaggatgatttattatttatgacagacctaaagaatccagaaagccttgtaagaagtttctcacttaataaaattgaggttcctttggaatctgttcaaaatagcagaaaatgtttcagaatgtatttcgatggatcgcctgtagttatgtgtgcaaagtctgacgaagagagaaacgaaatgatgaataagttgacagaagctgtaagtttttttatttatttgaattcattcaaatttatacaaaattatcatattaacttgtttgataattactcagatattctgcaaaaatag

SEQ ID NO: 3869 - DNA, 477 bp, Cryptosporidium hominis
atgagtaatgccttgacagtttttcatttaaccaatccattcgatttattacaaggattgagtcatgttaagcttgagagaactacagaattaccagtttctcataaaactttgaggtttttacaagaaaaaattaagtcattttctgttgatggagataatgtagcaaaagaagccattcaaggtattagttcaacaacaggagtcaacttcaaaactactcctttatcacaagaagcttttaaattacaaagcaatacattatttgctgaagctgctgaaaagagaaaggttgctaaatatttacaagagcaaagtggaatgactgaaactgaactcacacaagcagaaattgatccaaagaagaatccagaaaaagctgctgctatcacaaatatgaaacgtgctaaagtacttcttgctcaggcttatattttagaaggtaaggttttatatttaaacaaaaaattaagatga

SEQ ID NO: 3870 - DNA, 207 bp, Cryptosporidium hominis
atgcaattagcttctactagaagtggaaacaacgaaagctttaaatgcgatattctcaagattggtcctcttgcatttgctccaaatagtgaagaaattactgatattatggatggatctcttggattcttgaatggtaatatgttaacaatttactacaactcagtaagttcattcttgatttcttcttttctattcaatatttaa

SEQ ID NO: 3871 - DNA, 627 bp, Cryptosporidium hominis
atggataatggagagaacgaatatggagaacagctgatggcttcagaagaagctgaggattctcagcttgatgatgagattcatgagaagttgattccgtttgagagtaatatagagtttgatgaaacacagttaccagaggaaacaagacaaataattaatcaaaatactcgtgaattgctaagaaatattagttttagcaattcaggtggtttgaaaggagccatagagcgttcttatttagttaggcagcaatcactagcacacactaaagaggaggtagttgatgcttataaacaaagagcaagattagctgcaatggtatctagaagacgtgtaacattacaacatgtaagagctcaatttgaagcggttgcgaagtttaaaagaggtctcaaacataaagataagagtgattcaggtgagactaatattcccattaagtcaaaaactgagcactatgatgaaccaaatgaagattttaatgcaagttttgaggtttctagaccgattcaaagagaatcatcaatgtcttttgcacctgttagattcggtagcatgtctatttccgatacacttgctttacaacaacttgcaaacatgaagataggatcaaatgatgaataa

SEQ ID NO: 3872 - DNA, 906 bp, Cryptosporidium hominis
atgagttcaagaggcagtccatttggaggaagaggccgaggtggaggagggagaggtggaggaagaggaggtggaggtagaagtccaggtggaggccgaggtggaggaggaagaagtccaggtggaggtagaggaagaggtggaggtaaaggaggtagaggaggaggtggaggaatgaagggagggtcaaaagtaataattgttcctcacagacatgaaggtgtttttatggcaaaaggtaagagtgatgcattagtaaccaaaaatatggtaccaggtgtttcaatttatggtgaaaaaagagtagagacaacagatcctgagactaatgaaaagattgaataccgtgtttggaatccatttagatcgaagttaggagcaactattattggaggtgttgctaatatgccaattaaaccaggagcaaaggtattatacttgggagcagctaatggaacaacagtttctcatgtatcagatatggttggcccagaaggtagtgtttatgctgtggagtttagtcacagatctggaagagatttgacagatatggctaaaagacgtcagaatattgttcctattgtagaggatgcaagaactcctcaaaagtatagaatgcttgttccaatggtcgatgttatcttttctgatgttgcccagcctgaccaagctcgtatagtagctttaaatgctcatcttttccttaagaataatggatactttataatatctattaaggcaagttgcgtagattctactgcaaaaccagaggctgtttttgcatctgaaatagataaactaagagccgaaaaatgtaaaccaaaggaacagcttactcttgaaccttatcatagagatcatgctgtagttattggggtttatagacctattaagaagaaggagtaa

SEQ ID NO: 3873 - DNA, 2014 bp, Cryptosporidium hominis
atggcttcaattttaggtcaagaagctgagaagcggcaagattctcatcctgtgacccttcaattgtcaaatcgtctagtcaatttcgtttctggaggatttttggcaaacaaaacaggtatagagtctccttcttacgtttcagataattcccagatctcagataaaacacaaaaacacatggacaaattaaaagaaaaagaacaaattgaaaataacgttccattagcaaaaccagaatattattatttccctccagaattactcactgatgcaagagattttcttgaaccaaaagaaatctctcagttcagaccatatggtagaggattagctaatcctggttggaatacatgttattttaattctattttacaagcattaacttatgcaccttatctttcaattgattgcttaaggaggaatcaccaaaagatttgtaaacatatgaaagaacatttggtttgtattatgtgtatgtttgaagatcatgttaatattatgttggataatacatccaaatctaatataaaaaatgaccaaccagtagtttctagttttatcaaatgtgctcaaaaactaatatggaaaagatttagaattggaatgatgcatgatgcacaagaatttctaaggtatttcttagaagctttacataaatcttgtttacctaagaatttacaaactgatcaaacttttaggaaaatacatcctattgcagcttctacaacttatattggtcaactattttgtggattctttctttctaggattgtatgtcataattgtcaatatacttccaatacatatgacccatttatggatgtaccacttgatattatgggggtatcgaatttagaaaatgctctcaaattatttactaaaattgaatatcttaaaggtgaaaatagatatatgtgtccaaaatgtaatcagagatctgatgcttcaaaacaacttctaattgagaaacttcctccactgttaacaattcaacttaagagatttagttatgtagggcatggaagtagaaaacctaacaaagctatcaatttttcagatgttttagacttacaaccatatatatcttctaagacttactctgaatcctcttatatttacaaattatgggctgtagtatgccattctggtaatactttatcttgcggtcattattatacccatgctaagagtatcgacaacaaatggtattgctttaatgatgattacgttaaaccaacaagaatagaaaatgtattaaatgagaatcataaggcttatttgttgttttactataggagtgattttaataaatatgacttacttaaggattctggtgtctccatagagtccttagagaaatctcagatcattactcctttagctcctgaaatatcatttataaatcttcaacttaaatcaaactcaaaatcttctgtaaatggtaaaaataataattctaaagaatcatcaaattctgaaccaaatttgaatgaatttttggatcaattattaacaaataagtctaaaggagaaagagatttagcccaaaatcaagatcaagatcaatatcaagatccaaacttacaattttatcaaaatcaacaaaataataacaatattagactagttttgaatccaataataaatacggatgtaaataatgagaaattagattcaaagatttctataatatctaaaaataaacaaacagaaaagattattaaggctaagatttgtaatttcaagcttagatccttattactatgcgataattggattactagatccaaatcaagaaggaatttggcaaccattttttatcttaagaaattaaagaaacttggattatcaatgagctactttattaaatcaaaatcaggaaattgtttaaatggaaaagttttgattagtaatattaacaagagtcaaatagacacttgggaagatcttaatttatccaatgatactattacaagcttggaacaagctcaaaaatctcttcttgctcgtt

SEQ ID NO: 3874 - DNA, 690 bp, Cryptosporidium hominis
  misc_feature (18)..(20): n is a, c, g, or t
  misc_feature (156)..(156): n is a, c, g, or t
atgaagttattctcgatnnntcaatccaagatcaagtctgatagagtcaaattgaatgatttacgtagaaaggctaagattgaggcattgaaattacaaaaccaatacagagaacatgttaagtctattattgatttaaagagacaagccaaacanaatggaggattatatcgtccagctgaaccaaaggttgtttttgttatacgtcttaaaggtattaataaattatctccaaaagttagaaaaatcttccagttatttagattacgtcaaattaataatggtgtattcttacctttaaataaagcaactattgaaatgctcaaggttattgatccatttgttgcttatggatacccatctatttctatgattcgtaagttactttataagagaggatacttaaaggttggaaagagaggtagttatcagagaatacgtattcaagataattctattattcaaaagaaacttgcttctaaaggtgtctatggtattgaaggtatggttcgtgaattattcttttgtggagagcaatttaaggctgttacttctttattatggccatttaagctttcctctccaaatggtggatttgttcgtaaatctaccagatttactgaagccagaggtggagattgcggtaacagagaaaatttgatcaacaaacttattgatagaatgtgttag

SEQ ID NO: 3875 - DNA, 393 bp, Cryptosporidium hominis
atggttcgtgtttcagttttaagtgattgtttaaaggctattttgaatgctgagaagatgggacgtcgtcaagttttaattcgtccttcttcaaaggttattatcaaattcttacaatgtatgcagagacgtggttatattggagaattcgaagttgttgatgatcgtagagctggaaaaatttgcattgaactacttggacgtctcaacaaatgtggagtcatctccccacgttatgatgttcctttatctgatattgagcaaattagtaccgatttacttccatctagacaatttggttacattgttttgtcaacatcttatggtattatggaccaagaagaggcaagaagaaaacatactggtggtaaaatccttggtttcttcttttaa

SEQ ID NO: 3876 - DNA, 2991 bp, Cryptosporidium hominis
atggctaaaaataatggaataaaagatttgagttcagcttttaatgtagtaaagtataaaaagaaagatcctcatttgaaagtaataaagagtagaaattctagtaaaatagaaaattcactagataagagaaaagataaattgggatttaacgatcgtgatttccttgaaagaaagaggtctatacttaaagagctatattcagagggaaggaagagtgaatttaatgatgagagagagaagtttgctttaagaaaagattttattggagataattatcaaactttaatagctactaggcaattaaagaagaaagttaagaagagaaagaataattttaatttggatgaagaagaagaagatgataatgattatagaggatattccggtgagaattttaaaaataatactagtactaatgatttagaattcactcatcaaggaaaatctatttcagccttggatgataaggctattcgtaaatatgatggtaatatagatgaggataatgatttcgatgataatgattatactggtaaccgtaaaggagatagtattttagatgagaagaatatgccaggttttttctttggacaaggaaattcagatggaacttctactaagtctagacaggagatatttaaagaaatcatgcaaaagagtaagcttgcaaagatggagatgaagagacatagagaaagtctagaggaggagttggttaatttagataatgcattttctcaagttcaatcaatgctaagctataaacagtcaagaaaagacagagtcaattctttactgaataatattaattctaattcttctgttactgacaataatagtaatgataataataataataataataataatattcggtcatttgacaagaatattgaagaattggatgaatatgaacaactcagaaatcttctaaagtttgatacaagaactggcgtttccgatagaattaaaactgatgaagaaattgcaaaacttaatgctgaaaaacttgagaggcttgaaaaggagagaaaagaaagaatgaatcttgatgattccaatattgacattgacttgagtactgaatcggaaaatgagtactttaaggacgactttgatgatgaagatggcgaagaagaggacggctttgaagaggaagaagaggaagaaaaggaagaaggggaggaagaagaggaggaagaagaggaggaagaagaggaggaggaagaagaagatgaggaacagaaagtagaagaggactgcttcgaagaggaagaagaagatggggagggggaagaagaggacggtgaggacggtgagaacgatgaggagagagtgaaacccgcatctaaaggattcattgatttcgaattaaatgaaattgaagaaattgattggttgttgaatgatgaatctgaaccaaatttaccatttagtgttaatttgaagaaaatcttgaaggaatatagtttaaagggacttatggaatttatgaatggattttctccaaaatctcaatggaaatttatttgcagatttagatcatgctttaacaaaggtgatactgcaatgttgaacgacttaaaacttcttattggtttccttattaaatatccattaaattgcctaagatcagcagaatcagattctgaaaagaagaatatttttcaatttattattaattatcttaagcttatgagtagtcatttattgtttatggcagaaactgatccaaaagaatgccttatcattttcacttactttacatttgaaatttgtcatacaacatttccaagtgtttatcacaaatataaaaaagttgaaaagtttttaaataatgatcttttaaatgtagaaaatgaaaactattatactgaaatattagaagaatgtccatctttataccaactttctgaagatatatatgaactgactttagaacatattgtgatatgcagaatgatgtttatattattcccagttactgatgctcaacatccaatattaactcctgttattatatgcttggaacaatgggctcacagatggagtcaagttgggaaatctttactaaacactaacacaccagatcaagatagtgaagagtttaaatacaaccaaataaggcttgttgggggtagtaacccaaacattagttgcatgattggagtaatctgtctattggagatatccagtattggttatgcaaatagtaaatcgaataataatggtaatgaattgcttgaaagatttagtattggttactttactttatcattaagttgccttaaatggctgttattgtctgattctgataataatatttccattgatgaaaaaaaaatttcattatcaataggaattcttaaatctttaattagagtaatttctgcttttaaagatttacaagggttccacgctataataattcatcttatacgtgaaaatatcaaacaaattaatgaatcattaataaagatggataattgtaaagtattgttaaatttggtttctgaaattgaatcgatctctacagaaattgccaatagacctcaaaaaccaattagtctttgtccaagacaaactccaacaattagatctttgattcccaaaattgatgatccatctgttccatttgctgcaaaagctatgcttagagccaaacatagtcccaaagaatcccaatatgaacatgaaaagaaacattatttgtctagattgaaaaaagaagtcaatactgctagaagacaagccagtagacaacttagaaaagattcacacgtgattgcaagtgcatggcatgaaaatagaacggaaaaatccaataaacaaaatgccaagtataattccttcatgaagatgttagaagacgaccaagctgaatataagaggatgaagactacaggtggaaccatggatacttcaattcaatcttatagagccaataaacaaaacatgaagaagaatcaatacatggttggtaattaa

SEQ ID NO: 3877 - DNA, 1296 bp, Cryptosporidium hominis
atgaagaaaaatcaattagcgttagaattacataaaagtgctaatataacggatttgtctgtattagaagatgaaaaaaagttggtaagatttggcaatagtggaaaattaagacagggaggagaacatttgaagagacctacggagtcagaagaattagagatttatgaaaaaactaaaaaagctttgaatttagtaattgatagaaaacaggatactctttatccatttaaagaaagcaaaaaagaagctaagactgaattcataaaatatagatcgagttctgatactattggatacgatccaaggtttgctgaaagaataattaaagtagtggaaagacctaaagatcctttagaacttcctaaatttaaaaatagaatattgggaggcgtaaaaagggaggaaatggttcctattttaagaccaccatcaaaaaagcttactcaagatgtttttaaagagtggaatattcccccaagtatttcaaattggaaaaaccctatgggttatactgttcctttagataaaagagtgcaagctgatactcgtgatttaattaatatctcagttaatgatagatttgcatcattaagtgaatctttacaacttgcagagaagaatgcaagagaacaaattaaacttagaaatgaacttcaaaaacagaagaaaattagagaagaaatggaaagagaggaaaaacttagaaaattagcagagtcatccagatatgaaagaagtagccatcatcttctttcaaaaattccagaattttatcaggataaaaaagaaggatcagatgaagataatgacgaatttgatcatattagaagaatagaattagaaaaaaggagagaaattgaaagagaatttaggcaggaaagagcagggaaaaaatcaaaaacattacgtgatagcgatagagatatttctgaacatattgctttaggccaagctcagtctgctaatattgggtcttcttctgagtcccagtttgatgcaagactatttaacaaggtatcaggattagattcaggattttccaacgatactataagtgtttatgataagccattatttaatacaaataatttaaaacatagaggattatatacttttgaagaaagtagagttgaagaaagtattggaggaagagttcatgtaccttcattttcaggtactgataattccaaaacagctctcagaacaaaacctgttgaatttgaaagggatgaagatgatccttttggattggataaattaattgattcagtaagaaaggattacaaaaagtaa

SEQ ID NO: 3878 - DNA, 501 bp, Cryptosporidium hominis
atgtcatacgcagaaactttaaagaatcaaagtgaatcacttttatcttcagcccaacaaggaattgataaagcacgtgaatatgcagactatgaaaaagcttcaggtttcttgtttccacatccattaggaaaagttggacctcttccattaagaagagtggtgacaatcctttcatcaattactttggctttttcaatctttcaaattttcactgcaatgagttttccaggactcattgtagcaattgcaagatttggagttggagttattggtcttattgcagcttatcaaaaacaagaatcaacttccaagatgtacgcatatgctcaagcactattacttactatcagttcattattgcttgtttcagcaatattctttgcaattatcagacttggattctcagtattttcatttgtagttttgattatttccattattactgttggatttgattactttgctgcttgggatgcaagctcttattatgatgcttga

SEQ ID NO: 3879 - DNA, 999 bp, Cryptosporidium hominis
atgagtgattcaaaagatattattcttgaaattaaattaatgaaggaaagtttggaaagactcattttaaacaaagagtcagaatctacatatggcgaagtaatgaaaattttggaaaagcttgaatcagtttgtattaatcgagaaatactcaagcagactaaaataggggtagtcatgactgcagttaaaaagggcttttgcacagtaaataatattgccatagtcacaaaggctgatgaattaattagaaaatggaaggattcattagcaactaatactcaacaagcaccaaataataatgagaaattaaataatcaaaacgtctcatctacagctaagaaacttaaaaaatctgaagaaaataaaacaaaagatattcaagaaagtcaagaccaggttaaaaacgaaacaaaagaagaaattaaagaagaagaaattttacataaagaatatactggacctttgacaggtgatgtaatgagagacaaagcaagacattttctatggaaggctatggtaacaggcgtcccttattctcaagcaaaattaatgaaagaatcacaagtttgtgaaattgctgcagaaattgaatctgtattacatcgagagtatatagtcaaaggtgataattcagttcgtgattataatttacaacttaaaacaattaaatggaatttaagcgatttaaaaaatcctgaattgaactctaaattatatgttggtaaaattacaccagaagaaattgccagaatgcaaagcagagaaatggcatcagatgcaaaacagaaggagagagagaaacacaaacaggaaagtttggaagcttgtcagtctgattgggatttgaggaatttaatacaaaaagagggtcaatttacttgcggaaaatgcaagacaaataaaacaacatattaccaaatgcagacaagatcggctgacgaacccatgacaacatttgtacgttgtttaaattgtggcaatcgttggaagttttaa

SEQ ID NO: 3880 - DNA, 1434 bp, Cryptosporidium hominis
  misc_feature (660)..(660): n is a, c, g, or t
atgaaccccctttcattaatttattgtagagaaagaaataggtttagaaatgatataaatgaatttaatggaatagtcctaatgaggatcttgcatcatgatcggtattattacagtgataataaaaataaaagaacatgcatttatgaaggggtaacatgtttatgcatagatgcttggaaacaatcatattatactattaacaaattagaaaacaacaaattaacagttaatttgaatagttcttcctcagaatcatctgtttttcaagaaataaattctcacaaagaactaaattctagcaaattctcagtatatcatccaggtgattttcctgttccattatttattagagatgaaatagattatcaaattagtacaagaatgtacaccaatgataatgatattaagtataaacctcatttaattaattggtgtggattgaatattagagaaggcaccaacaaaaagaatcggagtaattcaaaaaatatcaaaggttttacaaatgactcttcaaataatagtattccttattcaatgaaaagttttgcctctattaatactgacgttagctcaaatattttttgtgagcataaagatatggtagagttattattaatttcagaagatgaacttgaaggaggtattgttggattntatacatccaagaatcaattttcttccgaacctatgtgggtaaaaactagttttcctggaataatatttgcatttcttcaacttgaaaagaactggattattgattttctccttcttaaacgtttattatatcataggatgaatccttttaatattatttataggcatttttcaaattcaaatggaaatgatttatcttctcaagattcaggtaatgaagattatccaaacgaacttaatcttgattatgattttcaaaagaaagataaatcatatcttatcacagaatctcaacaaattattgctgatatcgcccaatttcatggtaaattactaccgaatgattggtatcaatggttgattatgcaccaagaaatctcaaaaaacaataatacaaatagtagtataatggaaaataatgaaaaatctaatattgagcatgattttttcaataatccaacattccaaatgagtgataagttatcaaatttaaccaatgaaccatcagaacttttaaagtcaaaatattcaactctttgggtaagatcagagtatcaaatctttgttactcctaatactgtaagagttgcaaataaacatttccttcttaagactttcggactaatcatgtccatcatattttccctcaattatctcaacctgttccattctgtattcccctattaccgaggggaagtacctaaattaactgtttcgcccttgacaaaatttctttcatgtaatcttctcaattcttatcatggtaaagagtag

SEQ ID NO: 3881 - DNA, 348 bp, Cryptosporidium hominis
atgagagcaaatgaattcatttcagagttggagttgaatccagcaacattatctgaaatacaaagaggaggaataatatcagataataatggttcaattttagctcattctgtttcagcttttcccttagatttgactttatattcagaatataaatctactcaagtactaaaacttgcatcagaagcttgtagtatttgtttggagccagtttttggtctttatacacgttgtttaagttgtaagcatggagggcatataaaacatattaaagattggttcgaggataggacaatatgccctatggtaaactgtaaatgcaaatgcgtcctggaagaatggaagtag

SEQ ID NO: 3882 - DNA, 645 bp, Cryptosporidium hominis
atgtcagagaaagaattaattgaaggagtgcagaagatggatatgggttatgattttggtgagaagaagaagaagaagaagagtaaggaacataagacgggagtttctgaagtagaaagcagttatgttgatggatcaggacaattatttgtcaagggtgcaatttacccatatgaagaacttttagaaagagtaagaagattgattcttgagcacaatccagatttgtggggagcaaagagatatacactaaaaccaccacaagttgttagagttggaagtaagaaggtagcttggattaacttccaagaaatttgcaatattatgcaaagaaatgcagaccacgtcttccagtttgtgttaagtgaattgggaactgaaggatcaattgcaggagatggtcaacttgtattaaagggtaaatatgggccaaaacacattgaagttttgcttaggaaatacattatggaatatgttgcatgttctatgtgtaaatctccaaatactagacttgaaagagataatagaacccgtctatatacaattgtttgtgctgcttgtggtgccaatagaagtgtacaaaacattaaaactggtttccacgctgtttctagagctgatagaaagaaggctaaagctgcataa

SEQ ID NO: 3883 - DNA, 1734 bp, Cryptosporidium hominis
atggagaatcaggtaatttcccaagaaaaggctaccaatgagatgaagaaatcgagccaggctcgccttcactacttggattggctgaaaacactggctgtttggctggtagttttcgttcatgtaatttattacttgaacctactaaatattggaataacaagaagtgaaaaggaaattgtcagacaaatgattgtatttttctcagaatttggaatgcccatttttttttacgtttcaggaagagctagttttctttcaagtactccaagcttgggtgtattattaagaaagaagattttacgcttggctttacctttaatttctgggtattttattctattaccaataacacattacgtggcaaatggtagaaggccatgtacttatacattagatggagctcctcccaattttcatctttactatttcatgtatgtcaaagattttaaatgtcatgggtttgaatggctttggtttttagcattattgatagttatttctgtggtgatgtttccctttatgaaggttatgaaaggtcagaaaaagagtgagaatatttcatatataatttcatgtggatgtattgcagcagtttttggtcctattataatatatagttataattttcatccattagcactttttgggctttcatttccactaatgattatgctagtttcatctctagtaatgaaatcaaatagagatgggaaatcaaatctaaatcttgctttaatatatttaacagctgcatcatttatacttggaagcttatttctagcattttatagtaacgttgaatataattccaacacttcaactatttcctctgataaccacaaaccagtttttcctgaaaaagggtttcttagagttattgatgacagaagaatgatgttagctattatattctatatttcattctttgctgttggttttattgatcaactactaagtcattattgttctataaatcatcaaatcattcctgaaaaccaagctttaattggaagttctgaccctctaaattctgaagagtcttctgatttaactataccaataccaagctctagtcaagaagatcaatttaatattagcgcttgcaaagaattcaatcttggtaatactaaaaatcaccaacaatctgttgacaaaataagccttttaaatgattataattattattccagtaataagatccacagtattattaataatatgccaggaatgtttaaaccaactctcattttcatttctttggttttatattcaatcagcttttctttgggtaatgatggcattggatatatgtgggcattcccaatgtatagaataccaagtagctcattattctatgttacaggatcatggattatcgtatttgtattggattcaatatgccattcactacttaatcatgtatttattccaaacttatatttccattttacagcatcatcaattataatatatattgtacatatgctttggcttgaagtaactatgtcttatataatcattccgctccagataccatatttacaatcaatcttccttactttcactattacaacaatattaagtatagcaacatatatcttagcaatcaaggttaaatttatcggatttattgttggacttactaccactttcacttctaaatcaaatagtaattcaaggaagaatcaggtatctgacgcaaagacaaagactcaccaggtttgtgtttaa

SEQ ID NO: 3884 - DNA, 1944 bp, Cryptosporidium hominis
atgccttcatcatctaattatcgtttatcaagtattctttccccaataaaaagtggacccaacaataatttccgagactcctattcaaagatttcaggtacaaattcaaaatttaatcaaaagtataatgattactattttgataacagcaactgtgttaatatcaatgttgaagatgaaactcaacctggtgaaattcagtctctaagtcaaaatgaactacttatctatgataaaaacttgttcagattcaaaatattcgttgttacattactttatatatcaagatcaataattgaaacaaggcatattgttagtaatattgatgagaaaactctgatcactctcaaaatctttcataatatcatatttttttcctgtattttcgcatttacatatatttccggaaaatcattcacaacttcaattctaactttaaataaaaccattgagttaaatcattcaaataatcaaccattcaaccaaaaatcttccagaattatacgtatttttactcatcccaacttcttatctatcaagactgtcatatataaatccattaccaaatattttatacccggattttttatcttatactttattcagcctttttcatattatatctcatcagaatatccaatatgggcagaaagaatcacattgtctcctatcaactttttcttggattcattggatagaatcatatataaagcttcattagatactgcatccaacaaaatttcatattttcctcaagtattaatttatttatcatttatacgtataatatgtttcccaattactgagcttacaaagtatataatagaatgttctcttggagaaatcagaaattctatattacaaaactgctctagaaataattctaatgatattgacttaatggaaacttgcaataattttcccactactgatactaatactaacaatactactacaaatactattggttctgtactattcagtaaatattcaacaattttggatatgaataactcaaatagtgtgagaaaatatcaagaaaatctaaatagtcctttgctaacaaatgagctagagaatagagatattggaattattaatgcaaaaaatcaagcagaatattacttttatgaaagagaattctcattcatttctttgattaataaagctacaattccaatcttggttattttaatgttatactactataagcttggagagttttcaatgcttatattcatcccattagctcttccaatcattacattctccttagccggtcatttatcttcagtaacaaaagtccaaatttctttggctttaacttacattctcttattctttcttttaattccattaaaagattattcaataatttggaagctctgcttaatattcttacttggtgctacagattcacaattgtcatttatgagaacccagtataataattatcttaagaaaagagaagaaatatacatcatacatccactacttaaaagtatttctttattggtattattcttaactattgtttatataacgtttttcttcacagaaaataaatactttcaaaatttaacaatttatttaaatacatttaaagaaatatctctactatttcttatgataacaattacatctcatccacttttcagatctgaattatgccttgttaaaagttcaaatgggatagaaaaaataaagaaagaaaaccagaatctatttattatgatttttttacatcctattacaattcgtattgtatcatttttattggagtccaaaataaagcttgagttacctatatacattaatatattatttataactatcacttcgttacttttaacacaaatattttactatattatattggtattcagttcttttgggtcatttttgaaatcatatattcaattaaaaataaagaataagaattaa

SEQ ID NO: 3885 - DNA, 1215 bp, Cryptosporidium hominis
atgataccacaaggaggattaaacaattcaggaggcggaataatggcttcttcctctgcatctacagtgccaccatcatcttcttcctcctcatcttcatcttctgctccttctatgccattacattcttcaaattcaatggcagcttctgtgccatcttctaattcagtatcatcatctaattcagtacaatcaaattctctttcagcctctatttccatttcaaatcctttatcggctcctccatcatcttctattagtggaaaggtacaacagagaatttcccagggggaacttggaataggtggagggatcccgaatcaaatttctgtttcaggagaagtaggaattttaccatcaccatcagataatagcggtgacttgaaagggaatgaaaatattatccaaaaagaaagagagaaagtgtatcaatatttagttgatatgacttgctcttcaaaaagagaaatggcattatcaaaactttcaaaataccgcgaaacattcccagatttagctccgctaatgtggcatagctttggttgtattactgctcttttacaagaaatcatttctatatatccacttttatctcctcctaatttatcaaatcaagcaagcaaccgaacatgtaattgtttagccttattacagtgtgttgcaagccattcggaaacaagagctcactttcttgcagctcatattccactatatctttatccttttctaaatactgtgactaaatcacgtccatttgagtatctccgtctcacatcacttggtgttattggcgcccttgtaaaggttgacgatcctgaagttgtgagctttcttttacaaactgagatcattcctctatgtttgagagtgatggagactggaagcgaacttagcaagactgtcgcaacgttcatcatacaaaaaattctgttggatgatcttggccttacttatatttgcgctactcctgaaagattctttactgtatgccaagttcttggtaatgttattactcagcataatgaggctccttccccgagactattgaagcatattattcgctgttatctaagattatcagagaactccaaagttagagatgctttaaaacaaaccatcccttctgtcattctttctcccagttttaaaatgatctttcatgatgacggtgttactactaaatggttacatcaactatatgcaaatatttgctga

SEQ ID NO: 3886 - DNA, 1464 bp, Cryptosporidium hominis
atgggatcagcaattaaagctgcttatatggcaattagacatattggtggaaaagttcttttattttcatcaggagcaccaacagttggagatcaaacaataaaacttaatcgtgagcagatgagaaattctggaaaagaatctaaagatattgatagagaagttgaattattaaaaccagaaaatgatggatatagtaattttgttcatgcacttgttagagcatatattagtgttgatttgtttatgtgtacttctcaaccgtatgtagatttacctacaatttctccaattgtcaaaaaaactagtggtgatcttacatatatttttggatttaattcgtatcttcacggacaaaaacttagagaagatatattttcaactttaactagaaactcagcttgggaggcttgtattagattcagagttagtcgtggttggaagatatcaaattggtatggtaatttctactttagtggagttgatcttcttcttgctccaaattgtcatagagaccaagcttttagtattgttatagatatggatgaaaatgtaacagtagcacctgatccatttgtttatattcaagcagctcttttacatacaaatagtgatggtgaaagacgtattagagttcatacaatggctttaccagtaactcaaaattatgttgatttagtatcaagcatggatgttcaagcaacagtttcaataatttgccaaaatgcaatggaactaagccttaaaagcaagttattagatggacgaaattatcttcagactatatgttcccaaatcattttacctcaatccaatcaaataattgaggctgcaaagcaacttccactttatattcttggtgtactcaaatgtccagcttttagagattataaggaagtttctcaatcagatactagaatttatcattggatacgcttatctagtttgagattagaatctcaaatgatactattttatccaagaatgttttgtctttcttcatggaatcttcaacaacaagaaactgatcaatcattagtgcttcctcctgccttaaatttaacagcagaaaaaatgacacaggcagatgcatatctcttagaagatggagaatccatgtatttatggcttggaagagcgattccaacaacctttattcaacaggtgtttggtgttgcaactcttgatcagctacatccagattatgctgaaactgttattggatcaacgggtgaaaagcttggagtcaaagttgctattttaatcaataatattcgtgaacaaagaaaaccaccatttatgaagctttatacaatcagacaaggcgatcctttggaaaataagttcttcctatcactgattgaagataagacacaaggctttatgctttcttacaacgatttcttgaataagattcttccaagatcaaatccaaacatgttgcaaagatatcctggtaattag

SEQ ID NO: 3887 - DNA, 1518 bp, Cryptosporidium hominis
atggatttaatggaattagctttaaaacatgggattaaaggaactcctaatggtccttttttatatccactaagtgtaagaggtagaaaaccattttccttattaacagatgatgaatcttctgatgattctgatcaatcttcatccaacgaggaggacttgggaatgggagcaaaagttaaatgcatatatgacaatgacttatataagaaacaagattcggtaatagaagaagaaaatgtagtcgaacaaaaaaaaagaatgcaagaaacaatgtatgaatataaaagtagaagagaaggaaaagaagtgaagtatatatctagagaagatgcttttgaaatacaatatgcaaaagattttgaatttttttttggagttccttatcgtccttatatacgtttatcacgttatagatttggtaaaaatatgaaatatccaagagatttaaaacaagaagaagctgtttataagaaatatccacgttatttttttaatgacccttggccagaaatagatgtctcaaaacctataccatatgtaaaacaaaaacaaccctcaaagttagtaaatgaaagaggagttccaatagcttggttagatattattgaaaagagtaaaagatttaatgtaagaagaggtaataaatcagcgcataacttagaatctcaaaataagaaagaaccgcctcgtactcttggtgatgctgttgttgcatgggaagtatcttccacattattgaatggagatcttccaagtattattggtgaagataagagaagtcgaaaacaaaaaagattctcatttgttagagataatattcgtggtgttgcagaagaaattgaatcatggacaaaatgtccagtagttcaaacagaaattaataaatatcttgagagttcttggaagaacattgaaaaacaactttctaacaaacctattgaagaacaaaacgataaaaagttaagcagaacaagttcaaacaaaaatattaatgaagctgaaagttcaacaaaaacaccttctgagtctaataaaaattccaagtctgaacctactggtaaaagcagtgatatttctaaaagtaaagtcgtaccttctgctaaagaagagcctaaatctgaaactaaattagaaggaaaagaatcatcacctcctcctccaaaagatcctcctacatcaaaaggcccaccaccaccaaaaggtcctccagctccaaagggtcctccaggtccaccttctgaatctgaaggatctccagcatcaaaaggtcctccgcagccaaaaggacctccaccaccaaagggtcctccaggtccaccttctgaatctgaaggatcccctgcatcaaaaggtcctccaccaccaaaaggtcctccaccgtcaaagggttcaccttcccctgaatcaaaaggtcctccaccaccaaaaggtccgcctcccccttcatcaaagggacctcctacaggaaaagggccatcacttccaaaaaaggcgcctcctccaaagaaaggttga

SEQ ID NO: 3888 - DNA, 2217 bp, Cryptosporidium hominis
atggattatttaagtggctattacaatgatgatgtaactggatcaatttttcatagagacccagatttaagatgttgtagttatttagcttatccagaatctgatgagtcagtatatggagattctgaaatacaacttaaactttgtattatggaattatatgattttctttataataagaacaattcgttaataaaagaaaatcaagattttcaacattctgaattacttaaaattattactgaaatttctagtattatatcagtgtgtatagaaaccaaagtagatattaaagattctattgatgttcaaaatagccaagtacaaagattaactgaacaaaaaagaaatattgaaaggattggtgaaactgttggaaataataacatgttaatagatattgttgataaaatctcatcttctattcaaaataaattgttctgtttatcaaagattgtaaatacggttgaacagttttctttaaaacaagaagaattctatgataatgaatatggtttaactcctttaaaaattaaatatccttatttaactggaacatatacacagttaaattataataatataccaaatagtccacaaactacttatcaatatcaagaaagtaaagtcaacataaataaagaaactcctgataatattgggatgaatttaacaaatattaaagaatatgttgttaataatgatcaatttaatcaatatgaatataaaaaaggttatcaaatacttcaagaagctgaaaggaatgcaatgattaaattaagaaatagaaagaatgctaatttacaagctgctattaaagacacatctaaggaagaagaatatcatatagttaaggatgatcatttatatactaaaaatcaacaagattataatcaacttataaataatacaaattctaataatcaagaagaagaaaaaattggtatttgtgataaattctctggaggaacaacaagattaattatagacaataatagaataaaaaaatcaaatggtaaagattcactactttgtattgatggttggggattaatagaacaccataaggaagatactccagtaagtcccaaatataaatgtaataatttagagtctgaagatgaatctagtttagatctttataaagataataaattattaattaatagaaaatataaattaaatataaacaataataaagaagaatctaatttaagtgattatggtagtggtaatactaatacaacagaaacaaaatattcaagaagaattaataaaagcaaagaaaaatatataaataaaggagatagttcttgtgaagaagataataataataatagtaccaaaaatgtcagaaaactccgaaataaatttgagaaagatttgaaaagtcatattcattgggaaattgaaagagaagaggataatatgaaattacatgaagaatttgaagaatgggaaattaaagaagataatgaaaaaaaagcaacaatgaaaaataataataacaataataatattattagtaataaaaaaaatggagataaaatgatttgtacggaatctaatagaagaaataaaataaaacttgaatattctggatctactatgcctagtcaatatacaaatactaataatagacaactttcaaattatagagataccatgtactcaactagtagttggctacctttatcaaggaatacaggtttcaattacaattgtttatattcaaattctgataagaattcaaataaacaatcaggttcagaatataatccagcagcagaatatgctcgattttcagatgcagtaggaaaagtaattaatcctatagtagctgatgagtcatatagagataatggtaagaatataatgaatccgaaaaaactattcaatgtaaaatttggtactttaacagaagatacatttaaagagattcaagaaaaattgagacttaaaatggaaggatggacaatacatggatcaggattacaagatcccagagcaaatttattctgggatccagctgtaatgactgctgcatcttcagtatcaccattctatacaaatatgccatcctcaaattctcctttattaataaatactctaattcctgcaagtaatgggatacctaaaagatcaggatttttagaatcaattgacccatccagattttctttacataaaagtcttaataggggagaggataagcct

SEQ ID NO: 3889 - DNA, 1419 bp, Cryptosporidium hominis
atgccatcatttaataatgaattttgtagtagattttcagaaaatgattattttaattcaaataataaagatgggaatagtaaaggtataattggattttctcactcagattatattatggataaaggtttatgttctctaaataattgccaatttttacgtataattccaaatgaatgtaaaatttataattccagaaaaagagttcactttttattagcaattgaaattgcagatcttgatgatcaagattatgagcttggaaagaattctcaagatttaatttccaaggatattttaaattatctaaaaaatcatggaattaaacttaaaactgataataatgatgaaaatcaaaatagatcacaagatatattgcttaattttcttaatatactttctgtcggtatttcagaatcaattgatatgggtttatctcaagaagactttaaccaaataacttttattgataataaagattctgatgagattgaagattctagtattcatgataatgaattaagtgatgaagatgtatttattaataaagattggcctcaagaaacttggtcaagtaagattaagagatatagaaaagaatcaccttactcaaaattaaagagttggggtattaaaacacttttgttaaaatcctcagatgatcttagacaagaatatcttgcatctcaattacttcaacaatttgattggatttttaaaattaataaattacccttatggcttcatccatatgaaatacttgtaattggttctcatggtggatttattgaatatattcaagatactttctccatagatagccttaaacgtagattccagactgataatcttttgaattgctttgatcagttatttaaagatgaggaacttaaatctaaagcaaggaaatgttttgttgaaagtcatgctgcttatagccttgttagttatttccttcaagttaaagatagacataacggtaatttcttaattgataagcatggtcatattattcaaattgattacgggtttatgttaagcaattctcctggtaatgtaaattttgagcaaagtcctttcaaattaactcaagaattccttgacgtcatgatgggtgaaaactcttctgatttccaatattttcaacaacttattattaaaggattcttggcttccagaaaacatgttgaccaaattgttttaaccattgaatctatgacttcagcatctaaacttccttgtttctctttatttacaaacaaggaatactttattcaagatattagagatcgtttctttcttcatcttactgaggaacaatgtgttgttaaagtcacagaattaattcaatcttcaataaataattggagatccattcaatatgatgcattccaacgaattaccaatggaattctttag

SEQ ID NO: 3890 - DNA, 3219 bp, Cryptosporidium hominis
atgtcagctcgagcaagaaatttgagagctaataagaattctgctattgcaggaaataacaagtctaattctaaggagctaaattcttcaataaatgaggactattatagaagaataaatgttcaaccagctattgttgatactcctatgtctccaagaactgcaaagtgggtcagagaattgacccctgtattagaaccatataacttcaatctaaatgagatttctgatttaatacatagatgccattacgatgccaatcaaatcgaacttgctgtaggtaatgttattgaggattttagtggtcatgaatcagggcaatggacaaaggttggtaagaataggacaaatggaggcttaaagcaaaataacacaaattctacaaatgtcaataataacaatgtcaataggaataagaattctaataatactaattctattaaatctggtaaacaagcttatttgcaaaataatcaaagtcaaattcaaaaccaaaaccaaaaccaaacccaaagtcaaagtcaaagccaaaaccatgtcgaaggtactaatacaaactataacaagtccaataacaaatctattaagcaccatgtacacggtcatggccacaatcacggtcacggtcacggccatgctcatgctcatgctcatggccaaggtcatgttcaaggccatagtcatgggcacggacagaggcatggacacggtcatggccatactcaaacacaaaaccaaaatcattctcaccaggcaagaacaacaggagatcaaagtctacaacaagaatcaaataatgcttcaaaggtcgcaacaacaattggttcaaatccagttgtcactcatgttagcgctacaaaagcaagtatctccaataatccagtagataacactactacatgggctaatttggctcgcaaaaacaataataaggatgccggaagtactttagaaaagtctcaaaccactaataataacaataaagatcacaagaactcctcaaatgatactataactaaggagaaattatcacaagatcactcagcttctaccagacaacatcaggaacaagaaaacacacaagagacttctagcttaatatcaaagccttttgaaaagactataaaagagcaaattgcatcttcaaattttgtaaacgataatactcaaagctcctctccatcaacctcgaatatatactcaccagattcaatgactggttctggaattactgcaattgaccttggaattaaagttggaggaatttccccaccacatggaatacaaataggtggtgtaattgattataagtcacatggaattggagtatttcttccagaaggtagaacaatcgatcctaatgctaatgatggactcctatttggtagctttggtgctgttgatatcagcaaaattccagaaaatcaagtccaaatcaataatagtatagtttctgataataactccaataacgtccaaaatcaatcatctggggtttctactaattcctcatatacagctggggggggtcacactagtaatattggggcttcaaatgttggcgccatgtcggtagtgacaggtatttcagaaaatacaagtggaattggtagtgctggtgtaacaggaagtcatttattgaatggatggaatactagcggttcatctccatcaaaagatggttctacgagtggtatgattgtagatcaaggactattacaccaaaatgcttcacagagaaatagtggatcaggagtttcatctggaggatcaggtgtgtctggatccaatgtacatacttctataaaatcttctggtattggaaatggatacatgggtcactcaatttctgggagtgcaattaataactataacaatttgccaatagcaggacaaggaatggtaggtagtggtagtgtttattcatcaaatccaactttattatctggtaatagcggtatgaattataacgagacagttgtaggaggtagtactggatcaaatggtggtaattcaagcagtgcatctaatgggaataactctaatatggctttggcagcggcagcagcagcagcagccgcagcagcaaatccatataactatgcatatttgaactatgcaggatatacggcaaatttcccctatatggttggaaatactgcagcatttggtttccctcattatagtactaagccaaatggccatcatcacccaactccagtttttaatcaatactcacaaggaccaaatccaagtcaacatggattgaacggagtatatggaattggaggtggagcaggaggatcaggaaatacggcagttaataacaatacatctggaaatgtgatggtatctgatggtattggcgtgaactatcactcgtcaaataaccaatcaccgataacaatgggaggtaattctgcacataatcatcacatgagtagccaaaatccaagttcttaccaaaatattcagtcaattcttcctccaggtatgtcacaccagcaaatgggtataggaagccagcaaccgaatgcaagtgggaattctctacaaaatcagatgaatttaccaatgagtttcaataataatgggggatcaaatgagtttggtgtagatcagacaattcctcaagcagtttttttaggacaaccaggtactactaataacaataaactggacaatattggagctcatccaggagattttatacatcaccaaagctacggtaaccatcatggccacattcagaatcctacgtctaatgcaaacattaattctcaaggaaacccaaatactggcaatccaaacagtcattctaaaggcaatagccaaagcgctgctagcaactttcaggggaatatgcaatatataggtaaaccagctggatcggggtcgagtaatactggttcgggtactccgaatggtacaagtggtaattccgcacctggcaacccttcaggtgctgtaaatggggcaacggtaggttcaggaatggatttagctcaccaaggccagggagttggaggtaattcaagttctggcaattcaagcatgtttctaccaggaagagcacagaatacggctggtcaggcagggcaagttgggtctgctcaatcaaagcaaacttctgtaaatttcccaggtttccattcgtctagaactggtagtaattctggattcctacaacataataacaatatgtggaataataattag

SEQ ID NO: 3891 - DNA, 921 bp, Cryptosporidium hominis
atgcaaaaaacggtacatgaagaaatagttaacagaaaaggcggggacagattggaaaattggctaataaagaatttatgtatatcagtatttcaatttagtgagcactcaatttatttaaagaattggttggaacactttcatttgaatgatacccacagctatagtgttataggtaataaaaataaagaacaaaagagtccagggttaataaataatactaaaactcctggtagttttgacaatactacagctggtttgttgacaaagcaaagatatagcaataattttactaataaattagaaaatgatcaaccaagtgtaaataatagtttagcactgatttctaacaattacaacaatgaaaatgatcttaagaaagatcagggttatctgctttataatgctaagcaatacctttctgctggtcaatattactactcaaagtctagagctttgtggaaaattactcctggagtgaattcaatgattttaagaactcaatcagatatattaaagtcggtttcaagagggaaggatttgagctcttcaactatacttaaagaaataaataatgatgaaatcattaaaatgcaagattttatgaaaaaaagccttgagaattacaaaagaagagtttctagctcaagtttcatccaaggtgggaaaagacttgaaagtattttcgaattattgtctgatatacacttacaggttttgaaaatgcaacaggatcccacattaattcaaagaagatcattattattgcaatctcaaacctgcattgagagagacatgaatgatgataagaataaggaatttattaaaagcattacaaacgatatctttaatgcagatacacagatagagatattgttacagattgcagagtttattaactactatattctctcagcatag

SEQ ID NO: 3892 - DNA, 1137 bp, Cryptosporidium hominis
atgtttaataataatattcgtaccaaaaatgaagattttttccaatttgacactggaaaccaaataaataaaagaggaaagaatatagagaactctttaaatttaatgaataaagaaaataattcattagataccatttcaaaatctaatattattggaatttctttaaattcttgtattaaacaagatgaagaattttctgaattaagccattttcttaaaggtatttattcaacagattacgaatatcgaccagaaacatttgaagttaaagctttaaatggatattttcccaaaaaaattaaacaagccattttaaataatttaaaaagtatgaaattgaatttaaaagattccaatgatagaagaaatttaatttataaactctcttcagaaaatttagctttgaaatcaaaaactttaaataatcatagtatattttatatctattatgaaaatgagataattttttggaattggtcaaaagatgatcccatatattctgttcaaactgaagaattctttcaagaaaataccaataaaaaagcaataattaccagtgttggatctttagaggatgaaagctcttctttaataaaaattttagtttgtacgaattactatgttatacttttaaatattataaaaaatacaaatggaaattatattattaatcgtataaaagatagttaccattctctttctggatttaaagatatttctttcactaaggttatttctcatcaagcttcgggaagattttttcttggatgtggtaatactggtagtgtttatgaatatacaatggaacaagaaaattcttggattaaaagaaaagttcaaaaaatatctggatttattcataatgataatcaaactcattcacttgctagattaataaagatttctggtaataattttatttcatatttaccaagatttattcgaaattatttttttggtcaatcacagagttttattaaatccatgtttaataaaaaatttagaggtttactttatgtgctttatttgaactcagatattgatgtatttttaataccaataggaaattttctgatcaaaaaaatctcagatgatttaacttatatgaaaaagaaaattcttcgaactctataa

SEQ ID NO: 3893 - DNA, 1251 bp, Cryptosporidium hominis
atgagcgtaaaattaagaaaaatgtttcaaaagcctttggtttctgtattggagggtcattcagatactgttcaatgtttagcaagagctcatcatcatctttctgatatatatagtggtggatttgatggaactattagatattggaatttagcaggtagcagaagatgtgaatatatgattagagcacatgaaggagcagtacgtggattatgtgttacaaataatgataaacatttattttcatgtggtgatgataagaaattacaaatgtggaaaatatctaaaagagaatctgtaaatgaaatgaatttaatggaattagaagatggaggaaatgttgaggatgtatttaatggatatgataatatttctagcttttcaaaagcaattattcctgaaactacatttcttgcaaataatcaattatatagtttagatcaccattggaacagtggtgtattaataagtagtggagttggtggtttgcatgtatgggatcgtcatagaagtacgccattacaagaatttgaatggggaaatgaaactgtttattctgcaaaaattaatccaagtgagcctcatattgttgcaacagtttcttctgataattccgttggactttttgatataagatcatcaacagcattacgtaaagttgttttatcaaataaatcaaatgcaatttgttggaatcctcagcaaccaattaatttcacaattgctaatgatgattcaatgttatatacatttgatatgagaaagcttaacattgctagatttatatataaaggttttgttcatgctgttttagatgttgattataatccaatgggaaatagttttgttgctggtagtagagataatactattagaatatttaatattgaccaaggtgcttctagagatatttatcatgcaaaaagaatgcataatgtctgggctactaaatttactgctgatggaagatttattgtgagtggttcatctgatttttgtattcgtttatggaaaaatgaagccagtcaaccacttggacccagatcttatagagaaagacaaacattagcttatagaaatcagcttattgatagataccaacatttacctgaaattaaaaagatttccagacatcatcacgtaccaaagatgattaaattccttcaggaaacaaaacttgggcaaattaatggccaagaaaaagaggaccgaattttacgatcacaccaagattcattaaaccatttcaga

SEQ ID NO: 3894 - DNA, 1099 bp, Cryptosporidium hominis
atggagaaatttgaaataatggatgaattaacagatttacaagataatatttcatcatataaaagtggtgatgcaggattaaccaaattgattacaagacttcagtatttgaagacctcaagtcaagaattattgattgaaaatagaaagtataagaatgaaattaagtcaattctagaccattatagggaggaacaagaaaagtcaacaaaacaattaaatacaattaaggaattactttcacaacaggatgtttttcaactattaattagacaaatggaattagttcaagcaaagcttcaatatcaacaagaagcttggagaatgccagataatcaagctgagaatttattattttggatacaacaacttcaaaatcaatggaaagtagatgaagctgtagcaagagcgtcttatttaaaacatagaagtatagttcttggagaacaaatgaaggcttatactctaggtcatccacttccaacacattatgcaattatacaggaacttcttcataagcttcaatatatttttagagaagaagaattttctgttgtaacaagatctgaatttctatatgaggatattggcaatgcaaatttaggttttgaacctttaagagttcgtaaccaaatgaataaaaatctggcaaaaagtccaatttgggatggtggaaactttaaacaaccaccattatcagtattaccttcagtatttggtaattcaaaaagtaaaatggcaggaaagattgaagaaattattgagagctcaacaaatattgaaggatctggtagtattggtagtgtaagtggaggtttaaatagttcatcaagaggggatgatggcggattaattgaatattcttcattaaaatcttcaattatggcaaatactcagtatattccaaagattcaagttgatttacttagtccaccagaaaaaaatgtacctgaatcagaatatgaaagaattaaaaacaattttagagaaatgcaagaaaagtatcgtattctagagggggagaatgaaataatgtctgaaaagattcagaaattgactaaaatgattaaatcaatgaataaaaagacatatagacaaa

SEQ ID NO: 3895 - DNA, 408 bp, Cryptosporidium hominis
atgttagcaccagagaaggcaaaaagacagcaaaaaaaggcagaattaataaagttaaaaacaagagaattaacagaaataacatgtaaatcttttgaagaaaagctacgtagtaaaatgcaagaagatttaaagaaatacgaggaggctactcaatcagcttattcaaaaatgattttgaaggaaaaatctatgaatattaaatggaatgaaagggaaaagtttattgaaagagaaaagaaggatttcgaaaaatcgatattaaagcaagcagaaaaaagaattgaagaatttagaaaagggttaatgataactcatgcacaattaaataaagaaagagaaatattcgaagatatgatgggaaatttgagggaaagggtaagttataaaattaattatgaatattaa

SEQ ID NO: 3896 - DNA, 1428 bp, Cryptosporidium hominis
atggtgaatgtttcagaaaatattaaaaggggttggaaattaattttgcatagatttgtatgggagtacaaattaagtagagctattaatagaatcacattcacttttgatgaatttgaacaaactaatcactttaactgttcttggattattccacaatggtttttgatttaccttagactatctgtttttctatatctacttattatgcttggattggatgtatctaattattataagttaggatatgctatgtactggggtgtatatgttacaaattggacttatgctgtaacaattatttactatttttttgcaacaacttcaactatatattcatatgcaaataactcttctggtagaagaaagtatataaagtctttgaaaatgactaatagtccatctattggtggaagaatccatttaaaacttgatgatgatattattggccatcaaaatgtcaattctagaccacgtggttccatattaaatattttagatcgaaaatttgaacatattaacccttcaaaacataatgaacaaattgttgtatcagatcacacaactaatggatactcaagtagtccaaaaaatgcacaattaaacgaaattcaaatggttgatttaaatcttgagaataaaaataatagtaataaaaataaagaagcttcttatggtcatgcaagtattgtatcaatttcaacagcttttgaatcgcctgaaaatttgaataataatgtaataaaagataatactgaaagaaataatgaatatattttacctagaaagacaagaaatatttttgtaagatattacaatcatttaaaatctcatatgtttattataaagtattgtaaagaaacagacagaccacattttgctgatgaaattaaccaaagaatggataatactacaacaaatattaatttaccattattaattagacttatgtgggtatttcatgcaattgcattaccagcatctttcattgtttccattgtttattggtcaatgagtataatatcacctgttggagttgatggtttctctttcttaacttttaataaacatggtttaacagcaattttactttcactagatacttactttactacaataccattttttatctctcaagcattctactcattcctttattgcttaatatacctgatttttacaattgtttactttattcttaagcttccaaatccacaatctcaagatgatcttggttttatttactcagctattaactttgcagatcctgctgtttctattccatgtagtattggaatattctttttattatttttaacttcaaatataatttggttctttgttggattttcaagaaatcatattatcgatcctcttcctagtgatgatattagttctaaagagtttagagtcaattattacgtgtga

SEQ ID NO: 3897 - DNA, 711 bp, Cryptosporidium hominis
  misc_feature (46)..(46): n is a, c, g, or t
atgtcgggaacatcaaggaccaatactttatttactttaccattancaggagtttcacaatatacaagaactggcagtcttaatacagtggttgataattcagaattagaaaataataatttggatataattaaagaacataatacaaaaagagtattcaatgttgtaaaaccaaataaaaaaattgaacaaccagaaatcaaaaaagttgaaccagaaaataaaaaagaaatattatgtcaaaaaaaaaacaaaaatgtgaattaccatgaattagaagttcaattaatgatgaaggatagaatgatagaagagttattagaagagaatggaaaattaattgaaagtatgaataagatagaacaagataagatagatgaaacaaatagaatacaacaaggaacagaaatgatattacaacaagtagtagaagataatgaatggtataaagcacaatttttggagatgaagaatgaattagaaaaggcgatatctcaaacaagaaacaaaggaagagaaatagcaacattagagaaacgatgtaaaaatttgatagaagaaaaagaaacaatacaaaattttttggatgaattaactgtacaatatgatgagagaatttatcaattacagaaacacaatcaaaatatatgtaatataagtcagttaatgaagaaatatcttggatacgagaaaaaaagtaagaagacataa

SEQ ID NO: 3898 - DNA, 1002 bp, Cryptosporidium hominis
atgattgacgaagactcttcatccaaagatttattttcattaaatttaatgaaatattatgaatatatggataaaattcctggtaaaagaccatttggtagtacctttgaagatcatgcaaaagaaaaggattatatattaattattaaattggaagaaattgaatcagaaattattttgcatttaagatccacattttataataatattaaagatttatcaactttggagaatattaatgtcatttcatgtcttaaagaaatggttgaattaattaaacttgaaaattttaatctacatgaaaatttacgtaacttggctgaatttagtaataaaaattataagcacataatggaaaacagagaaaatagtcaagatcaagttaaagttcaggaattagaacaaaaacaaaaactagaacaggaactgaaacaggagaatgaacaagtacaagaacaagaacaagaacaaaaacaaaaacaaaaacaaaaacaaaaacaagaacaagaacaagagcaagaacaaaaacaagaattatctcaaaaaattgaagatatttatgataacgtaacaattcaatttaattcaccaaatacacgtggaactttagaattatctgaactaagagttccatcgtatttgaataattctccattaattgacaaacataataataatattaacatttttaactcgaaaatttcaagctcagaattattacataatcaaataaaaacttatagatttattaaagattcttccaaaattgggaatcatcaatattatggctcttattctacaagttctctacctgcatattactcttcattctcttcctcctcaagaacaaatggaaaaaattcagctttaagatctgcaatagaaactattcgtaggactaaaaatgattcactctatagacaaacaaccagtgcttttagtaatagattcaattcaaacaacgatcatgatgaattcagcaattacagagaacatacacca

SEQ ID NO: 3899 - DNA, 231 bp, Cryptosporidium hominis
atgcactgcatgcatttttatatatttacaatttttcgtgtggacgaaattttaagtttatataaaagtaaaattttaaagaaaaataatagaagatatttgagtaatataagtaaaaaaaaatttgttttgatcaaacaaaataatattacaattcatattaataaattcttttttcttctttttttttctctttctaatttctttttatttcttaatattgtcgattaa

SEQ ID NO: 3900 - DNA, 624 bp, Cryptosporidium hominis
atgaaaatgaaaaataacaactgtctaaataaatttagatcatttattattgttattcatcaagaatatggttgtttacttttaaaatcaactaaaaaaagtgaatatgacatttttcaattaccaggaggaagattagatgagaaagatttgatgattaatgtttcagaagctaataataataatagtagaataaatccaatacctacagagaatgcttttaaaatagctgctgcaagagaattatatgaagaaaccggattagattttagaaatcgtctttatatgttaaaaccattgaaatttgatttgcctaataaatggagatttttttacttgaatattactaattatgaaatagttaaccaaaatcaaaataaaaattactattttaatatattccaagaaatttcccaatactttaactcgataatatttaaaacaaagaataataacatcgatgtaaataatattaatataaaactgtccaaagaacatgaaagtttcttgtttgaaaaagacttggtaaaagcttctcagctagttaaatcccatagcaaaggtgtatgttccaaggcactattacttttccaacaaagttaccaaatatatacaaaatactag

SEQ ID NO: 3901 - DNA, 6429 bp, Cryptosporidium hominis
atggctagacaaggaaaaggtttaagacgttattgcgatatctgccgtgatggtgatacagatttaagatgtagtcaatgtggaaaagtatttcactttgactgtctacgaaattgtaacctgataggtagcgatgcggaaattgacgactcattttgttgccctgattgtaaaaataacgaagatttttgctatatatgcagagataacgagacaggtgatgttatgttatattgcgatggatgtcctaaatctgctcatttaggatgcttgggtttagaagaagaacctgactctccaacttggtattgccctaactgtgacaatgattcaggatcaggtaaacacaaaaacaagcaaataggagatgttcgaacattaggaggtactaagaagaccaatgatgaaactgatatcaacagtgatagttgttatgtttgtcaaaagggtggaaaactattggggtgcgatttttgtacctattcataccatccaaaatgtatcgaaactgaggtttttgcttttgatggtgacaaatggaaatgccctgtttgtagaggcgaagaccctttaaaaaatatgaggcacaaaaggatgaacaagtctgaacgatacaagctttcccaacaatggcaaaactgtattaagaaacaaatcaaacagtcaagcattaatagagatgtttttctttgggaaaatagacaagctatttccccatttgtctcaagaaaggttttggaacgtcttaaaaagaatgctgaaacatatcgcaaatccaatcttaaccaacaacaaaaccagtcatcaaacacaacttcaggaaagaaaaggagaatcagaaagatacaagaagacgatgccgcttctgacttaaactcagattctgaggcggactattcagaatccaatcgattggactcttcatccgaaactgaaaatcccgcccattcccaccatgcaaatgatggcgccgacttcccggaattcatggacgcgccaaagtaccgagaagctcatataaaggcaaaagaaatgtcattgcagattttgagtgaggggatagagctgaaagattatcagaggtatggagttcactggctattatgtgcgttttcaatcaaggggggggctattttagctgatgagatgggtctgggaaagactatacagactttgacatttttggcgtgtttaaaggctttgggaataactggtcctcatttgattgttgttcctctatctactgtgggtaattgggctagagaagctcgaaggtttactccgggtctaactttaacaaagatttgtggaagtagatgggagagagagcatgcaatgatggatcctgttgcttcagatggtctctatgatttatatatcacaacttatgaaacggttgttactgaagagtcttttttcgttgataactttaggtggcaatgcattgtattggatgaggcacacagaattaagaatgaaggaggtcgaataaggcactcaatggacagagttagcggatctatgagagttttacttactgggactccacttcaaaattctcttaaagagctttttactcttttgaactttttatatcctgatatcttgcaagactctgagatttttgagaagatattccagatgaaggatataacaaagagtgctaatagcagtaatagttcatctggtggaaatggaaaccatggatctgatgatgacgagagtattgatgatttggatgctttaggtattaaagttgattcaaagagagtaaagttatttcaccatttactacagaaactattattaaggcgtaccaaggatttggtcattaaactaccagataaaattattcgtgatatatggcttcctctctctccttcaggctggcaatggtacaaacgtcttttagatgtgggtaacgttcatggcgatgtatctttcagaaagttacttggattagtcatcaagatgaggatttgttgttctcatcctaggggactggttgctagaggatctcaacttgataagctgtttagcgtatttgctgaagcttctccagatctattggctgaagtaactgatgatgcttacaagctaaagagttcttttggatgggaacatgtcaaaggttcctcaaagcttttcttcttggataagcttttaatgcaactacacagagaaaactgcaaatatattcccaattataaagaaagtcatgacaaatacactcgcgagcagataagatctatcaagtcgagaatatttgaattgagaaacaaaggtggtgctgctgctgtatcggggcctggatctgcttctggttcctattcttcaacatctggaggatcttccaattcaagtagcactaaagataaggattcaaaagctaataaggagaatacaattcatgaaatcctctcgtttgaggatagttaccaggttactgatgaatttgaagaaagttttaaaaactcagatttcaaagatatatattcccagtatatgtatgacaagtggtccaaaaaggctgaagaaaaggtcaagattgaggtttcagagactaatttagattctgaaaagaccgaaactgagaaaaatgaaatagtcaaaatggacatagatgccaataataacaataatagtgacaatattaatggtgaagttaaagctgaaagtggtattgataataataataataataataataataataataatggtaccaaacaggtaccgacaaatgcatgtttagatcaaggatctaaaaagtgcaagatgcacaagatattgatctttacacaatttcaactaattttggatgaattggagaattattgcttgtggagagggtggcagtatatgagattagatggtagtacaaacaagttaataagagagcttgatattagagagtttgggctaccggataattatgtattggtttatctgatatgtacaagagctggaggattgggaatcaacttggttagtgcaaatcacgttgttatgtatgatgaggattggaatccttttgttgatcttcaggcagtagatagagcccatagaattggacaaaccagagatgtttgtatttggaaattggttactgaatggagtgtagaagagaggatggttttcgggcgtgagcaaaagctcaagcttgataagatgattattaaaggttcagcaagggatgataaccataatcaagtggaatctgtagatgtacattccaaggtctttgaaaatgatcaatttgttgctgaagaaaaactctcagctgaagaagttacaaaacttattaggtatggtagaagagctttgatgcatttaggagatacttccaagctatttggattagatttggaagctttaatggacagaaagagagttccaattcctgatgaggatgtacttatgcaaaaggaggaagaagagaagggtgatgatattcagaatgtgttatctggagaggatggagagcaagtagcccttaaagctgatgaagaagttgatattactgatattctttgtgatgagatggatgataacccaaatggatcagctgggagttctggtggtattaatgaatccaattcagctaaaaccatgtccaatgttaatacatctccttcagatgaagtattggacccagcactcaatagtttgaccgtacaaactaacgatactacatctatcaatatttctcctacaaccagtggaggcgatgatgataacttatggagatctaagagaactagaaagcctcctcctcctgtttataatcctttacactgggaaatgaagtcaagaagtaatgaagataagaagcctacattaaaacatgaaaggagttgtttccgttgtgggcaagcaaagttggagtgttctaattctggaaataaggataagaccaacgttaaccctaatggaaataatggtagttcaggatctacatcaactgtaggagcagctgtaggtactggttgttgtggttcaccaccaaattatggagatatttccaatagtggtagtagtaatagcagcactactaatactggaaaagaagctaattccaaagatttggctacaaattctagctcacaaacaggaagtaacaataaacctactggttcaattgctcaggttgatgaatatatgaaaaagatgggattaattaattgtaacagatgtccaaaatcgtatcattggtctcaatgtttgggattagataaggtacctcctagaacttggatttgtccttggcatgaatgttgtctttgctttagaagagctactcaagcaggaggacttcttattcattgtagtgaatgtcctacaacattttgcattgattgtttcccaccagaatatgcaagacaccaagttttagacagtttctttgagaacttaaataaaagaggatggaatatatcaagagattcgatgatacttttcctttgctctaagtgtaaagcacttcaacaacaggagattaggaaaaagctttctaggcagcagcttttagaagagcaacaacgcagaagaaagatgaatgagcaacttaaatctgatgtattaaaatctggccagaagaattttgatcaattttctcatcttggtccaaactcaggaaatagaacgagtccatatttatcaggtagaaagagaaacattgaagctgcttggaagcttacagaatcccttattagaaaaggatttgaaagattatttccacctctattatataaacttcaacaagaatatattcaagagaatgctaaacatgaggcagctattttagcagcagctacaagtggtaacaatggtgatgctgaccctgatcttgagaaacagattggaggactacgaaagagtccttggatgagacctcctggagaatggcttcgtttatgtgataattgtcttttaccatttcatgatgtctcaggatgtccttatcctttggaagtggttaaagtatcagttccttcaggagtaactcaaattgatgtacagacaggccaacctttacaattagcagatggaacaaaaattacttcggtagaggaattcattatgctttctaagaatggaggagtggactctaaattccagacacgttcgtattgttctctttgtggtttatcagggagaatgcatactagaagaagctgtcctctccttccagatgaggcagagcaagaatatgaaaaaagacaggctgttttggataactttatacaaactttgaatactttccaagtagattttccatcagaattgacagaccctgaaaagattacaggaggatgggaaagttacagaaaagccactcaaaaagttgcagaagaatttttaagggactgttttctttcttgtaacctccataagattattacaccttctggtactgcatatattggtcgtcaaaatgttgcaagaagcgtggtttatggaaatccaggaactggaatgggccaaattcaagggtcatccaatgctttaggagttggcaatattcatcttcaatcaggggttgggggaatgaatgttggtagttctggtcttttaatgcatgaaggccatggcggagcaatcccttctggaactatggcagcttatcttggtcttggagcaggcctatccactaattcaagaaattctaaacaggctttgggtagaggaggagtagaccaatcaggtattggagcttttgctgggtgttctattccaacgtcttcaaatatgagtgcggcagcagcagcaattcaacagagaatgaatgatgctgctgtgtctcttgctagagccagatatgctgcagctgcagcggcagctgccgtctctgtagctggattcagacatccacaaccaatattaccattccatatggttcagacaacagctccaactcacccatatggcatatttggcccaggtaatcctgtttctgcggcagcagctgcagctgcagcggctgcctcagctcctcttttctttggagtatccaatcctaatatggcagcggcagcaagagctaatatgtttgttggagctaacatggcagcatcaatggcagtagcagcagcagcagcagcagccgcttcagccacaaatgctacagcaaacttttctacctccaatccaccttctccttcattaggaagtaagaaaagaacaatcgatgctttaaaaactgaaaatagcaacggaaacattattaatcagggagcaggttctactaacgttagtagtagcaataacagtggagggtttacagaaacagtcaaaggcatcccaattaatgcgagcagctctcctccaaacaaggttaaggttatagacgatagtaataacaataatcaaaattctgacttgactatagacctcccacctccgccactaccagataagaatctttaa

SEQ ID NO: 3902 - DNA, 972 bp, Cryptosporidium hominis
atgatcataaaaaataataataatgggtattttattgataacgttaatgaaatttgggagatccctataaatagtgaccatatggacattttaaaggaaattccatggtttaaatatcttactctaccaattgaaagaaattggaatggtatgaaattattcctttggaccaatgataattattatcttgcacacacaatttgcataatatatgcattcttcatatactttggacccaaaattatggagaaacgaaaacctttcaaattggaaaaacctttaaaatattggaacttgtttttggcacttttttcatttattggaaccctacgtttaatgccatatgtcctaaccaacctcattaagtatggttttgtatcatccatctgttctcctcctattgctccactaacaaaaggtccagctggcctatggctcagcttatttatatactctaaatatattgaattaattgatacattttttattattgctagaaaaaaatcactttcttttttacactggttccatcaccttactgtactcctttacacatgggatgcttacgtctgctgccaaactattggagtctttttttgtgccataaactactttgttcattcaattatgtacttttactattatttatcctcttgtggtaagagaccaaaatggggtatgatcatcacaatcttacaaattgtacaaatgattattggtacaattctaaccacttcaggtatgtattactcttataaacacccatttgccaatgtatttccagttgaatatctaagtcaacctctcaaagttggttgtcactttatcagaaccaacggtgtttttgcctgtcttatgtacatctcctacttcgctttattctttgacttctttatcaaaagatatatcacaaaaggtacacctcttgctgaatgggtaactgccaataaaaagccaactaagcacgaatag

SEQ ID NO: 3903 - DNA, 1014 bp, Cryptosporidium hominis
atgatatcaaaggtattagaaagaagaacaacagctccagaaaatgtcctacctacatttaatcaggactactctattttggagaattgtttaggtcaccagtcagtggtgaagattacaagattacatgatacaaagaagaagagtaaggtatgcggtataaactggacatgcgatggaaataagcttgtttatagtgcaagagatagtatacaattaatgaatcctcaattatttatagcagaaacaagcattccagggcaatggttcaaagctattccaagtagtttgaatccgtttcaaatgatttgcattgctttgaataagccttgtatcgaattttatgatttgagatctggattatcgcattttgaaattactattccaaatgattcttttcttaatgtagcttggtcaaaagatgataaaactgtagtaacaggagatagaactgataacttatatgcaatagacttaaggtttccaaatagtaaaaaacttccaattccaattatgaaattaaagaatgatgaagaaaacaagatgaatatagattctgatattgtaaatgaaaggcaaaaaagaagagaacttccatataatattcaaagccacaaaagatcttcagaagaaattaatgatattacatttagttcagatagtaaacatctgattatggctagaaatgatggaaaattggaaattatttttttagaaaattcaaaggatatattgaatcaaaacaaatcagagcttattcaaactcatctttatagctcagtgattgtaagagagttttctaatatgattgcaagctttggacaagaccagacaatttcacttttggatttgcgttccaaatcaataatttcaacacttggaggaatagatggagcggcaactagtatagaattcaataatactggcgagattatatcaacaggaatttcttcagaaaagaagaaaccaggtgaggactccaatgacacattaatgctaaacaatactcaatta

SEQ ID NO: 3904 - DNA, 387 bp, Cryptosporidium hominis
atgcctcccaatgtaaataagaagagaaaaaggccaactaaaggcttaaaagaaagtgaaaaggaaaatcaatcaaaactagtaggattcaagactagtattgttagaccaatagtaaatccagaattggaagctacagatttaaaaccagtaaagagtgctaatgataatgaacaacttttaaatacattgcatagttttgacttggaccacacttttggtccatgcagtgaaatttccagatctaaaagacttgaaagagctaaaaaatttggaatagctttagacttgaatttagaaaagatgataaataaacactgtggagatgttaatagtgagatgtcagtttcaataatagataaattaatgaaacattattccgattag

SEQ ID NO: 3905 - DNA, 1194 bp, Cryptosporidium hominis
atgaattcaattcaaataaaacaattacaatatttacttggcattatattattgattggtatagtccatgcattaatatttgatcaagcaaaagttgaatggatatttagtaggcaagctgatgcttggctaacaaacttaagatcttatactagtatttatgaatattctcaaatagatggtactccagatcagtctaagttgttttcaaactacaaaacagcctcaaatgaatcaatgacattatttgaagaaaatgttgatcatctttttgattatttcttttatggatttggagtagaaattgttgaatttgcaactcaaagtaatactactgttgatgagaatgatttcaaatttaaaagaattaatagaaagaaaattatggataaacttagacaaagaacattacctagaaataatattagaagcttgaaggaagaaaatcaagatgaaaataatggatctaaaactttaccaacttctttctattggccaaacgagacagaaaaatgggctaagattagttttttagaatctggttcaattacagaaacgaattttacaatgagtacttatagaaatgaaacaggtcttttaacaaatccaaaagagttagctcttgtatttgaagttttggaggataatgcttttagatggggaggtaactatatctgtcaggaactagtacaagaacaactttctacagaatcaaatactccatcttatattccaagtgagcctcaaaaagctaatgtacttgcaaagaaaggccaaactctatggtatggatttatggttacttatccagaaggtaaaatgacaagtattggtagttttgctagtccagcacctgaaactaataatgaaaagcttcttatgcatatcttttctagacattttgcattctcagaacctttcatcaaacaaggaaagtatcctgagattggacaatatgacggttcgatgtctattattagtgacaccggtattattagcactggaaatacattttattatcttaaaactgccacaatttcatccccctcaaatcccggacttgttgttcctccaaagtttacaggaagtgtagataaatacccatccaagtatgatccatatgacttccaggatccattaggaccattatttgtacctggaaagcattgtagcgagttcttactaaaccactag

SEQ ID NO: 3906 - DNA, 585 bp, Cryptosporidium hominis
atgaaagaagttagtgatgatatttatagccgagttagaaaaattaagtttaagagaataggcttagactcaagtaaaaaaggtaatcaaatagaaaaagttggtcattccaataacaagaaagataaagatgatgaacatcaatatttagtttcttttaattccaaagttgaagagaaaaagaaaaaaggagaaggaagaattataacatcaaatactacagtacaaggatttcataccaaatttcaacaagaacttaaaattggtgattatatagaaattgaacatccaaatacattaattaaagaaagtagacaagtggtcaatattgtgagcgaaagaacattaatcatagatagtgaattttcttgtgacttggtttcaactagtgaatattactattatactaatacaaatgacaatgatttggatattttaaataaaagtaatacatactcttatagagaaaaggatggattgtttaaatataagactgtagttaaatcagtaaattcaaaattgtcaagggaagatattttagatattagagcaaaaaaacaaagagataaatattgttggatatag

SEQ ID NO: 3907 - DNA, 759 bp, Cryptosporidium hominis
atggaacagttatcatataaacatggttcaagtataagtatatttgcaaatagttcaaagaagcatccatttagattaatatttgcaagatattatgatagtcatattttggatatgtatgaatttaatgtattaaattataaaggaatttctccaaatatggaattaccaaagtatggatcaaaaccaatagtaatatgtcaaggagctccttttgaatcagatgatgtttataaaagtataagaacaatgttctttgatactttttctggtccaatagttagaggatctaaattatttcttaaaggatttgatcatttaattctagttacagcttatgaaactgataacgaggaaattaataaacaatctacaattattggatcaatgaattctaagatttatattgatatcagaagctatttaattcgtctaaataggccatcagaacaagtaccgagtgaactattaattagatcagatcaaaatcttgttttaaatggatcacctagagtagttttgtcagaaattggtttacaaataaagatggaattagtaaaacatcagataccagataagagtatattaaagtcagcaatgatagttccacgtgaaattaagcctaaaaagattaagaatgtgacaacaaatgttttgggagaatctattggtaaaatccatgttggtaaacaggatttaagtacattaaatactcctcatgcaggtattttatcaaagattaaccgtagtaaagagtaa

SEQ ID NO: 3908 - DNA, 1602 bp, Cryptosporidium hominis
atgtttttgaaaatattttatttcgtaatttttttgagctactacttaatagtaaatttgaaggtgaatgcatttctaagaaatgatttggcagataattatattcaggaacacttggataaagtatatttggaaagtgatctagtttatgttgatgatgattttgcacttacaaaagaaagtaatccttctattgaaactaatatagcaaataatttattaaaaatccacaaaagccaagttttgaatagcttaggcggatcagaaagactcattgatttaatgaaattgttagagagtgataaacaagaggaagaggaggatttaatagacgagggtattgaattgaaggattattttgataagatgatactaagttcaaatctggataataactattatcattatataagtgagattgaaggaggatttgaacattttgacagccttggaactaatagattaaaaattagtttcacagaaatggtcaaaaataagtctttaaataaaatgaataaaggtttaaaggaatatgaattcaaattcaaagtggatagaattattgaccaagaacataaactaataagagaattggatcagaaagaaataaacaaatacatctcagaagattttatgaaatattctgatgggtattatttggttaaaaagaagaaaatgaaagaaaataagttgagtaattacaattatactattaaaattgagtctccaatggaaattattgactttgaagagttgattttatttaatgaaataaagattttatataatcaaaagattaatttcaagcttgataataatatttcttccaataaatttaatagaaaatcaagtactagctatgaaattaaagatagttatgaatatgatgaggattatgaaatattggaagaagattataatagtaaggaggaatatcagaaagtaaaggtttcaaagaatttgctagcaaggggttatcctgtttgcgaattaaaatgtattatcagggacttacaaaacagggtacaatggactaggaaaattgggaaatttcttagtagaaatgagaaagaagatgaagatagtggaggtaaaactgagataaatttaataaaaagttataattggtgtgatagattagtattccacaattgtataggatttgaattggaatctatggaaattagtatattgaatgaaaaattgagagaaaaagtacattttgttgaaaatattttggatcctatgttaaatggtcagattgaaaactattttaataatatattcacggatttagtagtagataaagtacttaaacctaaacaaattggtaaaatcattgtaattgatgagatattggaatctaatagttttattatttctagaaatagaaatcaaaagagtggagaattctttaatattagatatgaaaagatatctaaattctcacagaatttaattagcttaaggcaaattcttggaagtacaaaatataaactcaagattaatcatttaaacaaaggctttacagtactaagttcatctcacaaaacattatttaaagaagaatatccattgattaatgtaataaaaccaatcact

SEQ ID NO: 3909 - DNA, 300 bp, Cryptosporidium hominis
atgaatccccaaactgaagatggagtgaatccttttcataagtttcaaagagcaagaatctactacaagaacaagtctctttttaaattaatgggtaattgtaatgaccataattataatgaaaacaatgattgtgatgataataacaatgataataataattatgattactataactattatcataataaaaatctgagcgaatctaaagataaatcaacttctgttagaagtaagaatattcacaaatcaaggaaaaaatcgagaagacctgcttctagaagtaggagaaagaaataa

SEQ ID NO: 3910 - DNA, 1365 bp, Cryptosporidium hominis
atgcctatagatattaacagaattagagtggagaaaggtggagattatcaaaagatagccgagtcagaaatggcaaggtataaaggattagagactcttgaagaactcgtcaaagtagatcagaaatggagagaggatatgtttaaattagagcaaagcaaaaaggagttaaattcaatttcaaaagaaattgctcaaattaaaaagaaggatccaaaagcagattgcaaagatttacaagataaaagcgttcaattaaagaagaatcttccaattatcgagaaaaaagcattggaaactgaagaagtaagagataagttatggcataaaattggtaatatcttacaacctgatgttcctatttctaatacagaagatgacaaccttgtattgagaacatggggagaaataccagatattaaggttgatggaacaccagggaaattgcatcacaatgaaatcatgtccagattaggattctatgatagtgtgaaaggtgcagaattagcaggccatcgtggttactttttgaaggattatggtgtaataatgagtatggctctctcacattatgctatgggattcttgttaaaaaaaggatatttggcaattcaaccaccatactttatgaaaagagatttgatgggtaaagcagctgaattgcaggactttgaggagacactttatcacattccttctgacaacagcaaaggcgaggttgattcaaatagcttatttttgattgcaacatctgagcaaccaatagctgcaatgcatcataatgtaacacttgaagacaaagacttaccaatcaaatatgctggtatttcaacatgctttagaaaagaggcaggcgctcatggtaaagatacctggggaatatttagaattcaccaatttgaaaaagttgaacaattctgtgttactttgccagaagactcacaaaagattcatgaggaaatgattagcatttccgaagaattttatcaatctttggaattaccttatagagtaatttcaattgtatcaggagcgcttaacgacgctgcatcgaagaagtatgatttagaagcttggttccccggatataactcatatagggaacttgtttcatgctccaactgtactgattaccaatctagagcgcttgaatgtcgtctgggattcagaaaagaaggagagcgtgaaaaacattactgccatttcctaaacggtactttatgtgcaatccaaagaacaatgtgctgtattgttgaaaactatcaaactccagacggtcttagaataccaaaagtcttacagccttatatgaatggcgtcgaattcattccattcaaaaacgaaaccgctacttgtgccaattag

SEQ ID NO: 3911 - DNA, 1689 bp, Cryptosporidium hominis
atggtaagatacaaggagaatgacttatcatcatatacagataaccctctgggattgttaccatctcgttttattgttaattcaaagaataattggaatattacaggtatatttgtatgtatacttagattatatgcatattatccagtatggttgttgttaaataatacaagtaatgattggtatataaataatgctccttttttaatagtttactctttaatatttggtatgttaaattatactttatatatattaatatcgtttggagatccgggatacctgaaaagttgtccatcaacaaaattgaaaccagtggacaaaattagggatccattaaaactaaaatttaacttggaattaagaaatttgaaaagaggcattaataaaaaaaatataagtaatagtgatatatttggatcttcagatgaagaaagggatgaagaatttgatgaatttgaccttgaagctgggtcaataaataatttaaatactataaatgaatcaatcaataactctagttttgagattttggatgataaatcattggctgattctagatgcgattcaagtacaaatgatttaaatttgtcaaacagtattttaagactgggaggcggtaccacatctttcccacttttaaatacaagtaatttgataaaatctccaataagaattgataagagcacagctagtttaagtttagtaatggaaagtgcgcctggacaacttctaaattcaataggagtttctcagttttctttgaataataataggatcttggataacttgttaagtaataatagctctgaatgctgcaaattatctatagatcttatagatggtgataataaatctcctgaatgtagttttattgacaggggaaacttaaatgaagaaggatcaacttttaaattaaattttcatgatatggatcaaaaaacgccaaaattggaacaactaactcatccagtatcaaatttgaatagtaatagtttatcatttccgctttctccatgttcttcagacggcattgatctcctaccaagaagagaaatgagtggtaatagtctcaaaaatagctgttttcaaagtaatgatggctactttgtctttaaagaggggaaaatgtatcagaatggagttaggttaagattttgtgattattgcagaatgtatcaacctcttcgtacaaagcattgtacttcttgtgaaagatgtattcggacccatgatcaccattgtccttggcttggtgtatgcattggtgaatataataggtgcaaattttggtggctttcgcttgttcaatttcccgagtgtatttggattctttattgtatctcaatttgtctattcaaagcagatctgaatggtagccgcctaacaatttttgatatttgctcaatgattttcattgctgggaatgcactctttattgcttttctctctttattgcttgttatatatcacctttttcttgcctataataacttaactacttgggagaatcttgcatggaataagatttcgtatctaaagccatttccggatacgcaaaactctccattttctaaggggcatatatataatatggcaatcttttgtattccctattacgtggacgatcttataataggagaagaaggagaaataatttgggaaagaaagcctccaaacagtatttag

SEQ ID NO: 3912 - DNA, 585 bp, Cryptosporidium hominis
atgctagatgatagaaaaagatctttattaagtgtattattgataaaattagccttaatgaattactatgatatttcaccaaaacaggtaaaaataattcgtgaaaaaggaatgaagccatattttaaatatgactcggaaagtgattcattactgcattttaatgtttcacatgatggagatgttgtggtgattattttgtctaaatatatggttggaattgatattatgaaaaccgagttatcaccttccagagttcagttatcaaataatattatggaagcaaatgagaaatttttgaataatatgaaaaatgttttccatccatctgagtgggaatatattcagaaagatatctcaaaatttatgcattattggacaattaaagagtcatttgtaaaatatattgggctaggactttatgttgatccaagaaggctattaatagattcaactttagtaaaagaaaatcatcagtataatttgaattctccctacttgaaacaaagtaatatatatctggacaatcaattacaggtaaggaaatcaattttgttaaacacaagtatatatattactaattaa

SEQ ID NO: 3913 - DNA, 288 bp, Cryptosporidium hominis
atgttagtaaacgcagatgttgatatttcaaatgaattagaatctatgtccattttaaggccaaagtacccaacacatgtagtgactaaacaaggaatagagttaagaagttcatcttatggagttgaagatagagagggtaatattggtgaattattagcagtaactcagattactggagttgtttatatgacatttgattcgtctggaaggctttattcaattcaaaaagatattgcaagagaatttcttggagagttacaggatgaaaagatgagttgggaataa

SEQ ID NO: 3914 - DNA, 1557 bp, Cryptosporidium hominis
atgtcaattgaagattccgttattaacaatatcaactctagtaggatagaaacagaggaaaatggagaagttgcaaatgtagatgaacttaaggaatactttaagaatattacttcatcaaattctcaattagaagattcaaaaaaggttcaagaagaggaggaaagaacatctaaagaagatgatatggaaaggaaagacactgaaaatgatgatatagatgattttaagtctccaaaaagcgataattctacttttcaatttagagatgttcaaaataactcatcaatatcagttcaaactgtagatcctaaagctcagctgtattctgcgaaagattggtcagatcttaatctttcacctgatctacttaaaggtatttataataaaggttttaatcgtccatctaagattcaagctgcagcattaccactcatattaaattcaccaatgaatttaattgctcaagctcataatggaagtggtaaaactgcgacttttgctttagccatgttggggaaagttgatacaaggattattcatccccaatgtatgtgtttatgtccaactagagagcttgcacgtcaaaaccaggatgttgtaaatgaacttggaaagtttacaggaatcacaacatggcttgttgttgctcaaggagataaatacgataagactattggatctcagataattatatgtactcctggaaaaatgcaagattttttaaagaaaagatcttttccgacagaatttatgaagttaatggttattgatgaagctgatgaaatgattgatcatagaaatatgatggcttctcaagttggacaaatcaggaaattctttagacaaaatttacaaatccttttattcagtgcaacttaccacgaggaagttcgtctttttgctgaaaagattgtacccaatgcaaataaaattaatgttaaaaaagaagagttaacattgaatactattcaacagttctatgtaatttgtaatgatgatgctgataagctttcatttttatcagatttgtatgcttgtatgtcaattggacagtctatcatttttgttaatactagaaaaacagccttttctatagctgaaaatatgagaagagatggtcatgcaatttctgttatatgcggtacccaaactaattctggtgagaaaatggatcatgaaattcgtgatcaagttatggattcatttagatcaggtgaaagcaaagttttaattgctactgatgttttatcaagaggtattgatgttcctcaagtcactcttgtgattaattttgatattcctgtcagattcaactccacaaattctattgatattgttaatcagatatcttcagttcaagttgaaaatgagacatatttgcatagaattggaagaactggaagatttggattaaatggtatatctattaactttatccttcctcatcagctttctttaattcaacaaattcaagattattatgattgtaatattcaactaattgacaaggatctcgaacaccttgagcagatccttaagtctttaagatcttga

SEQ ID NO: 3915 - DNA, 1047 bp, Cryptosporidium hominis
atgattaaaccaacagaagaagagcttaaagagtttaagaactcctggaatccattagttcaagaggatattagcagtgcagattattactttaattcttatgctcattttggaatacatgaagaaatgttaaaagattcagtcagaactggttcataccagaaggccataatgtctaataaacatttgttccaagataagattgtcttggatgtaggaagtggtacaggaattctatgtatgtttgctgcaatggcaggagcaaagcacgtatacggtatagaatgttcagaaattgtacatgttgccagaaatataattaaggataataatctatctgataagattacctttatacagagtaaagctgaagaagctgttcttcctgtagaaaaggttgatattatcatttccgaatggatgggatatttactattatatgaatctatgttggatactgtattgttttgcagagataaatggcttaacgaagatggtttaatctttccagatagagcacaaatgtatattgcaggtatcgaagatgctgaatataaacaagaaaagcttggatattggaataatgtttatggatttaattatcaatatgtaaaaccctgtattatggaagaaccaataatagataccgttggagagaatgctgttaatacaagctcttattgtattcttgatattgacctttacaagtgtaagaaagaggacttagaatttgtatctcctttttatcttaaggctgctagaaaagactttgttcatgctttcattgtatggtttgatatcatttttggatgtggtcacaaacctgttacttttactacgagcccttttggaaaatatactcattggaaacaatcagtattctactttgaagaagatcttgtttgcgatactaatgatatgatttcaggaatatttgctttaaagaagaacactaaaaatgttcgagatcttgacattaaaatcaaattcaactttacaaaaaataattcttctattgaaagaattaactattatagactaaggtaa

SEQ ID NO: 3916 - DNA, 3528 bp, Cryptosporidium hominis
atgggaaatgcatacgaggatatttttgtgatccaagttctcccatcaaccattaatgttttagattttggaatcaaaacaagattagtagaactggatctcatttcaactttattttctgataatcctgatgctccattagcaattaaatcttttattatgggtaacttaattataattttatttgaagattctactattaaagttttaaagatcttgaaatcgaatccagatcaagatcaagatcataaaataggtaccgaatatattaattcattaaatagcttaaaaatcattaatgaatttttaagataccaaattattattgagaatatagatgatctttttgaggaacttaataatctttttgaaattaaccaacttgtagttaaacaaagagttatggaaggagagacttcacagcttttcgaagatgagcctttagaaacaacatcaatagaagagaggaatcctgatcaattgtggaaaaacaaattctggatcagacatgtttctccagtaattactaattctgatcgtaatttgaaagattcagaagatttcttagttgttttagtcatttatagcaaattatggttgaatggatctataacaatctataatatagctaagaagagattaatgttcttttcaccttttatatctgctgtaccatctataatgggtaacatattatcacaaacaggtaataaggaggagatcatatatagatttcttgagaatgagtttgatcttggaagaccaataacctcaatatccactccaattattgaaccaaaatattatatagcaaaagaaggaggagggatttcaatttcttccacattttctctgaatcctagtggattaagtacctccaaccaaggaggtaatgattcgaactttacacaaagctctaattcttatttgatttcttgtgaacttattaagatggaagaagaagatagcaaagagggtaatagtgaaatgatactggttgcttcagtttcacagaagccaatcctggtttataggcttgatcttagaaataataataactcaaatagttctagatcaggagatttcatcttctctaggaaatggaagctggaaatacagacaaactttaatcatgtacaaatggatattacaagattctttgctcagtttccaaagaccatatcaagttccaatatccaagaaacattttcaattgaatcaccattatctatttataattgtggccatggtatttcatttaattcaaagatctcaaataatgtggatacctggataattcagccgccatctcctttagatatagaattcagacaagaaataatgagcgatgaaagaaagggatgcgaaatgggggatatctcgtcttattctccatcttctcttgttattatgacagacaaaggaagattttcagtggtaagcttgtacgagacgagaacatccaattgtatagccaagatagattcaccgtggtctcctatacatatacttttaacaacgagtattgagaatgaaataaactttgaatttttaaatcttgcaaatacttcatcagatccaaaattctgtaactctttatgcactttaccatttccaggtaatgataactggttgctcagaagagccttccttccagaagtggtgatccaaagagtggcattttgcaaagagtacggtcttattgccattattgttggaatacctgataatgcaaagcatcatttaaatgggtatcatattcgtcaaatggctttctatagatatctaagatgtctagaagctggaggaaaagaagctcaaactatcttacttaaccaagatctcattagaaaccctgacaagtgctttgaaaagtctttagcaagtattccagatctagacattcctcctgcaaatttcgactcagaaacatattttgacactcttcctcctgggatagaaattggagaatctcttcctaagatattctatcagtctaatatgataaacgaaaaagccagaaaattagggttttctaaccaatcttccacatgcagtcattccgagacagaaaatgtggcgcctaacggtgcatgcaatggttttgagcgggaacagttcggaatattaatggacccgaatataatgcgtaacgagttgttaatatattcatttgaagatttatttccacatttgagaccatcagtgccactttcaggtcaaagccttgatagttttccgaagccaaaaggcagatatgcttttggagcttgggaggtgggtctgagtatgaagtttggacaaaattccaaaggccagcaagttttaattattggtacaggcacaaacccaactcattactatgaggcagagggaaggctgttgatgtttaaagtaaagcagttggtttctgtaaatgaggaagatgggaatattgtaggaggaacaacaggaaatggaacagaagttgaaagtaaaagggaagtagtagtaggaacaacaggagttcgagtgaataatacaaaatggacaaatatgttaaaatattggccatccagattttcaaagcagctatatcatgataatgtacaagagttggacatttgttttcaaagtatgtatagaggccctgtaacaagtgttgatctaattaacctaccggcaacaacggctccaattgcaccagcaataccagctttagcagcttatccaataatacagaataattctattgtcagagctccaaattctaatgttacctacattgctcatacatttggatatagactttatatacatgaactaagagaaaataacgagggaaactttactaaaggaacttttatggatactcctttaggtatcagttcagtttctaattataaagctttatttttcttgggagatataagaagaggaattcattttggaatgcttagaactgatgcttccagaggatctcaaacaatggttaaatttgctagatctcatcctctttggaaatttacatgtacatctgctcaagctattgttcaagataaagatcttgcaattctagtatctgacaacaataataatctattcacttttgaacccaacttcaatgcaacgcaaataattgacaaggaaacacttaaaccaacatcccatacaagcctttctacatcctttgtacatatgagaactgtggaatcagataattaccgttatgtcattgctagtggaagaaatggttcttttttctctataaagctcacaaataaattacaacacgagcatctttcacatgttgagaaattactctgttgcaatattccttcatttttaggaatatcccctaatccctctctgcctgttaatccaaatcttaccagcatcccacagttcattcaaaatctatatcctactgataaaatcatatttcttaaacatctaaattaccttaaatacttatctgatccaatcttacaatccattttcaaaaatacaaatatatcactttcgcgcattcaccaatttatagtttga

SEQ ID NO: 3917 - DNA, 1332 bp, Cryptosporidium hominis
atgattttctccactttaaaagattcatgtaaagagtataaaaagattttgaatgagatgattgagaaaatggtatcattttccaaacaaaatgatcttataaatgaaaatgttactgaggaacttattaataattatttgaaagaaatcttttatattgttggaccaaatatgaatatatgcaacggaagttgttgtgaccataacaaggattctagtatcattgagttaattcaatcaaaaattataaaatcttcaccgaaaatacaagaaatgatacaattaatggaaataattgaagaatctctcgatatagtacatataaatatatcttcaatggaatcattatctcaacttggaagtaatagtacggaatcaaaaatatttacttatcttgttatttcaataatcagaaagatagatccggtaattgttccatgtataatttttccaataattggttggaatccaaataatctttttcaagaatgcattaggaataaaaatttttcaaatgcaatgctttacctaacagttttacaatcttttcttggaccatattatgttagatatgaacattctcttttattactacataatattttatcaagtacaaatattaccaattattatcaacttttttctatggcaagtcaaaccattaaattcatctttattatttttaaaccaaataatttatctataaatacaccattatctaaaattactgagccagtttcaattgttggaataaataattgcaataatttagaattggattgtcttgtttttttaaataaaatagatagtatacttgaattccattttttatctaaacttatacaaattgaatggttgtatataattattatgtgcaaaaatttgggaatgaactttaattcttggttcacacattgtttgcaaaaatactttccattatggtttagtgatgaggatttggattctttttcttatttaaaatctactaactttgttaatttggtcatctcagtccaacataaatttaacctttttaatatagaagaaaattctatttgtctttttgatgaaacattccaacagaattcatcatccaaagtattgaataatattaaccataattttctttcaaatattcacaaaaataattcagaaattttttctcaacatttttctatacaaaagaactttattgttattcaagtaattaaacaattttttaaagcatttttatccaattctttccctttaccggcattagctattgcatatgcatgcaatgacgtgtattctgtccacaaagttctgcatgactttccaaatattaaataa

SEQ ID NO: 3918 - DNA, 267 bp, Cryptosporidium hominis
atggaaaatagttacaagatgggagttaaaaatattgtattgttatttgccacatttttattaagtgttttagcagaagatcaaaaggatggagaaattttagcagtaactccaagagatttaaagttgactccttttaatttatcagctttaattttagtttctttttttactatgttgattatttttattgttggattaactattgatactgatactccaactagatttgaagaaaagatgccacctattatgaaggaatattaa

SEQ ID NO: 3919 - DNA, 546 bp, Cryptosporidium hominis
atggtatatcaaacatattcagagattttcttatcaattcctccattacattttgcatatcttggagtagtattatgcatagttctttcgacttttggagcaggttggggtattttcacaacgggcaattctttagttggtgcagctcttagatctccaagaattcgttcaaagaatttgatttcagtaattttttgtgaagctactgcaatttatggtgtaattgcaacatttttattaatgtctaaaataagatcacttccagatattgatataatttctggtcaaccaaaggatgcttgggaggtacagatagttaaatcttcatggattttactctgttctggattaacaattggtttatcaaatttattttctggtattagcgttggaattactggtagttcaacagctcttgctgatgctcaaagaggagaattattttctaagatgttggttgttgaaatttttgccggtgctttgggtttatttggaatgattgttggtttttatcaactttcgcttgctgacttcccttcaaaataa

SEQ ID NO: 3920 - DNA, 762 bp, Cryptosporidium hominis
atgaatcatcagacttctcaaggtgatttccattgtttacataataaaatgagcgaaaatttaagattagcagctcctgctactctttccaaagcaattgaacattctcagaatattccttcttttttggatattcaagaatctgacacaaaaagtggccaagaaaacgataatacaaatattagaaaaggagctattcagaatgtttctgaagataaatcaacgtttttgtcatctttggtttcctctttatcatcactatcatcaaaatcgtcatcttgttcatcatcttcatcatcttcatcatctctattatctacctatactcaactttctgcttctactattcctgctcattctttcgaagagatagcaaacaaaggagtagaagttaaaaacaatggtattcaatcaattaatgggttaaaactggagaatattaatattcaaaataagatagaattttctggatatgaaaaaaagaagcaatctgaacaagattacttaaaaattaaagaatcaaaaaataacaactatagaagtggaaaattactagtttctgaaacctttggtgatggtggttttgtggcccctccttctaaagattcagatcatttcttggactgctccaaaaatatgaactctctcatttacaataacattaaccactgtaaaagcaaccacagaattagtagcaagacttcattacagttaccttgttcatctttaacattttggattgaaaaaaatcaatcaacttga

SEQ ID NO: 3921 - DNA, 633 bp, Cryptosporidium hominis
atgagaagaggagtacttaaagattgtaatttacaatttactggtttcaataataaattcttttataactttgtagattcagatttatataaatggtgtagatattttggttcaagtatattggataataatacaaagaattactcagagaaattaattgctactcactgtatatgtgaacaattatttacagaaaagtatcatcatgcaaaagaaaaaggaattccatgtattaatattttatggcttgaaactattatttatacatggattagccctttaaagattaatataaataatccattattttgggatcctgttaattcagattattattccccttttgaaagtttaaatttaaaagataaagaatcttcagactactttgactttgataattacagttattcctatctttattctacaaatacaagcgaatcacttaaggaacaactttgggaagaagcttttaacgatatctcattttctatgggagaagaagaagaagaagaagaagatgatgatgatgatgatgaagatgaagatgataaatacagtgattacgataatgataatgataataatgacgaaaatctatatattccagattctaattactcaaagaattcttaa

SEQ ID NO: 3922 - DNA, 261 bp, Cryptosporidium hominis
atggtatctagtgaaattaactctttacctttacctacgtttccaaataaaggcgtttcaaaaatttggttaccaacagaatatgaaatgtcaattactccaaattggagtcaagatataaataatgttaatagaatgaatgattcagaaactgaaaaaatgaatcaagatagtgatatagatttaggccaagatatcgatgacgatgatgatgatgatgatgatgatgatgatgatgaagatcttgattgcaataattaa

SEQ ID NO: 3923 - DNA, 1039 bp, Cryptosporidium hominis
atgtttattaaaaggaatatattgagtttagcaacattattagttggagcttcagcaagtggtatatttagacaatttggtgataaaataacccaacaagcaaatccatgtcatattacatgtccaagagaatatgctccagtatgtgcaacagatgcagaaacttatgagaatttatgtttatttggagtagcaaaatgtatgaatagagatcttcaattggtagcaaatgtaacatgtccagatttattaatacatttaacacatttagcacagaaaggtatggtagaaagtatgaatgcaatagattcaacatatcaaacatttggtaatataacaaaaggaacagcagaaatgatatcatctactttagattctgtaccattaataaaattaccaaactttaatcttccaatatttggaataccaccaactccaccacaagttttgaaaacaacttcaacaacaacaactactactagtacatcaacatcaacttccacaacaactgaaaatacaagtacaaattttgaatcagattcttcatctgaatcaacatcagaatacacatccacatccacatcatcgactattacatcagatattgaacctacatctacatctacatctgcttctacatctgcttccccaacatctacaactacctttgctacttcaacaaaatcttcaagaaaattaatagagattccaagtttggaacaaggagcaagtggagtaatagcacaggtaactaagacaatacaatcagcactaagtggatctggagttagtggttcatcaccaacaacatcatcatcagcagcattgggattaaataatttggatgatgcaagaacaacaattgagggtatggtaaagactattccatatacaccaggaaagaattctagtaatatattattagtagatggagtttcacaaatagtaaaattaccaaatggaaaagaaggtaagaatttactttcaaatattacatcaacagaatcatttaatttaccaaatattacaaatttaacaa

SEQ ID NO: 3924 - DNA, 5922 bp, Cryptosporidium hominis
atggtattcgaaaatgtttgtattgattcttctaattctaataatattgcagattcttgctcattctttacagaaaaggcgagaaactctgaaattaataataatttagaagaaaatgatcataattataattacttggcttcagttatggaaaatacaagtcaggcttttagaactgcaagacaaaaagttaagatttgtattctgcctggtaaaattaaagagttggatcaatttattaatggtgaaattgatacaaatattaaagatctaaaaaggtaccgattacgatttattaatgaaaataaaaattctcaagattctaattcttcttctcatattaataatgattttggaattacagaatctttacaaaaactcaaagaagaaaatattgagaaattaaattctttaaaagttttaaaggataaaattaatgagatcattactatcgataatcatcagaaaaatactggtgatcatattccatttcttatatcaacatttaactacttagtggatgaaattaagttattagaatctattttagaagaaagtaaagatgatcatactcttgaaattattaaaatctatcaggatgatttagttattgatagagaaatacaagattatattgaagttatactaggtataccagaatacgtatctttaatgccatattatactagtctttgttatccaatacaagatcataataagtttcctttaaaagctattaaagatattttaagaccaattaatggtgatttttatcatcctattaatttacttggttattcttcaaaaattcaaagagtaagaaaacatattaaaagaaaaaagatcatgattagaaatgaaatatcaaatattaaaagatctttacattttatatatcaccgctataaaagatatgtagcatataatgaaatgttaaatagtgaaagagacctgaattttacttggggttgcttacctttaagagcaattgatcatcctgatcaattggtacctttacctattggttattttaaacatgattttaggtttaaagtatatcataaatttctagatcttctacctgaatgtagaaataatgatatatcaaaaacttatatgatgtctttacataatattcaaacaccaatactttttactaattctaatagagctcttgtatttggtgataacattgattctgctaatactaataataatcaaaagttatataatattcaaacaaaaggaggtatattaaaaggaagtgatcatattgggaatcttgaacaaaatcattctgaaagtattaatcgaaatagtcatgatataaataatatctctaattcaacaaatgaaacacttaatactgttagtaatacaagaagaaaaagaggaactggaggaattgatgtcggtacctttgaattaaattctacaagatcaagaaggacaagaaattctaatgataattctcattcttccaataatattattggaaatgaagatcattctatatcatcaaatacaggcaatgcatctttatcatttattaatttggttaaaactgggggggtacctggatctacaaattattctaatgaatttgcaccaattatgaaaaatgattctcaatcatcaattggaagtattttaacaggaaataatatcatttctacgtcacaatctaatctttctcattctaatagttctaattctttatcatttggttcttctggtactacaacattaggtatcggggtaactaaaaactataaggaaatacctatttctaataaagaaaaagataaagaaaaagatattggattgaatatacaaaaaaatagggaaagagaaaaaggaatagtacatcaaaaacaagctcaaagagaatggatgcaaatgactagttcatcatccagttttataggtccatctccattatggtttgagaatagtatttttagatttcctgcagaaattgaatttaatgtttatgatcaagatcctattaaacctgtgaaatttatttatattaataagaataatcaagtaatcaatccagctgatcaagaaaggaatagaaatactatttggacttattcagaaataagaatgtttatagaaaagtatttaatgtatccaaaagattttagaaggatagcatcatttatggaatataagactattaaagattgtatagatttttactacaaatataaatatacattaggatttaaaaggattttaagattagtatattattttaaaggaagtcataataagaatcaaattaatatgaatcatcattatgatcaaaaagatcataatataatgaatgatgatgaaataatatcatcttcaattcatacaaaagatgatacagaagaaaatattcaaagaattattaaagattctcaagatgatgataatatacaaataaaaaaagataagagtatattttggaatagccttgttagtactataagatgtatggagattattaagtataagaaacattcatatagggagcttttaattgatgaaatattgaatactttaacaattgaatcaacatatactcattttatgagagatttttataagagatcatgttttagtagtcttggtaatatgaatatgtatacagagagacttctttcaagatcatctttaagaagaatgttaaatagaccatcaacattatttaggcttccaataattgaaagaagagaaatgaataataatatgataggaatagaaaagaaagaagaatggggattatatgatgatttaatatataagtttttatttagaaaacatgatgattctcatttaaatacaaataaaagatatacaatggataatttaagtaatggatacatattaccaaaagatatggacgcattaatttctcctttttataatataaatattcaaaataagcaaggaaattcaaatatacaattaccaagtaatataccgataatatttgatcataaagaatataaagatcaagaatctttgaatatgtcatatttggatccaaagatatcaataaatgatttaaaggtatcggtatatttatatttgaatcagtttatggataatataatgggagaattaggaggaggtataggaataggaggagttataaatggtagtaattctttattacatactttgacaatatctccatcaaataagcaagattattcattaccttcagatatttcaaattatgtctcaagtgttccatcaacagagacaggtaaaggtaaattaagaaacttggaaatagttaataatataaatagtaattcagtattacaaaaatcatcaatgaatgagaagccaaggcaaggaagacgcaagagaggatcaggatcagggtcagggccaggatcaggatcaggatcaggagtaacaggagtagtaggattgttaaatagcaaggaagttagtgatacgaacagcaatgatatactaatgagtagtggaagtggtaataatattggtttaaatgaatataatgaagagaatatgagtagaaagataccaaaattgatggatgagtatatgaaaggaaataataataataaagtattaagtggtaaaatagaaacatcatcatcatccaataatattaataacttactattattaaataataatggagttctaacaaactactttatttcagataattcaatttctggactaagtcaattacagccaaattcattattaaatatgaatatgggtaacgtaaattttggattacaattacctaaagttaatgatcattctataccaattttatcaggtggttttccatcaattattaattcatgtggaaatgtcacatctcaagtgaatccattaaagccttgccaagtatcaaatgcagttatttattctggaatgggagtggaaaatgctgttggtgatgtaggaggaagtggtggtaatgatattaatagcagtagcagtagttgtagtgggaacggcaatggtattcaagatttgtcagggcttggaggaatacaaggtatgggaggatttcagggtttgggtggactacaaagtatgggaggactacaaaatttaggaggaatacctcgtgtaggaggcatatctggtatacctggaatggctaagggaggaattcctggtataggagggctgggattaggaggagcagcaggggtaggagtaggaggagcaacaggagcaacaggagtggggtatccttctggtttattatttggaggtttggggtctaatcttggacagcataatgtagcaggaggagtaggaggaacgggaataggagaagcagggtcagtatcaggagcaggaggagcaacagagaatccaatatctataaatcctgtgaataatggtgttaatacaacaggcagcgttaataatagtacaagtgattcaacaaatattaattctcagagcaatcacaatcagacttggaatagtatattaatgaatcaatacttacaacaacagttggtttttcagcaaacattacaagaacaaatgagaaattctcaacagattggatttgttggaggattggcgaatcctttaaatcagatgataatgaacacattattaggaagtggaggaattgttggcggtagtaattatactgcaggtatcactacaagtcctaatttaacttctgtaaataattcaacaattaaagattttacagagccaaaagaacgggatcttaatcctgaaactgtaccaaatcttgagtctgaacctggacctgaaactaagctcaaacctgaatctgaaactctgattacggatttgaaagaagagatggtttctgggttagtagaaggaatatcagtaaatgatcaatatggaaaagagaagcagaaagagaaagaggagaagaatgaggacaagaatgaggtattagttggagattctactaaagtaggggattatgataatagtagaggtatggttttagctgaggaaacgatagtagacggagagaagtcatgtgaggttgttgaaatttcaagtaaaataacaatgggagcctcagaaggtgaagaaggaggattcacttcaaaaacagaaaacagctcaaataaaggtattatagttccaggaatatttgattctgcaactttgaattcagaaggtgtagtaggatctggagtaggagcaggagtaggagcaggagctggaagtggtggagttggagctggagttgtaactggagctggaattggaagtggagctggaattggaagtggagctggaattgaacctggaagtggaattgaaactggaattggaagtggagctggagttggaaatgaattcggggttggaaatggacttttttcacaaacctctttgcaaacacaaccccaagcatttcctaactttttccaacttcaacatttgttccaacaacagttattgcaacagcaacaacaactgcagcaacaacaacaccatcaacagctacaacttcagcttcaattacagctacagttaaagcagcagcaacaacaacagcagcaacagcaacagcagcaacaacaacagcaacaactacaacaactgcaacagcagcaacaacaactgcaattgcaacaactacaacaacagtttctggcgaatacaatcccttttaattttcaaagtcgacaacaattaaatagaaatcctattggaggagatatgttgagtcttctaatacaacaacaacaacttcagcaacaacaatttcaacaacatattggaaacccaatagttggctttaatggaataaataaaggagggacaacaattggaaatccaattcaagattcaacaaataataataatagtttaaagaatgtgaatttaaaccaagaaattcctaaaaaggagtga

SEQ ID NO: 3925 - DNA, 630 bp, Cryptosporidium hominis
atgataaaatgtaaagtttttccgacatttttagtcatttttggtattttctacacaatcactctatgttcaactatccaatatataggatattgtgaaaaccatgaatttcatgaaatttacgtcagagttattgagaaactatataataaaaatgaggaaattaccagaagagacaaaagaaatgaaaatattaagcaaataatcattggaaaaaaatatgttaatgtacttgattctattaataatcggaaagaaatccaaaaacaaccaaatcttgaatatttagaagatgaaaacagtatttataagacatattctcaaagaagaagttattttacaaacttaaatcctgctgattgtagaattaatattctaagaagacacaaaatcaaaatttcaagagtttcagtatctgtaatggaatcatttgatcgacttattcaacttgttgatatactttcttctagaaaaccatgcccttattgtaaaggatgtaatgattctagacttgacagtttaccaatatgggtttccccaattctacatagacaaataaaaagagtaaattctcaattagataataagttatgtctaatattaaaaaaagattcaaaactcaattccatt

SEQ ID NO: 3926 - DNA, 1542 bp, Cryptosporidium hominis
atgcttcaaaaaggtgttcagagaaatacaaactttaatcaatggaatttattgattttattattacatttgcaattactaatagtaagtgtaaggtcaaatggtggtgatgagttttataatcaagtagttccagaggatcactctaaagcaataattgacgcattaaaaagtaatttaaataataatccacaattgaatggagattttaaagatttgactggaaatttaaataatatgaatggttatcagaatcaatattattcagatggaagcttaataaatatgaatccaacagtgagttcaaactataattcaaattttggtggttttgctcaatcacagagttatagtttaagaaatgaaatgaatacttatttagatcctcagaataatagaaatcaagtagattctaacgataatacttatcatataatttactcaaataatgaagaaagaaaagtgcctttatttttgtcaaaatcacccttggtggtgaatagtggaggaggaggaggatattcaagacaaagctataatgtaaatagtcgacaagaaattaacaaatatttttctccgtattcttcaatccactacttaacatcttcagaaattccaaacaatgaaaattctagatggacttggaaccgcattgagaagcctatatttagaacaaacactgcaaagcccatagagtttaagcataagattccaagtaaggacgaagcttggtggaatgtatcatacaatgtaagaaaggagcccagaagaatggattattcagagaatttagggcagaatgaactggttcaaagccaaaatacagctttaggcgatggtattgaaagatctggtccaaacttcagtactgattttggatctgtagctactaacgaagcttttgaacaaattcaaagccagagccaaagccaaggacaaagccaaagtcaaatacaaagccaagaccaaggccaattaaaaggccaaattcaaagccaaatccaaggacaaaaacaaggacaaaaccaccataaccaacactaccataaacatggccacagccataagcacaaacaaagtaatagccacaaagatcaaaacaataaagatgaagaagcccacatagaagatgagattgtaaaatctacaacagttggagacatagtaaatttaactcggttggaattacctaacccatatgatagaaaagttgcggtggatcagcttatttcaacttcattaaataacttaaaacaagaaaactggtcaattcctgttgaagaaataatcaatgcaacttttatatatcctggaactcaacaaccagatcttgttccaaaccaaatgggacctaaagtaaaagttcaagacttttactgtaatcctcagattcacaaatgcaccaatcttcaagaagttggagttgctattggtgaacctatttggaagatttataatacttctacaattggacgagctcaaagaagaattagtaattttcttgatgatacggaggtaagtaaagcttttgattttatttaa

SEQ ID NO: 3927 - DNA, 651 bp, Cryptosporidium hominis
atggcagctcttaaaaataaaatacatataaaagaacaatttccaaagattttgaatgggaaaactactcccattataactgattgcatatacaaagagattgaaatgcttaataatttggaaagcaaaaaagcagatttttctggtgcaaaactaatagctagaggatacttcaggcataaatgtggtcatacttactgtaatgaaaatatctctaatattgaacataaaatttctcttacaacaaacagtcaggatatttcttctgatcaagaagatcaaactgaaaaagataccacttctgaagttaataatgcagaaaatcaaaatattcaacgtacatttgattcttttagatgcattttagatgttatttcaaaagataataactctaaaaaattcattgttgcttctcaagatcctcttttaagaaagaaacttcataaagttcctggagttcctttgatttatttaaataatcaagttcctatattggaacaaccatctactgcatcttataatcacaagtttgcatctgaagaatacagaatggggcctcaaaagtgggaatactctttaattccatcattaaagagcttaattcaagataataataatcttgataataatgggagccaagaatcaaagtaa

SEQ ID NO: 3928 - DNA, 1119 bp, Cryptosporidium hominis
atgttagttcaaaattggactatgtttgatggagttattctatcatgggaattgacaccaagtcagctttacattaccttaaactgttcatctagaagcaaaagatttttaggattttgtgtaaatggtattaaagaaattcatggtagctttgctaatgttgttcaggcaatttgtaacccttcagaaaagtataaattcttaacaaattcatacgaagatgcaatttctttgactaattatttaaatattatatactttgttttattagcttcagcatccgtttctatatttggagtagcattcttaatgttgtatagcagaagtttcaaggttgaagataataagacaagttgtaaaacctctgaagtaattttaaaatctaaaccaagaattggtttagcagttgtatcaattctattcagtattttggctttattaggagtcagcttttgcagcatattagttatttatttgagccaatctttacaagatatactatcatttagttctgatgttccaatatttacaattgaacctttcaaaggttcactaggatggggattttatttacttttattggccaattctctattaattgtacatatattggctcttgtagattcaacaagaatggcaaaaaatctttggttatttagtcaagaaattatggagagtaatgcagcaaaacattctgagattgtgattaagaatactaataaaataccagagaaattttttgttcatagttttccaccatcttcaattgaatctcaaggacctcaaaacactggatccacttttctaccaaattcaggagttgttggaagtcgtatccaagttcctattactagtgaagatcagtctcattgccagtatatgcctttagttcaaaatcaacaattatatccaaagattagtaatgctccatcaacaaggtcagtatggggatttttcccagttaacttacttcctcgttttaatccatacaactctggaatgccaaattttatgaataactatggagatcatcactgtcatagacatcaaggatgtaatcatcatcatcatcatcatcatcatcatcatcatcataactgtaatactgattttctaaga

SEQ ID NO: 3929 - DNA, 342 bp, Cryptosporidium hominis
atgcatgagattcttgatacatctaatagattttctggagtaaaaagaaattctcctttatacttagattctgatttaaatattgaagggaagatgatatttcatagattccataagcgaaaatggaaaatgtatatagattctagcaaaacaaaaatctttagaatgagaaggactcagacaggtggtgtgattcctactaatattcaattaggagcaaatcaaaagattagaattgaagcaatagattgtcttgattgcagaattgatcattctgacactacagagagaagagatcacgaagttacaagtttaattaagaaagatgaatttagatactaa

SEQ ID NO: 3930 - DNA, 5799 bp, Cryptosporidium hominis
atgcagaacaggctattatattcagaaggagactatgaggactcttttttaagcggagttgttggtctagataccggatcaaatggttcaggcaattcttctagaagagctaatcaagggggagcagcagggggaactgaatcaggagggattggactttatgacagtagaatatctaataaaggcggcgcatattattcttcagaaattaatcatggattaccaagtatgagtggtggtagatcatctgttggctattatgatcattttggtggggttggatcaggacatttggatagtggcttaggggctttaggagcagacttgagagttggacaagctccatggggatgggaaacatatacaagttataatatgattggcttgttttcttcccatactaataataagaaaattaggccctttatttcttcaatttattgtgatccattttatgagctcctttggcttggatggacaaatggatttctgagttcattcagatttccccactgtagtagatatacagcatttccagtaggaatagctgattctgcaaatgggggtggacttgtcagagataatgtgatttacatgggatttccatcatcttcgcacttatatacagtgactaatagtggaataggtgtctattccagaggaggagcaccaatatcttctcattcatataatacactaaccaatgaaaaacaacaaagctcaaaaatactgtgttgtgattcaaatagatatcagtcttatatgatgagtagtcatccaatcattggtattggaacaggaaaaggtgtgtcaatcctagatttacagcaagtacggccaattcacagtattccatatagtggaagtattagctgtattaaaagctcagcaagttcctcaagttttattgttggaggagtaaatatgcttggaattgctgatacaagacttccaagattaggacatactattcagatacatcctactaattcaggacaaaatgagacattggtttcaggattagcagttaatgaatacacagtagcaataattaccagtacaatctcaaataggaagatatcgtcggatgaacttttaagttctgttggaggagtttgtggacttcctgtgcttgatttaattagaatccatcctggagaagtttctacttcaccagaaatgatggtttataagaagaacttagatttgacaaacatgatgagggattctgtagttagattatatgataccagaaaattcagaccaagaaaaaatatctcattttctccaggaccaataaacattgcttggagtgacaattcactggccatttcagcaggaactgctactacacctgattttgaggatttatacgttattggaaataatggacagtggcaaatctaccactctaatatagaccaaatggaattctatgctactccatctgttcctttatcgaatcttaattttagctcttctagcaattacttaatattggctgatacttctgggtcaatccacactatgcagagacctcatacaaatggaggaataacttcttcatcttcaattcaagcaaatacttcatcgaacaccaatattagtacaagcaacacaaaactagaacagcaacaaatcacaggctcaggaatttctggaggtggtattggtggtggaatgggttcaagttcagcttacaatcaccaaaaccatcaacactcttttagcgtcttccattcttatcctcttcctaatctaaatataccaggagcaaacattggaggaggttacagtagacaaatgaatacttctctatataactactcatatgtgaaatcaattcaaactctaatgggaatagcctccaatcctgtaactaagcctgtcactcataatgttggacacccaacaatacctaaccttacagttgcactcagatatcttcaaggacgtcctgttgttgcttacgactctctaaattcagttgggattcctcctattcttgaaaagctacataatggaaagcttaatattagagaagataacctacttagctttaacaacaagtttgatattgaccaaattcgtaaaattcaaacagaatttggctggaatacctacaaatcatctgatgaagtcccacatggacttactatagttaaagctagaacaatttcccgacaaacagattcttcacttggtctcaatattagcacatccaatctccctggacctcagaactctgcaataaggagcccgcctaacgtgggaagcatgcaaggtttagtgcatgcaatggggggcattaataagcagagtggaattcagtcaaacacaagagaacacaatgaaggtggagaggtccgacacagtcactctagcggagctttggcattttctgtggagtatatccgtgaagttcgaccagagatggaccattataaactaaaagcattggattttagaatggttgactttataaaggctgctattaaccccgatacgactaaatacagaaacaataacttggtttatggtatccctcttctttgtcttagaggctctatgccaatttggtattatcgcaagaagaagaatatgtctctttatgcatttggaggtactcaaggctcttcaggtgaaaattctcacacaaaaagcctttccttagtccctgttaaattccattataaaccaagattgaacccaaataggcgggaaaaattgaagaacagaaggatgatgggtggaggtacttcaattgagaattcaactgcaggaacttcgggccaaggtgttgctcatacaccaggagctttgggaaatatgggtactagttcatcccttcctaatggaggggatgctcaaacagtttcgagagcagaggatgaccaatcttcaattggagaagggttggtttcaatagaatttgataacgatactttggactttactcaaccattctttatgttactttcttttattccaaagctttcatatgatatccttcttgctcatgtgccaggctgtacctcagaattttgtcttgcttgtgagcttgttcatttaacatttatgttgtacagttgcaagtttaatttaaaaaatggaaaaggacgaaatcccgacttatttccatgcgtaatactcaattcaatctatacattaaacatgttaagaactgttaggcatataccagaaataaaacagcttgggatagattccgaggatagtcaacaaagtctagtaggggctcctggagttggaggaggatctgtgaatagtaatggctctttgggaggtactggggttggtgaattaaaatttggtggagttggatcaggaagtccaactggtggattcgatgatattaactttaatggaatgtctttattgagtcacttaccacaagcagctttcaaccagattcggaagacagagatcttttggaagttcttcttggagaatttgaaaggtgatatgatgaataaaacaaattttaatccaaatactgaaaggataatcgatgagcaaggaacaattactcctgaccaatttggaggtacaagtgagaattgtattcttgaaaagttgatagattctcttttcaatattgaggttacaacaatcagtagttgtgtacaagctaaacatgcatttaaatcaacacagattgtcacatatttagatataccagcaaatcatttattagcacagaattctatactgataggccagaagttggatacatcttccaaaatgggccagaaggatgacctaattctatcccagaagctgaaatctgagaaatttttgaaggccttgaattccaacttactgaggatcattgccggaagaagcttctgtaaggaatgtggaatttcaactgcttgtcagcatgttagatgtatcacaaagctccctcagcttcttgttctttcttgcaatatccagtcactaaaacactggaatgaatatggaggtatgtctcctgaagaacatgaagaatttgtcaaaaagaaccagggaataggtggaattggctctggaaccaaccacgaacaacttccaaatacagaatattcaatacctttcgatattcgattctcaaagttaagaaaagggttcagttctcagaatggacgtggtactggagagacatcaggcggaatagatattatccaggttgataagactactgtatttacagagggtagtattggacataatggtgaacgagataaagagtccaagttagacgacgaaaatcccaatatgggaggaaactaccaggaatatgagttagttgcattgatatttggagtttatcagggttgttcaattcagcttccatcaggtacccatttttgtatgtatgttaagcataagttattatttaacgaaatgaataatacacaagataaatggtacatgatcaatggatcttcaattcttccagtaaataacaagaacgagattattaattttacatcttgttggaaacttcctactttcttattctattcagacaagaaagggaatttattgaattacttattcaataaatatccatgtttagaatttcaacttgatttggcccaaagtgacttggatcttttagtaagaaaagtttctggtactgataatgatgatgaagaatgcattgatcaagaaaaggagaaagattctctgagtaaagacgaaggaatacctgatcaaacccctgataataatttagaaactagcactaatcttgaatcaagtcatttaacccagaatatttctgaaatggagattttagatattcatggtattaaatttaagataccttggaagtatccaaaaataatacatgaacacgtaatacaacaactagaatcaataataaagctaattaaaaacgaacagaatctttcagaaaatccagatcctagtcaaatcaatgatcagtctccattcacaactagagaactttcaaatctttgcttaaattactttgtaagatatccattttctaaaggacttttgaagaaaccaaaagaaattaatgaaagatttataaatactcctagtcattcagaatttattcaaaattctccaatgattgttgcactggattcagagtatgttgctttagatgttgaacaatctgttgtaagatctgatggaacaaaagaaatcttgaaaaaatctcaattatctttggcaagagtttcaattgtacgttgtggaaagatatcattaacgggagctaatgataatgttgaaattgataataaaaaaggactgataatggaccactatgtatcttacggatcaaatagtcaacaacctagagattatttgacaaaatattcaggagtgagacctggagatttggatcctaaaacttcatctcattttcttaccagtaaatcttgtatacttaagaaacttcagttcttggtagatgctggtgtagtatttattggacatgcactcccaagtgactttaaaataattaatatttatgttcctccatttcaaattattgatactgttgagatttacagactccctgatgaaagatatatcagtcttaaatttttggccaagtttgtactgaacaagaatatccaaactgaggtccatgattctatcgttgatgctaaaactgcactcgagcttttcttaaagcacctttctttaaagaagagcggatcttggaatgatttccttagtttcctttattcaaaaggtcattctgttgactggaagattgaagctattgaaaactcaaattttgagcataattaa

SEQ ID NO: 3931 - DNA, 939 bp, Cryptosporidium hominis
atgaaaagtaaggaaaaaggattaataagtgaagaaaatgaagaggttccagtaatattattaagaaaactaacaaaaaatgagacaattttaagtctagaatttatcaagaatgatagtaatttaatatctggaaatatttccggagttttggatatttgggatttagagatcatgagatgttcttcaagtataaatatgaaatttgattcacctattattaaaactatttatgatgaaaaaaaggaaattatatatgtacaaaatagaaaaggtgagatttatttggtagataatactgaaaattttaaaaaattggatttaaatgatatttattattcacttgcaaaaatgatcattcttcctactagagaaagtataatttttccaagaaaaaatgatcttttattaaaaaatattaataattcgaaacatgatgatattcaattcaattatccaactgaaaaaagtgacaaacttattgaagttgaatctcttaatgatcattctgtattattaggttttgaatcaggaaatgttgttatttgggatttaagaaaacctgattctcatgtatatatgaataatgtaacacaaaattctccaatattatctatgaaaagatcttttaatcgtatttggatatctacatttgattcaaaacttcgtgtttttaatagaaattgttttgattatccaattaaagaaattgactctttaaatgttgttgataaaatttctgtacgttcagattctcttattacagttacatccaatacactaaatacaaacatggatatttttgaaaataaatctttaaattatattaaaacattcaaatttcattccacagaagttagttctatacaattctcaaactcttcaaatttatttgttgcttcatcaaatactatttcaatatgggacttactatcgtag

SEQ ID NO: 3932 - DNA, 501 bp, Cryptosporidium hominis
atgtttacaaagagactaaaagattatcaaaaatctagaaatgttgaaaggaataattttgagaatatattaaataaagaaagtcaaaaatttaaagaattcgaaataggaattagtagattttacaaaaataatgatattatagaagaattaaataataaaagtttagctagtattacaagtactagtagtagtaatagtaataatagtataaataataaaagtaaacaagatgatattttaagtaaaataagttattctccaagcattgttagtaatgattcaaagacaaaatcagattatgttaaaacattaagaagccaaaatagtgtattaaaaagaagggaattaataatatctgatgaggaagaaaatgatgaagatgataatcaagataaatataagaaaagaagtaaaataaaagataattatttagaaaatgatgaattaaaaatattaaatagaagagttttaatttcttataatattatgatatattag

SEQ ID NO: 3933 - DNA, 4197 bp, Cryptosporidium hominis
atgaattataataataacagagcaatagagctcagtaaaatacttaaagatgaacaagaatggataagaactagaaaagagtctcaatcaactttaataatagtttctttggaacttcctgttaaagtagttcgtttagaaaagatggaatttaataatgatatagatcatattaataataataataataataataataataatgacaagaaaaagcttagatttgaactaaaatcttcccaacattcattaatgagaactttacatggccatagaaatgaattatcaaaaactgtaaaatttattggttggcctggtatccatatagaaaaagaagatgaaaaagaagaaattagagaattacttgagagtattgattgtattccagtatttcctccagaaaatgaattcaaatcttttaatgaattttgtcaattatttttatggccactatttcataatgtattaaatcctgaagaattaagtaatgctccttttgatcatgaagaatggagaagatatcatcaaatgaatatgttatggtcatcagtaattactccaatagtttctcctgaacatatggatatggtttggattaatgattatcatttacttttattatgtcaatatttaacaagaagagtaaaaggagtaaatattggattatttcttcatattccatttccatcatttgaaatttttagatgtcttccagttagagaagaattattaagaagtatattaatggcagatttgataggttttcatttttttccatatgcaaagcaattcttatcatcatgtaaacgtcttcttggattagatcattattttaaacctggtggattaattggaatagataaaacaacagcttcaagtagtagatcagtaaaatcaaataatagtttagatccagaatttaataaacaagagacaattgttagaataggtcatgtacatatacaatgtaatgatattcttcaaagtattgcttcaaatcatgagatcttaaaaagatctcaagagattaggaataaatacaagaaccattatatttttgtatcaatagataggcttgatcaattgagtggattacaacttaaacttaaagcttttgataattttcttcagaactatccatatattaaagaagagcaaccagttgttttgattcaatatatttttccaacaaatactttaacacttgagaagagagatcgactaattcaatcattagtaaatctttcaaatgaaataaatcaaaaacattcaaaatcttcagaatcacttggaaaaccagtaatagagttaaaatatggttcaataactcaagaggagaaatactctttatttctttctggagattgtctttttgatacaagtgttagagatggattgaatttgaatccatttgaatatattatttgtaaagatgattcattatctcttttgaactcaaattcattgaagaataatggtcataagattattgggaatggagttagtgacacttcttcttcaagtggtaatagcagtagtagtagtagtagtagtagtagtagcagttcagagtatggtgaatccagtggaaatgatgatcgaataatgagaaaaacaaaaataattggaggatatggaattggtggggataaaacagtaatatctggtccattttgtagacttaaaggccaaaatagtttgccttctttgataatatcagagtttacaggatgttcaaataccctctccagtccttatagagtaaatccttggaatatgatgaatgtagttgaaactttagataagactgtttattgccaaaagggaatctttcaagaaaaaagacaccattggaatatggacaaggcgtatcttttatctcatagtactgtaaactgggccaaggaattcattatggatttatacatcttttccgaaagaaagaagaatgaaatgcttcatttctataatacaacttttggaattggtccatctttgatggattttcgaattaatcttaattctcaacatcttagtcttaacttgctttcccaagtgtacaaaaaagctgataaaactggtggtttgaaacttttccttcttgataacgaaggaacacttactccagattttagacactttttcgataagattaattcctcttctaacttttacagtaactccggatttgggcctgaagtcaggactggagctggggttggggttggggttggatttggagctagggttggagccagagcaggaaatagagccgtatctgtagttgagcatggagttggagttggagctgtacatggaagtttgtcttcgtccataggagctaaccaagaaaaaaggaaggaaaataatgaaagaaagtctgaaaagaataaccaatctgttcttgaaatgaatccaagcctttctaaatgctgtggtggagatgaaaactttaacgttagcaaacaagtagaaggtactattgagcatagtttagttacatgcactccgaaaattataaagtccaaatcaagagatactgagacttctttggaagaaaatttatctccctctgctatacaagtttattcaaattcttcagtttcttcctcctctactcctttatcttgtcaatccaatgaatatgctgcctttaatatcaatagcaactgtaccagtattgaagctttaaatttagaaaactccttttctaacaccagtatttccagtataatcaataacaatgtacccattgctaatcctggaatagttaatgaagaaaaggatagatgtgttgaaattagaaaatgcatggacaaaaataataccagtagaattcaaagtataaatgaaagagaatgctcaccagattgtcataaagtaatgaataatggaccaatttttgaaggtaataataaaaatgaggaagaagatgaacaaaagtttgaagacttttacttgttaaatgaaatctcatgtgctcctccgcctcaagtgattgaagctctcaagaatttatgtagttctccaaataacattattatcatcttttcaggaagagaaaggcatcttcttgatgaatggtttggagatatagacaatattggactttgtgctgagcatggatattatctgaaactccccaaatcgattgatcctattcatcctaacgtttggagacaactcaatattgaatcttcaactgaagatcgtctttcttcctcttcttcttcctcctcagccatttcttcttcctcttctttatctgcttcttcctcatcatcatcatcttcttcttcttcctcctcttcctcttcctctttttcttcttcatcactctcattctcctcatcttattcctctccttcactaatgtactcagtaaacaaaagtaatggatctgaatataatttatatggtcctttaaaggcgagctttgactcggatttaggaaagtataaggaaattggtgaccaaaagaccaattctgtgcctttattgccaaacaagcaacaaaaactccagcagcagcaacaacaacaacaacaacaacaacagctgcagtgcaatgtttcaaattggaaaaatataaccttccagcttatggaacagtatgtactcagaactcaaggatcttatatagaaaacaaaggaacagctttagtattccagttcaaatattgtgagccatacttcggagcttggcaagctaaggagttatccaattatctttctgaattattaataaactttccagttaatgtgatttcaggaaatgattttgtagaagttcgtcttcaaggtatcaataaaggagtagctgtacaagcaattttgaatcaaattaattcattatcaagaaataataatcatcatgaaaataatgatgaagaagatgatttaacaaaaaacaatgcaagcccaaatctttcatcttcttttcactctcctcctcctcttgaaatgatactctgtattggagacgatagatctgatgaagatatgttttctgtagttaatcatttctcaaagtctattaactccaatcaaaatactgagcaaattccagattgtaaatcttcaaaatgtgaaatcttcaatgttataattggaaaacatacatctcttgcaaactatttcctttattctactgaagaagtatcggatattctccaaacacttactttatttacatag

SEQ ID NO: 3934 - DNA, 1089 bp, Cryptosporidium hominis
atggaagaatttaaatctagaagagattttaaatctttatttttagaatctgattcagaaataattaaagaaaattggttggatattttagttgaagatttacataaagagttggtttatcgtaattctaatgaactttggaagttggatattgcttatttttcatttcaaaaatttggaatggataaaagttgtaaggattctattattgaatcctattttggtaataaaagatctgagctttatcttaagctatttgatcaagaggtgaatgaatatcataattcagaatcaatttctaatgagagtttagaaggtatttctagtggttttattaaagaattaatttttggaaattctaataataaatcatttggagataatacatttgaaatgatgatacaggagatttggattacaaaatggaatcaggaattattacaagatcttgcattgggagggagagagttagttcaattagattctttaataggaagtcaagatataaataaaaaagttgaagaggataaagattcaatagaaattttgaaacaagaaagatcacaattatcggattttcaaaatgaagatattaatacaagattaaatgaaagaagggaaattagggaagcatatcagaagataagttcttgtataaagtcaggtataaatagtttattaagcaattatcttaatgatttaagtccagtacaatgggaaacttatcgaatttcaacagaaagaatagtatctcacttttcttccaagtttcagaaagattttaaaagaagaagaaaagacgataccaaacaggaagaagcaactttaagacaagattttggacattatgtagggtttgaagaatttgatgtaatttttccagcagatattgctagaattctggttggagttacatcttttagatactctcataaggttaaaggtggtcttaagaaggattatttggatagtaatgacgtggtttcttcaaagttatggggtaaatttaagagtataccatattttgtagttttggagatttgtaaggaaagttttaaagagataatgaagagcaaactaagtatataa

SEQ ID NO: 3935 - DNA, 642 bp, Cryptosporidium hominis
atgagtactggaaacaagcgaacaataagacaaatatataatggtacggacctttcagatgtagtattaaatttgccactaactccatatagtgagcaatttttgccttataaacaaaagttggacaaagcattatcagatttaaagttattagttcaagatcagttagataaagaggaggagaaattgaaccttgaagatattttggaacgaattagaaatacttggacgagcaaaagtgactctaaagaacaaaaagaggtgataaatgaccaaatcaaacaagacaaatactttggtgtatacctggaaataattcaattggaggaaagtaaatctgatatacttgaatgttttataaagtggaaaaatgatcattattatactaaatgggaggagtttaatcagcctccaaatgagatgagggattattggctcaagttcaaagataagatttcaaagataatattggatagtagaaagataggctcaaggctattaccaagattattagtttctgaaaataagtcatcacaagaagattttagattggataatgatttagataatatgaaaaaagagacaaattctattaataacaagaaacacaaagatataggagaattggatgggggagaatag

SEQ ID NO: 3936 - DNA, 933 bp, Cryptosporidium hominis
atgaactcaatcatttcattattagtactatctgctgttgtccttgctaatatttctatttaccctacattgaatacagatacacagagtttaaactattatgtcttcagttatgctcaaataaattctgcagtaggatctacatcaggatctggccaattgccacccaatgagagaaaaagaaaactatcaagcgatgaacgtgattctagttcttctggacatcgaccttcacgtaggcttcgattagaagatagtgaaacatcttgttttaatacacttgatttccttaaattttcattggaggatatttcagcttttcacaaaccagagcatttaactgaagctcagttaatggaattggttcttactgaattcgagaagggcggaatttctagggaagatgtttcttctgaacaaatacttgccgtcgttagtagtcaagccaaaatatgctataaaaaatggaaaacagttaagcaaagtcttaaatctttggaagcatccctgactgatttagaggaaaaacaaaggaattcacccggtactgatgaagacgaagcaagggctttttctgatgcttattctgatattgtttctaggcaagaattgcttattgagttagaagcttccctagcatctgtttacaataactacttattaataaaggagaaacataccaaagtaaggagaagtgggagaattgcttcatctcgccaacacagcagttcatattcatcattttctcctcaaactccatctacttcgtcctcactccaatctgaattttcgcaatctcaaacaaggcttccatcagctcatacaacttcacgttaccattctcgtactcatcaatcaggtagaggcgtaacttctactcgtggtcgttctacaagaatgagacaccgtagacgtagaagaacattacaataa

SEQ ID NO: 3937 - DNA, 2739 bp, Cryptosporidium hominis
atgaatggtcaagtatgggcatggaatgaaacaggaataatacgtggttattttccaaaagttaagatagtagtaccaagaacattaaaaagtattaatatatctaaaacaatattatgtagatatatatggagtttttttataccaacttggaatcgtatatttattacatcatcaaaagaatcaaaagatagtaaattagaagacaaattatttacatcatcaagtattttatgtaatccaatatacattaatacagtaactatgggaaatataagtccactaagagcaagcttggagggatttgctacaccatgtcatccaatgtgtaaaccaatttatgcaaaagatgataaagtaatgaataaaattgaaaataatattacatgtcaatttcattacgattgttataaagcattatattttttacttattgcaaagcgtttaattggtgaaagtattgaaagaattttatttttaatcttaaataatggatttttggctttacaacataataaattggatgaatgtttgagtatatgtcaattagcattttcatgtaccccggaaattccaaagtatcaagtattaattattgcattaaaaattcaatgtttaataaaatataataaattggaagaagcaaccacggaatttaattttatgagaaaattaatacttcaattatatggcaatcatagaaattgtttaatattagtaaaattacaattatgtttttctctattatattttgtgaatggtaattttcaagaatgttatacaaattcaaaaaatgttgaaaagatattgacaccattgttaagtgaggtttctgaagatgattcaatacattggatgattattattgctttaagatttatcgctttatcatcactacaattaggaaattatgctcaatgtattgttgttggtgaaagaatgttaagatcaacaatcaaaagaaatacaaaacaagtgtatttggaatctatttgtagatacattattggtgaagcaacaattagatgcggtagatatgataatgcattaaaaatattagtaaattctataccagaattggatagtttcatgggcccaagtcataaatttactataaaattattaatgatggcaacaagatgtaagattattttgggttgtagagatttaatgtttccaccattaaatttacaagatagagaaacagaagttgacaatgattatcaattccaaattgtatatgatttattttgtattgaacaaaatgcttcaaatattaatgaagatgatatatttcttaataataacagaaataaatattattattatgatgagaaatttatggccaaatcaagaaattggacaaaattccctattttattaaaatatgatgatttattaattatggaaaaatctatttttgataaaaaaactgcaaaacacagagaagatgcattattaatgtgtagatcattaattaatcgaattatggcaaatataagaggtacaggaagtatattaaatacaaatcatgaatatattgaaaatgatcgacaaatatggtataatcgtttaatgtgggtattaaaacatgaaattattatatcaatattatccctttcacaaattgataatgttcgtttattatcttctattagatctatagctgttagttcaagtgcatcaccatttgttaaagatttaacatttggaagaagaattaaacaaaaaaatgatgataattattgttattcaaatcaaaatcctggaaatgaattaaatattgataatttatcacaaagaataattaataaaagaattactgattttactgattatggttatattgattactgtaatattaatacaaatatacaagaaaatattataagtaagaatattatagaaaatggtataggaagatcaaccaattatctaggtgcttcagtagttatgagtccaagacaaatgggccatatttcacaagaaaaagaaaatttttgggaattattaacatgtgaaccaactatgactattattgatatatgtgggcatgtatataaattattagtagaaaaaaaaatttcgagtgcttatgaatggtgtattgaaattatcagaaatgtatcagctggaaaatctgatacttatgaaattaatattgtattaaatttaatgcgtatattattatctaaatttcataaaaaatatcttattgcttcattatatccagatttattaacatcttcagaagataatgaatatgaaaagaataaaaataaatatggattaaacatatttcaaaattattacaataatcatcattttgataattataatgaaggaaattatattaatggtatacaaaataatgaacaaaatactaattatagaaataatgcattaagtaaaaattataatagagatgaaaatgcttcaaaatatggaaataataaaaatattattaacaaaaattacggatcatttcataactttaataatcaaaattattttgatagaaatgataagaatatgtcaagtattgattattcaatattaccacaatatagtacagaagttgctgctaatataatgttaccaatggaggaaggaattaaagttattgatattaataatgatatacgttggaaagatccatatagaaattataaatattttgattcacaattacaaaaaagtgcactattgtatttgccaaaagaagtatatgaaaagtaa

SEQ ID NO: 3938 - DNA, 378 bp, Cryptosporidium hominis
atgcaatccaattcagagtctgcaaaaggctcatcaacttttgatactaaccaatttgctatttgggagcttaatcaggcttcaacctcgccagtctctccttcatcaaactcaacggactctgaatatcaactaaatccattaaccccaacctctgatccttctgatcccaaattagaatttagatgttcttcttgcgaaatttacttgagaagaatgcatggacttgagaacgaactacagattcttactaataacatttattgccttttcaaaaccgctaaagaagaaatacagaggaaagacaaactaattcaagaaaaggatgaattgatcaaacagcttaggaaaacgaaaacgaaacaatacaacaaataa

SEQ ID NO: 3939 - DNA, 1137 bp, Cryptosporidium hominis
atgatttcagatacattaagaaataatgatcttaatttaaatgcagaaagtgacaagactgccttaactacaggaaactctaaccatctacttttgggaagtcaaatattggaaaaaaataattccaacttggtagaatcctcaatttgcaaaatctttcctgaagaagctgatagaaagattatattagaaaatgatataccattaattatgctatgtggattggggagtagtgggaagacttccataattaaagtattgtatgataaagtttctccacatgagacggtttctttatatccaacccaatcaggaagtattactttgattaagaatgagtcaaaaattcttccttgttttggaatcattgatttacctgggactgctcagatccaagattccctattgggggaagatatcttcagtaaagtttcatcattaatttttgttattgattcccaaaattatccttataatacggaaattttaagggctaaaagacttttccaaaatgctatccaagttaaacctggaatcacttttgaagttttccttcataaaactgacaatgagacattttcattggatggagcccacttggaatctcaaagagacatccatgaaaaaatctcaagctttattttccaacacggctttggaattgacattagataccactttacctctatatataatgactctcttttagaagctttcagcaaagtcacacagaaaatctcaccgtttactcaaatacttgagaaacttctagatgttctagttatttcttcttctttggaaaaggctttccttatggatatttattccagaacatttgttgccagcgactcatctcttttcgatcctattggattcgaactatgcgctgatatcctcaatgtcatttctgaaattaacgaaatatacgcaccaaattgttctttgtcaagaaactcatctggaatctcatgctccattaaccttgattctggacatcttcttcatattcaatcaatcgaccataatattgttcttgcatgcgttataagaaatgaacatgtcaaaaatgcatctctcattaatatcaatattgatattcttaaacaaactctcattcaaaaagttctttctccttaa

SEQ ID NO: 3940 - DNA, 885 bp, Cryptosporidium hominis
atggaggaccattcagaacagagtgctttacattctcccaaaaaaatgagaaagacgggaattaatgaagctaataaggtggtaggaggaacagtttgtgatggacacgaatttataggaactaataatcagagtgtgacgatagtgaatatattgagacaaggtatacaaagtaaggacaaaaatatgttggagaatgctctttctcataatgatattaaaataattagaggttcagtaagccaaatttctgatgggaattgtctggagctctttgaggagattatgaatagaatagaagataatccaatgaagcttttggagctttctaactggatttcagttctacttgaaggtatagcaagacaggtcgtagcttttaaaggggatcctgatcgaattttacttattttgaaccaaatggaaaggttgaatgaaattatttctatgaggctaagttataaccaagatttgataagtctccaatctactttggatatatttcagcatattattgaggaaaacaaacttatcacggaaatgtgtaataagatctcctctgagtctaataacgctttaatcacttaccaatttgaggcggatcaggaaaatgatgaaaatgatagctttgacaactatgaagatgaagatgaggatgacatcgatactgaccatgaggatgaaaatgaagatgacgatgatgaagatgatgatgacgaagttgacgataatggcaatgaagatgatgatgatgaggattacaacagcaagatacgcaaagtccgcaaaacaaaaggcgtaaaggatgaaagtgatgaaaatgatagcgatagtgaagagaatgatgatgataatgagtatgaagagagatcaaactccgaatag

SEQ ID NO: 3941 - DNA, 255 bp, Cryptosporidium hominis
atgtgttatcttggttcttcaactcatggaagatgttgttgctgcattcctttgggaatttctggaacaattacatctctcatcttgttggcatcaggaatcttcacaacatgccaattttcacaaactccaaatcaggaaattggtggtttaacttcatcagctttgtttacaggttgtcacacttttatcattcttatgcttttattgtggtccaggaggagcaggattcgcatattttgcaacacaatttag

SEQ ID NO: 3942 - DNA, 477 bp, Cryptosporidium hominis
atggagccaagtaggaaagaaaatacagaggagaccctggatgaaaataggcttaggataagaaagttatatgagaaaaaattacatgataggaaattaagaatatatgaggaagcattggaggaggcaatacgacgtgagaagatgaatgttagcgttattgtaaagtttggtgtgaaatttgaaacaaaatttggacaagaacttaaagtagttgggaatatagctgaactaggtaactggaatgttgacaatggattaacaatgaagtggactgaaggaagcttttggactgcaaatgttaagattattccaaatagtaagattgagaatatcgaatacaagtatgtgttaacaaacagctcatctaaagctcatgtttgggagccaggaaaaaatcactcggtacaaattagtagcgatacacttagagagctgcagcttacagatgcctggggaggaggtggcttgtattag

SEQ ID NO: 3943 - DNA, 978 bp, Cryptosporidium hominis
atgcaacagccacaacaaccaaatgatatgttccatacatcagtaggagatggagtaacagcaacttgggtagatcccgcacaaatgggacaagtaaacaataattgcttcccaaatcaagcgcatccatcatcaggatattatcgattggaagtagatcaagctccactcattacagttcctgtagtacaggagattcaaagaagagataaaattattgaggtacctcaaacaattattaaggataagatcttaccaaagatttatcatcaggaagttattcatgaagttccaaagcttgaagttgaggtacaagagaaggaggttgaagttccaaatgtaactgtagtagaaaaggtggttgatttagaacatattgttgggttcaatccaaaatacgtaccaacttgggaagttagggaagtaccaaaactcgttccaaaatttgttggtgaacaaaaagtcctttatattgaaatttctcaaattcaatatgttgataaagtaactgaaaaagaggttgttgtagatgttgttgataaggtagttccaaaagttgtcgaaattgaagagccaatagaagttatccgatataaatggaaagaagtttatgatgatataccagttgttaaatatgtacccaagtttgatgttgaggttgtatgccctgctccagttattgtgccttatgtgcagccagaaattaaggatctaccaccagttaaagttacagttggcccagatggtagagaaaccaatatggctcaggattacaatataccaaataataatgtagtttcttcaccaaattctatcccaaatatgaatgctaacttagctcatattaatgatatcaatagctcgcccttcccattaccagaaggaagccaaccagttgagccaagaatgccacaattcatgaaaggaaatatgccagtaaatgttagagtaatgcccccacatccaaataatcaatag

SEQ ID NO: 3944 - DNA, 321 bp, Cryptosporidium hominis
atggttgcagctttagaagaagtagtcaaacatattgagaacaattttggggatatattgaccttgtcagaaattgataatagttataaagataaaataattgcaaaggctacgctgggacttcagcaaaataaggataattttagcaaatttaatgaaaaaaagattgtaagtttagaaataagtcaaaatggtttccggattttagaagaggaagattcaaatttctacgaaactatcgagggatttttgtattcacaagttccagaaatatggataaagtattttgaaacaaaaatatcagaaaaactgcaagaataa

SEQ ID NO: 3945 - DNA, 474 bp, Cryptosporidium hominis
atggatcattattgcccatggtttggaaattgtattggatatttcaactataaattcttctttcttgcccttctttatggatgtgcctcacttacgtacatgatgtttagtcaaattaacactttgagcaatatttggagtgataaaaatgtaacctttggccacttatatcttgtttcgctgggaatctgtttcagtgcagtgctactcattatagtagttcccttcttcttatttcacgcatatattacctcaagaaatgaaacaacaatcgaattttgcgaaaaaagaagtaaagaaaaggtaagtttttacttcattttaataatcagccttttattgtgcattataattagggatttacatatgatcaaggaatatataaaaacatccaaagtgtatttggtgaaaatccgtttttatggcttgttccagtcggtttgccaccatcagatgggcttttcttcccaataa

SEQ ID NO: 3946 - DNA, 459 bp, Cryptosporidium hominis
atgagcgaacaatctaatgtacaagcagtgcaaccagaacaacaaacacaacagattgcaggagcacaagctcagattggaatgaatgcaggagtagcatctgcaggtgtaccatacagttccggcatgggccaaaatatggtattccaatctatggcaggaggaagtggttatttcttccctccaaatggctcagccccaatgagtatgggaagtggagcatttgcaagtgtcggaatgccaggaatgtatgaactcgacccaaatatgctttcaggtggctattctgctccttatggctccgctatgggaagtagcttctatcttccaaatcaatatggaggttcaggaattatgacaatgccatatacttatgatccttatggcttgatcaacccaggaatcattcctccagttgcaacaaagatagctaagaagaagagatcaggatgctgctaa

SEQ ID NO: 3947 - DNA, 339 bp, Cryptosporidium hominis
atgcccaagttcagaaagtttgtggtcgagtctttaagtttgttatctatggttttactagttcatttaaatggcgtaaaatctcagatttatggctcagctaaggatgttcttagccaaataaacactaataactatccaaatttctctgatctcacaaattatccatattatttaccagaaaaggcaattattgggtatgactctccatctttaaaggaaaatatatacaaagttgacgagtatcataataagagggatttagatcctagtcattataaggaatttcagagacagaaggaagagtttagcgaaatagaaaagacaagaagaaggtaa

SEQ ID NO: 3948 - DNA, 921 bp, Cryptosporidium hominis
atgaaggaaatacaagatgaatcaaaaatgtggtctggaacacgtaataatgattttgaaatatcaccagaaataaaagaacaaagtcaaactttgagccagcaaaaacattcaaaaagagttaagaactgtctgacttacttgttagttgcagcttttacaactattgctctgattttaatctttgtaatttttgataaaaatggaagaaatcctatccaggtttatttccaaggtattttcccctcaaaagctggtgaaagagagatattcaatccaagcttacagaaagtagctgatgggcatagctttatggagaagagtgtgacttctgaatacgataatggttctgaaaagagtaataaaattgctcatacttatgattctgggcattatcaatcagtattagaattatatatgaataggctctttgttactcctttgaataagatgagtttaaccgtcccaattaatgatcaagtacttagaagttatcaagttgaagccattgattattcaatagatgacgaaatgattttgtatctttctttagaacaccagcttaaaataaataatgaaactatggttttatatgataaatccatgaatgttattagccattttccaacttatgaagatgaagaaggtaccgaaaagaagaatatcaaacaaggatcaaataaccagaaaagtagtaatacagaaaataagctcagaaacaatgagaataaaagacatttacagcaattacaacagcatgaatactataactatacatctacatcggaatggaatcataagccagaagttgttaataatattattccaacatattatcctaggaatccttatgttccaccatatggaaatccttattattttgccccaaatatactagttccttatgtatatatttattaa

SEQ ID NO: 3949 - DNA, 84 bp, Cryptosporidium hominis
agagaaagtctccttatttattaccataataaaaattacaccaagctgctcagagattctccaaagagagctaaaccctctata

SEQ ID NO: 3950 - DNA, 492 bp, Cryptosporidium hominis
atgtattctaataataggaggaaatctggcagaaagtgcgtcttagatacggatatttccccgattttggagaaaaggatcagagcaaaaattgttcaagacagaatcgatttaaaaggcttaatcgatgagcatattggcaagagaaaagcaatagagaatgagtttaatgctgatcctaaaagtttgaatgacgaatctctgagagagaggatccaaattctagagaaggttagggctaatttattaagaattatttcaataaagagcgaggcttattaccggcttctaaacaaggcggataatgttagacgagatgaaatcagtaagtacgtagaaattgaaaacagaaagaacaaagagagggaaaatgacattctagcagagaatctaaaggatttttcatctaatgtcaaagatttggttgataagattaaccaatacaaagaagattatgaaaaaaagaacgaaacaattcttcaagatccataa

SEQ ID NO: 3951 - DNA, 1155 bp, Cryptosporidium hominis
atgagtgcattaaggcttgatagttttgagtttgaagaaaatgaagagcaaagaaagggtagttttgatggttctaattctctacatactgattggtcactttcttcggatggcgtatctttactgcataaaagtacgggtgtgcatattacgcatgaaggtacaagaggtcttgagtcagactatggtcttggagatatttacgtatcatttggagattttgaggttaatccaactccattaggtcatggaagaagttcggtggtatttagtgcgatccataaattatcaggtaaaattgtggctataaaagatatttatgtaggagatattttgcatcaatctcaactctctgcagaaatacattcctggaggttgactagctactgccctttattagtacaattttttggtgcttttattaagcctaacaaaagtgtagtatgtttagttatggaatacatggagttcggtactttaagtgacatactttataaaaatttgaatagaaatcttcaaagtaatgagaccccggaaggagtcaatgaaaactttctgaaatttatctcaatacaaatggtagatggacttgcatatcttcatcagaataatagaatacacagggatgtaaaattaaataacattcttattaatcaggatggagcagtaaaaattagtgattttggaatttcaaagctcattgaccaaaatactactaaagaccataataaaaatgtatccacttttgttggaacccagatatacatgagtcctgaaagattacaaggtaaatcatactctttttctagtgatatctggagccttggaatttgtatttatgaactagctgtgggaactcaccccttcaaaaaccttagtctgttcgacatggtttatattttatgtgaagacaatacagaaaatggagaaccactaccatttctggagaaaataataaaaagatgtcctttgccagaacacttacgcaaaaatccagacttttatgcctttctcaagggatgcctagagctagaccctttaaaacgtctcactgcactccaactccaagacctcaaatggctaaattttggcacctgcaatcgctatgaattcttagcttggttacagcaaattcaaaaaatagatagcaattag

SEQ ID NO: 3952 - DNA, 768 bp, Cryptosporidium hominis
atggattcgaaaaaaataaagaaactaaacaagaaaaaagcaaaaggaactcttgtaaacacctctatttatgtccaagggcttccaaaagatataacttttgaagagatgaaatatttttttggtaggggaggtatcataaaaattgacccaacaactttgtctccaaagattaaattatacaatgatgagcttaccaaagaattttctggaaatgctttagttgtttataaatatgaacaaagcattgaattagctctcaagtacctaaatgaaaccgaaattagacctggatttaaagtcaaaattgaaaaggcaatattcaacaagtcatccaaaccaaatattgctccattatctgaaactgaaattaataaaaaaagaaagcaactaaaagcagcagaaatggaagaggaaaggcttttatcttggagtaacgagcaacattcactaaatagcaacattgcttccagaatagttgttcttagaccaatgtattctagaaaagaagctgaaacgtaccctgagggggatgaattctacagtgaactagaaatagaagttcaggaagaggtaaccaaatattgtgaggtagtaagtgttacatgtattcctagacatccacagggaattgtttgtgtcaaattaaaatcccaacatgatgctgaaattgttatcgatatttttaatcaaagatacttcgatggcagacaaattgaagcccacatgtacgacggaagcaccgacttcaaggcatcttgtatttag

SEQ ID NO: 3953 - DNA, 882 bp, Cryptosporidium hominis
atggaaatgaaggaattgctgaaggtgtgtgtttatattgtactttctctagaacttgttgggaagttatacttaatctctgcaggaaatattttaaaaacgggccatgaagaacctgttattagaagtacagatactcattgggatgacgagcataggttggaaaagccaactatatcggatcaaagtattgacgcaattgatttagatcacatttttgatattgaggagtctgatagctctcctgaagatattaaaaaaggtaacttcttacttgaatggcttagagaaatgaagactttcataccgtcaaaccactttgtgttcgatcttaattctaaagctgatgagtacttctattttgaactagatgaagtcaatccatacatcctgcttggttactattgtactgacgatacccaaggtagaatccatgtcacaatcaataacccagaatcaaaaagaatttatagtagacacggctgtgaaggagtatacaataataaacctccagaagatggttcagatgatgggaaaatggaccatcgtattaagggaacttatactgtcattctttctaatcaccgttggcatgatactattcgtatatctctacttgtaggtaatgactcaaaaaaaaataaagctgtcgacaaaaaaaatgtagataaactgacttcaaagctagaaaatgttgataatatcttaagtataataaacacagaaaaccaatataattgggctgccacaaaaaccaacttaaatatgatttataatgcagacagtcaacttgtcttttatactgccattcaaatcatttctataattcttgcctcagctatccaaatttactatcttaaaactatcttaaccggtaaataa

SEQ ID NO: 3954 - DNA, 1971 bp, Cryptosporidium hominis
atgaaacaaaacaatcgaagagagtttgacccaaaagaatataaaatctttactattgatccaccaactgctaaagatttagatgatgcaatacatattaaatatgatagtgaattaatgatttatgaagttggagtccatattgccgatgtatattactatatgttaagacataaagaattactttcaagtacaacaaaagagctttgtacaagtgtataccttccccatactaattttccaatgcttccacgtgtattttctagtaatttatgctctcttcttccaaaccaaaaaaggccaacattatctgtaattatcaaggttaaccaaaaaggagaagtcataggagagccagaatttgttcatggaattataacatctactggaaagttttcttatgatgatgttgatcaattatttgaaattgttgaccaaattgataaaaaaaacaaaaagtctaaattgaacacattaaattattgccaagatagtagaatttcccaaattatgaaaaggtctacagtaaaagaaaataatagaataaatattgtacatgatttattgcttttaaggaccttaactagcattattcaaaactccaaagatagaagtgactcaatcaagttattcaatgttgatccttgttttaattttaagagtgaatttcctattaatattactgagccatttaatttagttaaaagtaatgattcatttagctctatgaaatatagctcaattattccaaatatagagttaaaatttgatatccaaagtccaataccaaattccttagaaaaaatttctccaaagagaatcacagtttgttataatcactctatatcccattctttaatagaagaattaatgctactagctaatagagtaactgctgagttcactgttaagaacagaccagaatcaggttgtattatcagaatacatgatgaaattgcaaatacaaaactatatcagttgattacttatttaagaaaacatggatttaagcatatatttgaggataatatcaatagagaaaatattgttaatggcttatataaactttataaggattatgggcctctttattactgtactgtaagtgaaatgcttcgagatatttttagtagagccagatatatggtttataataaagatgcgcgagattcaaatgtctcaactaatcactttgctttaaatatgaacttatatacacattttacttctccaatacgtagagctgctgatatcctagtacaccaaatggtatatgatattttggataatatggaaaagagccccgacaagaaaaacaaacaaaattcaaagaatagtaataatcaattaatcttctcggaaaatgatcatgctattatttgcgataactcaaacataaaatcaaatgcaaacaaaaatatgcagagagactcaaataatatctttttttcccaactaatttcaaaaattcatgtcactattccaagtattgcttgtattcacaagatcaatgctagtaatctaaaagttcattctgtattgctttatcccacagacttttatcaattattccttattagctcagattcttttgctaaaaacaattctctggtctccttattaaaattgaatccatcattacctatcaatattaaatctaaaggcaataaaatcgaactttattggaaattcaatcaggatcgcttaaaagatacattaaaaaagctaaaaacttcaaaaaaattgaatatcctattgtacttggatatgattaataatcgaatgaataatcaatttcaacacaaactaacttttaaccaagaaaataaactgattgtgcaaactattggaatatggtcatacctcccagttaatcttatccccactacaaccctacctcctaagttcattgttgtcccaatgaatccgctaagtcattacttttatgaacaaatctcaaattttaactag

SEQ ID NO: 3955 - DNA, 513 bp, Cryptosporidium hominis
atggctgtgaatcccgcatttattccaaaggaattaacagatgtttatgcgcctggaaattatgactcaaattgcagtattttagcatgtaacttccctacaggaacaagcgtagaagaatgctcaaatttcatgtcatggattggtccagtggtttttgtagaggaaggtccctctctgcaaagggaagctaattttattgtagtttattccaagccagagtttgctgtcaaggctacccaggaagaattagtatttaatgagggttgcagggtctattgcagatttgtggatgcgaaacctacagtatggggaaatatcacaaacttttttcagggaatagaccaacaatatggagcgtcagaccaaatttctaactttatcaacgatactgcaggtatgttttctttatttgaaaatgcctatttaggactagtactggttttagtgctcgaattagcgttcaaattgaaattgggagtggtaagtctaaatacaaaatacctccattaa

SEQ ID NO: 3956 - DNA, 666 bp, Cryptosporidium hominis
atggacttggattctattatatctaaaaaaagtgaacttaatgaagaaaaaaaatgttcttccttgtcagaaaaggttcagttttgccagagcaaaatgttaaagttagaagaagaattgaacactcaagaagaaagcaataaagaagatgaaaataggtatccttatagaagaatgataatttctaatatttatactttgttaggagagctagcatctcaagcacaatccagaatggctaagaggctcgaagctcagtatattaagagtcaaaagtttaaaactagggaaagaaaaagtaatcttagctcagaatcagctggaatagattattctaggttggatcagaaaagctataattcatatgatggaagtctagatcatgatcaggatcttgacccaggaatggatgaattaaccccagaaatggagaaagccgctcaagaattgcttaatcattttacttctgacttggatgctttaagagagtctcaaaaccagttacacgagatttcatctctgatgagctttttctcatcaaaaatacaggaacaatcagagatttgttcaacaatattagcagatgcaaatgatgcagttgactatctggatgaatcaaaaatttacttagaaaagatggaagaagcatatggagccagagggtaa

SEQ ID NO: 3957 - DNA, 1365 bp, Cryptosporidium hominis
atgagaagaagctcatttagtagatccccttctccggaagtgagaagtccaatggattcacttaaaaaaaagtcaatttctgaagtcacatctctaactaaagcagatcaagaaaacaagattctaattgttgaaataaaagaacagaaaaatgcattaattaaagaacccgaattagcatctagccaagataacttggaatgtaaagacgaaataaagcaagaaattatgaaaaaggataataaaacagaacagaatattgattttgaggaaattgatgatatctttgcgtcagatactgaagaatctaaatcaaaatatattaaaccatcagggaatccaggttacaacaaaagattagaatgtgacgatgatgatggatattacgtgagttatattggagaaattattggaaacaggtacaaagtctccagtaatagcactggtaaaggtatgtttagcagtgttgttaaatgtgttgatatggaaactcaaaatgaagtagctatcaagattattagaattaacgatatgatgagaagtactggagagaaagagtattcatttgttaaaaaattcaaaggagctccaaatattgtccaggttcaaggaacatttatgcatcaaaaccacctttgtatagtctttgagtggttacatggatccttgaagaattgtatccaccatttttccaaacataacattagaaaaacacaagatttggccttccaaatattccagggattgaaaataattcacgagaagggcttggtacatgcggaccttaagccagaaaatatcttaatagactctgaaaggaaaaccataagaattagtgattttggaagtatgcactttacaacagatgcctcccctgcatgttacttagttagtagattctatagagctccagaaattattttgggttgtatatcttatggacagcctattgacatttggagtattggttgtgtactttatgagtgttttactggagatattatgttcaaaggaagaacaaataatgatatgatcaagctaattatggaatacagaggaaactttccgaaaaggcttcttaaccaaggagtgttcacaaaatcccatttttctgagtgtctgacgcaattcaaatggatcaacacacagggaatgttacaaattattaagaattatactgcaaacaaaaatatatacaatagtttaatggattcagtaaaatcctctaatattgtttactctgaaactgagcaaactcttattcggagactctccaatcttattgagaaatgtcttattattgaccctaaaaagagaatctctgcaaaggaagctctggaacattccttttttcaacttaaatag

SEQ ID NO: 3958 - DNA, 1992 bp, Cryptosporidium hominis
atggttgagtgctacaagaaagaattagatttggagaatgacgaaaaatttagcattgaaaatttgattttatccatttcaaaaagttcaaacaattcttttttgattcgtcaaatacttttgataatgaattgtatagataagaccgatcctgaggtcagaagaacaattaaaacccttgctttgaactgtcttaagttcactccttttgatgattctgtagaactcttagaatcagaactaattccacttgagtcaataataagatcatctgagggaggtgagtgggtggcttactttttacatagatcggtaatttgggcttccttaaagctattggatgattgtctagataataatgaattcttagaagcaatccagacaataattgaggagattttgaaccctgttgaagaaaatggacaaggatcaaaagctgagttgaatatgtataagatgaaggatttaattgattgtctggattctcaaatagaaattaaagagtcagatgagtcattttctgcatatcagcttctaaaagagatagttgaaagtagatggatgaggattctatttatccttgaagcagcaatgtctattctaacccacgcagaaattaaagattcaacttattggacagaggatatcttaaagcaatcaactaagttctttgtgagacactcacaagaccagggaataccccagatcttacttgccagatctactgcactaattactattatccaggaaagatcttcgccttatgcatacttgagtgatgatgaaaatgataatttactttttttcatccaaggtctggaaaatgctttgcatgagctctctcaagatgtatctaatgaatctaacagtacaaatcaatcagttattctctatgtttcagtactttgtgaggtatacgtatcatcaattgtagatattattatgattagacaaatgaaaaaaaaaggaactttagagttgaattctgaaattcttaagggtttacatagtatttgggaacttgcatgtggttcagccatctctacccacagactttcttccatttcactcagaggagttgcaaggattctactttgtttaagagaaagtactaaagaaactcaattttcgattgaaattctgatttcattactttatttaacttatatgacaggtactttggatgagttcgatgttttagtggaacctcagaatttcatttctttaagtccaagaagagttcttacacaggaccaaatctcaatttcagaaatattttcagttgacttgttaattaacatacaaaatttggtaaaatcttctggagataaacaaatgttgatatatttgttttcgacttatattactttaagttttcaacatcttaagaactttacaatctctctttacggtttattggagaggatttgcgaaagagttggaattacagcttggagttctgggtattcaaaaaatgcaaacaaacttcttatttttggtatcttacttctaagacaaggaactgagtatttgggagagagtaaagacgattctgaactagtatcttattcgaatatatatggtcttttgtcactctatttgctttatttaagattcccaaaacatattaagaaactggacttgaaaagaattttgtctcatatttattgctacttaaaagtggatcttaaggatcaggatattcaaagtttggaatggaacatttttaggatgattctaaaggattctgaattttcagatagtttttacgatcttgaccaaaatcaatcatttaagaacttaaacgaacccaagttggatatgaactttatattgaaaattaatgatgaaaatatcagaagaatgtgtttagaatttgaagagagtgttaggagtaaagaagaatctaaggttattgaattgaataagattggaaacagaggtagaagaaaagaaaatactagaaatgaaaatataaatttttgtaattaa

SEQ ID NO: 3959 - DNA, 624 bp, Cryptosporidium hominis
atggaaaaaatactgaaagagttccagaaggggattcttgacaaatctgaggcaatttctgagttgggaaaggttttaaatggagatgactcgagggaaattttgatcaatactttggcttttgctctcaaagacttcaatttgaaagagcaaaatatttactctacttttagtttattacttgagtttggatttaacatagagaaagagagtgggcacccttttaatggtttctcaaagacaatattagaagatttattgctacaaggaatattagctaaagacttgggagtccgagtgaatgcacttgagggtataaatttaatgataaaattgttaggaactgaatatatgacaaagtttggattggagctgagctatatttgtcaggcattatatcaaatagttttgaaagataaatcaatgatggttaagagtatagcaatttcaactttggggttgatttctaatggcaaggattatttaatgaaaatgattatgaattctcaaagccaaactgagaggctgaagtctttaagttgccttcaattaagatttttggatgatgttgaagttaataatcttctttccagtatgctggatgaaaagaacaaagttagatga

SEQ ID NO: 3960 - DNA, 546 bp, Cryptosporidium hominis
atgcgtattttgggacttattcttcaggtatatcaaattgaagagagaaaaagaggatttgaacactgttttgaattcaaggtacttttactcacttcaatgggatcaaaggtatttgttagagtgcattctatgggatctcacaattcagatttaagaatgtgtgagagggttaacaataaattgaagagagcattcataaattctggagagctagactatagggatttcatcattcttattgaaaatactgaattttattcatttgaaagatctacaaatctatactacttcaatgcaaaagtaccttattcaattttcacaaccccatacgctttgggagaaaagcatttttccagcaattccaccagaagaatgctttcaaaagtgataatggatctcagttttcatactaaatgtaatattcccaaactatttgatgaccatattctggatgagaattcccctcaactacctatttgcactaactgcgaaaacaagctttcagagtgtaaatgcataactgaagaattaataatgctttaa

SEQ ID NO: 3961 - DNA, 918 bp, Cryptosporidium hominis
atgcttggaagcaatgcttcgtcaagtttgcaatcattgactgataatcctcaatttactggattaagaaatatacgtcagagcaaatcaatttatccagaaagtatattgattagtagcaataatattaatagtggcagcgcaagtaacagctgttcaaatagtattattaatggggtaaatggttctaataatgggaatgggttgtctagctccgttcaaacttcaaggattaaaagcgatgacttatttgtttcaccgggttctgggaagttgctagataaatattggcgttcttcaactgaattatggaatgatctagagtgtggtattgtatatcctgattattcttcaaatataggaaggaactctctaacttcttctcaggtttcatctggacaatatactcatccttttggattattttcggtttcaattcatccagtattaacaagaaaaaatgctcttgcgattttttatagtttcataccttatattattggtcttgtattatttgtttggctccttattggtgatagctttgtacctgcatatgctctaataatgatgcttgcatcctcagcttcgagcgaattttttcttaaaaatattttcaagagcccgagaccaccaaattctgcttgtgcatcttatggaatgccttctagccactgcgtaacttcatattctattctaatatggctattactagaaaacattaatgctcttggttttgtttctggtttcttattcaaactttctattatattaattactgcccccgtaccatgggccagatggtatgttgaagatcacactattccacaatgcatatggggttgcatagtcggtatttttatcggtatttttgcatttattatgcggatacaatttttctactctaatttggtattttag

SEQ ID NO: 3962 - DNA, 864 bp, Cryptosporidium hominis
atgaatgattttaaagagattcagagaaaaataactcccaataatataggaatatcaagaaaccttacttccagaggtcttaaagtgaatatagatttgctagcaaattcaaaagaatctctagggagaaaaacaattatgagctcaaataatataataaagaaaaattcatggaaaagtataaatgaaagcgaggagagagatatagaagaatttttgaagagccaatgggacatgttttcaataagttgtgggacaattttgaatgaatcaggagtttgcagcaattcattttgcaagtatagagataatgtcaggatggaatactccaagtgtgagtatacaaacacagagatagacaactggaagatttgccaatattgtcaaatggaaatgtttccgagtctttatttcatcaacgtaaagcgaccaaaatttgtagaattcttctttgactcatctattccaatttttttcccctcaagacaattaatttggccaacatctcttcattttctattagctcaatttttctcaaactattcagaagtcagagagtgcaaaacacatgaccaaatcattagacttgctaagaaaagacagaattctatttctattgatattcttcctaaccttgcaataattattttggcaatgaaagttttccaacattctgtattgcagcaactattgctttcattttcagaaaacgagttttttttactcagagaatattggataaaatatgatccaataataagattagttagttcagattctagagagagcctttcagatcttggagagaatcttattacaactctcgaagaactgaggaattatatacaaagaaataaaaattaa

SEQ ID NO: 3963 - DNA, 1032 bp, Cryptosporidium hominis
atggtggatttatttagggctgcgctactatttcctttatttttaataattatttgtatatccttcccttttactgaatgcgagagaatacatgagctcacaaaactcaaacaagagagcccaaatagtttgattaatttcaactttacaggatatcaacactttgtcttgatggatggaagagactatgacttggttatcctttatacaggaacgaaaaagtcctgtccatcatgtgtgacctctagtaataatttcgaggttgtagctaaaaattactacaaacaattaaacccaaatcagaaaatattttttggatatttatatgtggataaagtagagaatgtggttggaattcataagcttaggttccttccagcaataatttatattgaatctacaaagcaatttataacttcatctctttcatttagtagagaaagccagtggagaattccagaacaaaaagatatttctagcattgctatgatcaaatttttgaattctagaactggaaataactttgagattatcttaagctttgaagaaaaggttaagagagtctcaatgctcatatttttattaattgtatccattttatgcatatacaatattattatgttagcaagaaataaacctttcatcataatgatactagcaataattgcatgttcaatctcaatgtctggaatagtttacagcattcaacatggaaagtatcaatcaagagacttctttgttcaaaatccgagagtacagaatctacacgagggtatgctaatgtctatacttatgacattatcttcattattcctgtttcttactccttttgttattcacggaaaaatctttattttcaagcgtaagatcccaggctggtcagcactcatattgcttatttccttcattttttcggtactttgtatttatttcggctacaagatgaaagtctcgtggtatgcacctactttctatcctcctccgggatatctcaagggacccttactagtagacagaggcaattccttctaa

SEQ ID NO: 3964 - DNA, 312 bp, Cryptosporidium hominis
atgtctggtcgtggtaaaggaggtaagggtttaggaaagggaggtgccaagcgtcatcgtaaggttctccgtgataacatccaaggtatcacaaagccagccatccgtcgtctcgcacgtagaggtggtgttaaacgtatttccgccttgatctacgaggaagtcagaggtgtattgaaggcattcttagaaaccgtaattaaggatgctgttacctacactgagtatgccagacgtaagactgttactgctatggatgtagttcatgctcttaagagacaaggcaagactttatacggttttggtggttaa

SEQ ID NO: 3965 - DNA, 744 bp, Cryptosporidium hominis
atggcagaacatttagctcggatattgggcactgaagaggatcgtgtaaactgtccgttctactggaaaattggagcgtgccgtcatggagatcagtgtagtaggaatcattataaacccactagtagtccaacagtgattattaggcatatttacgagaatagtccagtagctttggcaattgctgaaggccaagaggttagtgataagcttgcagatgaagaatctgacaaggttgaggttttttatgaggaaatatttaaggaattatcaaaatatggtgagattttagaattattgatttgcgataatattggggatcatatgattgggaacgtatacattcgtttttcaacagaagaatatgcaaaaactgcattgctcaatttgagaggaaagttgtatgctggtaaacctattaatatcgagctttcacctgttagcgattttaaggaagctcgttgcagacagtatatagatggttgttgcaatagaggaggatattgcaactttatgcatataaagcacgtaccaaggtgcgtaaaggataagatatttgatcaaatgtattctgaacatccagaatatctccacaggaaaacaaattcatgtgggaaatctagtgctagagatgacggaaaaggctcagaatcatcaagacctcgcaaattccaaagacaatcatcagaagaaaggaggctaatgatagagtcatggaataaacgtagggaaaacaactcttag

SEQ ID NO: 3966 - DNA, 708 bp, Cryptosporidium hominis
atgcaggataacatggaaatatttcgaaataaatatcacattagatgtaggtacacaaaattaacttactgcacatgtacaaagggaaataaaaatttttactacactggagatcatgagctcaaatctatgtttgaaaagatcttcccttcatctcagatccacgaactactgaagcttcttgctgatagtaatgaagcaagaattggcttgagatccagtactcagaaatataagcgcattgaaagaatagtagcaagggagagagaagaattcaacatacaatatgagaaagaaaagaagagaattcgagagctgaattctgagaaaatgtcagatattgtagtttcaaaaaattctgagtgttcagaagatagtgaacaaactgcattacttgaggatgttgataaacaagggtctggaaatgaattggatgaatctacagccactcagtgctgtgccgaagagtgttctgacaaagaaaactatgagaatattcttagatgtaatgtttgtcataagtctttccacacttggtgttgttcaccaaaaatgtctgaatatattaaaaatagtttcccttgggcttgctctgaatgcatcagttgtactgtatgtaagaaaagtgatagaccaagtattcaggttttctggcgatgtttgcagccgctgtttccatacatcatgtttaaatccaaagcttcataa

SEQ ID NO: 3967 - DNA, 1647 bp, Cryptosporidium hominis
atgatagatgcattttttgtatttaacaaaactgggctagttctctggtcatatagaagcgaagatgcagggccagaggagatcttagaacaggttctacaaggcttagtagagcatattttcttagaagaaaggttgacacaaaaatactatgatcagggaccttatagagtaaactggagcacaatcaatgaacatcagattattttggctattgtttatcaaaatgcatactcagctgtttcttcaagcacatattttgagacactgctcacaatggcaagaaagaaaataataaagataattacggaaaatctgaactctgtcgaggacgatacctactttgagggcttcagagaccaatttgttgagatgatagatttttgtgatacaaatttgatgaaaaaagggggaagtaaggctgaccttagttcttttgacagcttggatgaaaaaaattcttattctaagagtaaaagttacgatgacaaaactaaagattccgaagataccaattctcagacttccaaatttaagaaggtaagtaggcaatggggcaatcaaaaagttacaaagaagaatatggaaatgcttgattactcaaagaggagtggtaactcggaagagagccaatccaaacttagtttctacgaaagaaatgaagatgaggttagtgatgatgagatggaggaaatcaatcaagagaagaaagctgtatcatactggagtaattttctttcaacccaatttggaattttaaataataatactactttaacagcagaaatggttgagaagccgcttcagaaacttaagagccaactagttgagaagaatgtggcatctgaaatagcccaagatattattgactcagtatcaaatgctttggttggggtaaagactcaagggggcttttctaagctagacacaattttgctaaacagtttgagagatgcaattaccaaaatcctctcacctaagaagcccacagatgttctctctgatgctttaaaggcaaagcaacatagtcaagtctactctattgttttccttggagtgaatggagtgggaaaatctacaaacctggctaaagtttgctatttgctcaagaacaaaggaaatttaaatgtattgattgttgcatgcgacacatttagggcaggagcaatcgaacagctaaaaacccatgcaaattgtttgggagttcaactttatgagaaaggatatggtaaagatgcggccatggtcgccaaagatgcgatttcttatgctaaagataaaggatttgacgtcgttctaattgatactgctgggagaatgcaagacaatgttcctttgatgaaatcactggccaaattagtgcaagttaataatccaaacctagttttatttgttggggaagctcttgttgggaatgatgctgttcatcaacttcaagttttcaacaaataccttgttgaatttggggacaggcccattgacggaattattctcacaaaatttgacactgtggatgataaagttggcgctgctttatcaatggtttacacaactggacaaccagttgtttttgttggaactggccaaaaatactttaatcttaagacattatcagttccttcagttgtaaatgctcttcttaaataa

SEQ ID NO: 3968 - DNA, 1503 bp, Cryptosporidium hominis
atggagtcgaatggagtaaatttaaataataaagaatggaccaaaaaaaggtggatgccctggattacgatggtttttacatcgtttttcacagtaagtgggggatcttatggttctgaggtagttcttccagtaattgggttgcgaaactttactttaattcagatatgtatttgtattttttacgcaatacccctgattttgatctatgaaatgctaaacaaatcgtttccaccaaattcaggcccaaaaagctggtgtgaaagtatttttgacccatttttagctgtatttctggatgtactttatatttttatggaaataggtatgctttcttcctacgtaggtgtagcatcagcatatatacactctttttcaaggtctttaaaatatggtgcattttctactagtggccaactatctatctcagtaattgttttcctattaataattgcagtttctttactccttacatactttgatgactatattatttggatgtttagtgttgtggttgcacctttaataataatggtaattattactttttattcaatcccaataaattcatggagaacaatcccagatttacctaagagaaaccagttagactggatcactggacttcaatatgtgatgtggctaaattgtggttatgagaggtctttctctcctaattcaaaagcttcaaagggtcaattaacaaatgatagggactttaagttttgcttgattgcaaacgcaattctcgtttctattctttatatacttcctctttggtgtggatgttgtattctgaatcactttaacagagatggaagatcgtttcagcttggtaatttcttcactttttcaggattcttggtgggaggaaattttttgtcgagcatgattactatttctgcttgcttctcatctattgggtgcattacttcagatgtgggattagtttcgcaatttcttatcgcacaatggtacagaatcaaaaacattaaaaattatagaccatcatttcttcaagaaactctcgtttctcttggaattgtcatgttctgttcttttttaacattattaattaaccaggagcattttgctgcaggtgcatccactctttatgggttcattaccttaattactgtaattgcatatctcaaatttctttggactattgactcaaaagagacttttccggactcagaattccctcttattaataatgaaaatattactaagccttcacatattctattactaaactcactatactacagtaagctacctctcagaattaagcaaattatacattcaacgtttgcaattccagctatatttttcaccctcgttatattttttactacctcttccatactatatttgactattattttactagcactctttgctacccctatatttgttccaaaatataacaaagatcataatattaaaaacctaagaatcgaatcatcaaaaaagttcccaggagttttgaacttactatag

SEQ ID NO: 3969 - DNA, 633 bp, Cryptosporidium hominis
atggaaatgttgaatggtgtgctaccatgggacattagagttattggttactgcgaggttagacctgactttagtgctcgctttgattgtgaatatagactttataaatatttctttcctttaaaccatgaaagaacaaagatatccaagtttccaaaaatcccaccagagcaagtcccactaatggacattgctgcaaaacagttcttaggaactcatgattatagaaggttctgtaaaatggacttgaagaatcgaaaaaatcaaacttatattcgtactatttatgaatttgatatcaattttgtagatgagaacaggacgtttgctgttgcaacaatcaaaggatctgcttttttatggcatcaagtcaggctaatgatgggtattctttttgaaattggacaacagaaatttaacccggaagttattacacaaatgttaacagatgtggagcagaagaacattgcagaactttctttccaaatggccactgaacttggtttggtactatgggactgtgtgtttaaagaatatgatatccaatgcaatataaattcaatgaaaacatttctggatgaatcagagtctttaaaactcaaagcatcactatacagttttattgggtcgtag

SEQ ID NO: 3970 - DNA, 6513 bp, Cryptosporidium hominis
atgtttattaaaaagttcattttaatatttcttattttaatatttttaatatgtcagacccagggaattagtaatgatttaagttcattaacatcaaattcagtctcaaaatatatgacgaaggaagagtttttgggtgaatgtaaaagagaattgccgaaatttagatcaaatcttacagaaacgcaagtttattttttgtgtttaaaggcacttaagtcttcattagataaaatatacaatagcccagtggggaagcttttaaattcagattcagttcccgaagatgttgttgaacacaagacagagaatgataatgttgaaggatatcgtaaactacttgatgatgtttcaaatattttctctagtgatgtttattttgatgaagatctattggaagcagataatggtttattttcaaattcaatacaaacattactagagattgataagaaggaattaaaaagaaaggaattcatggaaaagaaggtaaaagaaattcaaaatactgaagaaagacttagagaagagtacaaagaaaagttaaaaaaaaaatatcctgaagcttaccatcctttagctctagaaatcttttcaacaatttcaaaagaagatattgaaacttggatgaatcttcctttgaagctgaagctacctgtgattaattactacttcttgttagttgctacaatgggacgatcttctgaaaaaggagacaggcataaaatatttacaaaagcaattatatctacaataataagcaaaaatgaaataaagattcctaagtatatgactttacaagatataaggtacgagatttgtaagtttggagtgattcataagtcagggtgtaaaatagttcctttctctactttgctttctttgcctagacactcttttgaaatttggaaatcctttggtttagttcttcaatttgagtttttgatcgctatgacttatagtatagaacacgaaatgaattttgatgattgtgacaaagaaatatttaagatcacaaatgagaaaaagcttagaaaagaagaagaaagtaaaattcgagtttatctctcacatttatttccagaggaagattctcttccattgaaacattttaaaagtgtcttaaaatatcttctagatatagcagtgaatgatgaaccatccaagttagacgatcaaagtcagtcatattccgtagttagttcaaattttgctcaagagaagaatgatcaaacttcttcaattcaagtaaaacaatcagaaaggattaatgtggagccggccaaagaaacaaaaatagaaaatgaagttaaggataaaattgaacatcaagagaaaaaggttactggcttttttgatgaattaaaggatctttctacaatagatagtgaaaaggttgagattaataaaaatgaatatagttctaaagaataccccactctaaataatgacactgataatattatagaagttgcaaagttagaagaaataaggaaaataaaaaataaaagtattaaagaaagcactgcaggtgataggaatgaagaagagtttaatttgatatccttagtgaattctgaaaccaaggcaagagacgcaaaaattactatggaatcagaaaaaagtaatggcttaaaaaagattgatgtagaagggcttaatagcctccctcctaatgagtataatccatattcaaatgtcggtattggatctggcttgatgaatgaaggagaagatgactcttttccagaagaggaagaaaatcctgaattgggagatgagtctaatgatgatttagaaggacaagaaaacattgagaatcatgaaggtgataagattgaaaatgaggataatggtgaaaataccaatgccgaagagtttggagatgagggaaagaaggacgacttggatactaaacaagatgaattggatgaaggagactctagaaatggagaagatcctggccttaacggagagggagaagatgaaaatgatgataaggatgatacagatggtaatgaccaggatggaaacaatgaaaaagatactccagatggtgaggacataggaggtacagatcaagaagattctgattctggaggagaggcaaaaggaacagattacgacgaagaagaaggtaaggaattagattctgattctggagatggagaaagtggaggtggagaagacaatgatgaagtagatgacggagaatctaattcaggggatggtgatcatggcgaagatgacggaggagataatgatgaaggagaagacggagaatctaattctggagatgggggagaaagtggaggcggagaaaacaatgttgaaagagagaacgaagaatctatttcaggagatggaggttttggaggagatgatggaggagatggtggaggagataaggatgaagaaggtggggatctagattctgattcaggagatggcggaaatgatggaggagataaagataaagaggttggggacttagattctgatttggaagatggcggagatgatgtagaaggcgggggaggtggaggggaaggcgatttagattctggaggaggtggtggcgattatatgggcgacagcgataaagattcagatttaggagatggggccgaagttggtggaggtggagacgaaggagaagatggtggtttagattctggagggggtgggttggacaattttgaaggtaacacaggagattcatactctgaaagtaatgatgcttttggaacaggaggtggagattacagaaaagatagtgacgaagactcagatcttggctcaggagaaggagttggaagttttggaacgaaaggtaggggcgaaggagacgattttgatagagacttagattctaattccatggaaactggtggaattagtggaaattttggagggggaaatacaaatcaaaatgatttagagtactccaaaggacataccggatctggaagtttaggaaataacgaatttgagggggatcctttatccggaagtggagatgaaggcggatttgacgattcttactcttccttagtgggcaacaatgataaggggggaggatttggaaaagaagtacctagttttgatatagaaacaggagataatttaaattcaggagactcgaatccatttggaaattctagctttaaaagtttaaacaatgtggataatgatgactttgaaacagattcagaaaaaggtattgatttacctatagaagagaaaattagaaatgatattgatgatttagattcaactctcaatggcctaaacacacctattgatagctttgataattctggaataggctcaaaagaaaatttagaattggatggtattttagctagcaagaatgaatttaacgataatgatgatatggaaattgcggaaggattgcctacagtagatcaactcagcttgggaattgaagaagggaatgagacaggagggcctactatagttagcgagctagattttggtaatggggaagaagtaaaggatttagacaaaagtctcgaagaattaaacgccagtcttggaggttcaactgtagataacacaggagttgatgacttatttggaaatagaattaataaatcgaatagccttggaataaatgaaaatgaaattcttggaggcgaagattttggaaatggagtcaaattcggtcaaggggatactagtaatggagttgacagcctgttgaatgaaatccaagaaggaaataatttgaatattgaaaataactacgacgagttaaataatattcaaggaaccgaagcaatagatattcaaccaaataatattgacagtttccttgattcattatcaatatctggcaataaaggggatgttgaaattgaaataaatcctatgagtggtgataataaaaatattaattctgaattggaattacttaataacgtaggaactcctagttttgatattgacaagaacccgagtctttttgagatggataataacgcgtatggaaggataaatgaggcagaaatagataaagatctggataaagctgccagaaatttacaaattcctaataatgaaattaattttggcctaaatgatagctttgaaattcaaaataaaaatttggaaacagaattggaggaattaacaaagttgggcgatccaggtactgaagctccaggaattaattcggattttcctgataattcagttttaccagaaacagtgggtttaaatgatgaattcaaggcattggaagatttgagtgctgatggaccattagaagaggatgaattcgagtttttagagagaatgctgaatgaaaaaggagctaatagaaattttgagtttgctagtacagtggattcagaggaatttacagatgaagaggagtttgacgaattaaatttacctaatggccaacttagtgttggatatgggcttaattcacaaattccattatcaacacaaagccagactcaaagcgaaaaagacgaactttctgttgtgccaaatgaccaattaagtcttgtaattaatagtattcctggagcggacgataactcagcaatagaaataaatgaagctttgattagagatccaggtactctagactcaatttacgaagatcttaatgatattattaatgatttaaatcaaaatacttcttttcctgtagaggtgccaaaaattgatcaaatagatacaataaagacaaattcagatcaagctattgataataatataagtaatatttattcagattttattgaaaatgacaaagaatcaacaaatattaatacaattgatggaagtttggatattgcattaactggaaacagtggggggattatagatgatgggaatgattacattggtgattttgatatttttataggagaaaataatattccagatcaaggtttcgaagatgactttggattggaaaggctatttaaagaaggtaatatagataaacaatttgaccagagtgaatttataccttttttggatgaattagaaaaggaaaatagtctttctaaaaataaaaaagcttcaaataatattgatgatattgaattggctgataatgatttatttggactaaattctggagttgaaactaaaagtgataaaacactttctataggagatccagaagagtcaataagtacattatttgaaaacgacggtcaatataactcggctgtagaaaatgacaaaaacctagatatatttgaaattcagtcaggaaccaccgttaaagatggagaaattgagaatgttcttaatgatttgataaatgatggaggaataaacactgattcatctttagatgagtttggtttgggttttgataaaatgattgaaaacaatcaagaaaagaattttcaaaatgatgatatgtacatatctaccttatttgaagaaccagaaattaaccttgggaagaatgatattgaaaataacttacttattttagattttgaggagaaaaataaaccaagtagtttagagccactttcagaagatgataatttataccttgatgaactatttaaaattgaagaaaagaaaaacgaagattttggcattaataacattttattagatcaaattaccaataatgaaaaagcccaagcgaatgatgaggaaatcaacttgagtgaaattgaatggctcaatgaaagagatattgaaaacgataaaaaaatagacgaaacaaatttaattatagaagatttgcataggttatttgaaatgaatgggaatagtgagggaaatttaatatttcaggatgaatttgttttaaatgataacaaaattaagagttcaaatagcttggaagatgctgatgatttgaaacttgacgagttttttgacagagaggtagatttaaaccagtataatacaaacagcatgacttctactaataagaggaaaaagagaaagaaaaggaaaaaaatcaagaaaaaaaataagaataaaaaggaaagaggaatttcttctacagaagaatacgaaatttcatctgaagagcttgattttctttttgatcaatccgacaaggattcagatcaaactcttaataagctgataactgactccactgatgatgcagaatttgttgattccgacgacttcttgaatatggggaatattcaggtaaaaaaatcaacattagtcagggttaataagctagattctgatgatatacattataaaaaaaaatctcggttagtgtcggatgacgaggatattgaaacaaacaaacaaaaatctatgaaaaagatgctcagaggagcgtcctctgaggaatataaagaaccaaggccaacgaatagatcaattgggacaatattagaaaaacaaaaaggagggtctgagaaagaatggattatgtcgtttgccccgaaacttagaccaggaagaatgcagcgtcgtagagatctttttaacgaggaggaaattgaagaggcaataaaagaggctagattagcataa

SEQ ID NO: 3971 - DNA, 2448 bp, Cryptosporidium hominis
atgaaactgtatatattatttttaattttagtactaaatattttgctctttgggcttccaatagtagttgagtctagcagctttatactgcctggaagccatgatataaaccaacgtaaaggtaggtcatccagtgcaagttctgtagattcaaaaagatcaggaaatgaaaaaaacggattttttggtaaattattcggtttttttggaagaaagaatgggggaaaaaaagacaaggtttccaaagaatcagatttgagttttgagaagaacgactatagcgctcaagtagataattatgaagttgattctgaatcctccaaaagtaacatcactgttaagaaacatagcgatttttcaccttcttcctcaaatgaatcttctgagccagaacaaaacatcgatgaatctcaacaagagaaagaaattgtttcagaagaatcaaagtctgctccagcaccggtagttaagcattttgccgatgaaagtagctctgatccaaaatctgaatcaatgaaagatggatttatttctatttatgatgaagattacgacgaaatgctgaataagggagcgataccaggcattgtttcagaagaatctggaaggagcagcgaatatgtaggcggggaagagcaaaaaacagcagttcctgaacaatcagaagtagaggaatcaaatagggaagatgttttgagattttctgactctcaaattcttggagaaaaatctttacaagagggcttgcctgaaagtgttgatctaaatgaaggatctagatctagtattgctaaagatgttgaaaatgaagattcagcgaagcataaaccaagtacggtttctaacgaagaaaatcattatgatgcatcatatgaatctaatttggaggagatggagaagtcagtttctgaatacagagctaaatttagtgaagatttctccgatgagcttccacacgaaacatatgatagattgttaaatgacgctttgaagcatgaggctagtatgccatctaataatcaggaaaaaattaaaagtgatggcgagtattccggttctgagcattcagaaaaaagtaaaacttcacaaaaggaagaagtttctggaatcgagaagtatttggaagatacagatgatagcaaggaagggagtgaagcgagtactgcagacttagaagatagaacaaccatcactctggatgagggaatgccaaagtattcttctcaagaagctgctacagaggaggaaccagaagatttggaagacttcttggctaatactgatatcaaggttccagaggcttctgaactatcaatcaaaaacgatatgagtgctagagttccatcagaatatattagagaaaagagtaggtcagcgaccgaacctcttcagatgcaagaacaagagtcagggtcggagaaagagtttgaacaagaatctgagggagaacctaaacaagatacagagaaagagtctgagcgagaatttgatgagtctaaagaaacttccagtaagattgaagagagtagtaaacctttagaaaaatcaacaggaattatctcgagaatctcagatagttttaagaactttataagttcctttggaggttctaagaaagagtcagaagtgactaataaagaagaatctgtatcggtacctgctgaagagtcgcaaaaagaagccgttgaaagttcagtaaaagaagaaagcgaaaaacctgaggagttgccagataataataaaagcagagtaaagatgttgattgagcattttgaaaaggaaaatgcacgtaacgtccctgctccaattggagttccaagaaacagacttgggcttaggaacacagaaggaagtagtgaaaagaaaaacattgatagcttgattaatttctttgagaatgaagacataaaggcaaaagaggaggcaaacaaatataaggaaagcataaagaagcgtgaaatgagtagaacagagggttctgttcgtcaattagaacaaattcctgaagaggatttggaagaagttcaattggaaagtattaatgttgaggaaagcccagagtcaggagaggaaagagagggagagataatgagagcaataaatggtgaacagccatcagagatatctagagttgattcagaaggttcagactttacccagacctcaaattttgatgagccacaagaggaattgagcgtaccaatagctattcctaatatatatgaagaaggtaaattagcaggaggacttgcttgggcattgggagttggaaagtatgtttgcaattcaaaaagcgctttttcaagtctgatctctccaacactctccaagaatttactagtttctgctcctagccaagaacaaatggcaaagttgttacgactttctggaggcgaggcatcagatataataatggatctcgtatcatctgttctagctcaaaattga

SEQ ID NO: 3972 - DNA, 3123 bp, Cryptosporidium hominis
atgagtctacgtatcttattaagctttttattgtttatcaaacttggggttttttcactaacaataaatacaagtccaaaaccaaacccctttacagttgatttggataaaatagttgaaaaaggtaaacataacaaaaggtcaccacagaatgccgttattcttccaactccaagtaaattttcaaataaaaatcccgaattaactgaacatgatttgaggcaggctttggtctgttcaaaaaaaacaactgatggtttagaaatttgcagattaaaacgtatttctaatttggataatgcttcaatttctagtgcatctactttcaattacgagtttgagataccagaaggtacggcaaaagaaagtttgaaatttaaaaataataaagaattaaataaaggaaatgatgaaaatattagcgagatgcttgaagaagcaataaataatatggataatcagaggcgatctacattggatgaacttgaaagaatcaagaaacctcataaagtacctagagaaatgaatgatgatgaccgtgagaaagtacgaaataaaaattcaaatgaagtttcctttttaactggtattaaattgattgatgaaataattagcccccagaaaaaggcttcatttagcaaagatgaggaagaagaaagccaggaacagactcccaaaattccacccattccaaaatctgattccaaaaatttacctaaaccttctaaagataccaatgaggaagtttctcaaacaactgatgaaagaattccatcaacaccaactgctaaaatggttcccccaaagcctgctgttagacgaatttttcaagcacctggtgctcagggaattatccaaccaactacttctcggagaaatgtaaaaaaatctcttgaggaaaagcaggataacaaaaaaaaaacagttgaaaaagaaaaaaagaataaaaagtttaaaatcaaaaatgtgtttggtcccaatatatttaagttgtttaaaaaaaaagaacaaaagccagcacgtaaaataattattagtaggccaataatgcgaactttgacggaagaaactgatgatgaaaaaattaaaggggcaggagctactgatagaacaaaaacaatctcaaatactgggggaaaggtactaaatcctcttaaaggcgaagaaagtgacgaagaaaaaaaaactagacgtgatccttttaagagatctaaaagtcaactatctaatataatggaaacagaagaagagaatcaaatggtaacaaacattaacaagaaaaaaagtcctagtttaaagtccttggatagcactcaaaaacaagactctgaacaggagtcggatagagtaactccgagaccacgatcttcacaaggtgaagctagaagaagagggaatgcttctgaatcagaaaggagatctctatcatcagcttcacgtagtgttagtagaataagcataccagaaagtattccaagtgtaggttcagataatgtattttttgactcagatgatccaagtaattcattgataattgatttaaaagatgatatgctcccagaaatagaacataaaaaaaaatactcacaagaattcagagattcggcagacatagattccttttccgattctgaattttctaattcgtatcctagcgtatcatttcaagataatttagagggggtgagcactgggctagctaagcagcaaaataaacgagtttacgaaaaattcgttccgggaagaggatttgataaaattctgcagaaaaagctcattaatacttatgattcaggcgatgagtttgttgaaaattcagtatttagtaggatgaagaacaaagttaagagacgacataatgaagacaaaaggaaaaaagagagatcaaaaggaatcccatcaagggtaattaccaaagaagatactaaaaaattcggtggttcaatacaaagagagtctcaagttgtaaacccatttgaaatttcacctggaattagcgatatcgtaggagaaaattctggatcgatgatattgagtgaaggggcaggttcttcctctaagaattcaggaatcaaagctgaaagtatagagccagtaaatgatgaagaagaggttgatagagatagcataagaaagattatagataaatatagagatcttgaaataaaaaaaagtgatatagaatcaggttcagagtcttcgaatggttttgatatgggaaatcaactagtgccgatacaaaaccctttggaagttattacttataatgatgagttaaaagaactaaaatatgcaagagatgattttttcagaaataagttccttcaagggctagctgaagaagctaaaaaggaagaaagtgataagttatcttctcagattgcagaaaaggaggcacttcttcaagaactggaaaaaatttcgcttgaattagataagaaaaggaatcaactcaatgaggaggaagagccgacaaatgaaggatccagatcagaagatcaagaaataggaacagatgagccagaaaactcagttgaacccgagaaaacggataaaaaaaatgcgtcaactgagatggatactatgaaatatgaagaacccatttatccagagggaagtttaaaactagacgaagatgcagtaattttgggagcagaaaggaaagaaagcaacaaaggaattgttgttttggatccagaaaatgctaattatgaaatttattttgacaataaaactggacaagaagaagatggtctggttcccagtatggaatattataatgaagaagaaggactaatgccaattcagcaatcagataaattagctgatagtgaaggtttagctccagttggagggtttgccaaaattcaagagttacaagctttcgaggaaaatgatagatctttgctccctccacctgaagaaagtaatatcccatttgaagagatttatttaacaaaacatcctgaattgcttaatactgatactgtaggcaatgtgagcagagaaaaggcaattaaaaaggcttttggaagggaacaaacaaaaggtggagtacttaggaaaagagagtttgaaaacttcgatttatctaacgatgcaattgaaagactgaaaaggtaa

SEQ ID NO: 3973 - DNA, 237 bp, Cryptosporidium hominis
atgaaaatggttgttgggaaaaaggtcgatttttcagaatctactgatgcttcaggtagtaatggagaagaaagtgaattcgcagtcgaagtaggtttggccagacttaatgctattaaggcagcagaaagaaaagagagcagagaaaaacaagcaagaagtggccacatacactatgctccttatgtgcctagaagagcagagtctgctactaataaaaatgttgtagcaaggtaa

SEQ ID NO: 3974 - DNA, 1038 bp, Cryptosporidium hominis
atgttttcccaatcacttttaatgtgccataaaaactttgttcgtatcaatgaagttatccaagaccaatcatacccattttctatatttgttatggaatatttacctcattcttgtatgaaatggaactctgagacccaatgttatcaggcacctacaattaactcaaatatggaagatgttaataaagtctatacatatcacggctcaaagcttattttttcacaagttctggagggagtaaaataccttcactcgaaaggtgtatcaggaatttactttactcccgagtcgattaaattatcacattctttgggtgaaacatatattgataagaacggaaaagagctaactcaattattattgactagttcaacaaaaagcaacaataaggtcgagaattttgtaaaaaataaatccaaaattgaagttgatccggaacttttcgaatactggaagccagccaaatcagtaaatatttcaaatgaatttgactctgctgctgttagccatattaaacacattattcaagaaaaaaaatctttacctgctgatattcaaaatgattcatttttatttaatcccataccttttgttgaagaccttcgaaatttctataatacagaacttgtacagaataatattcgatctgaaaaaggaaaacttatggtgaagatgagttctccatttaaaggtatggctacaaatcataaagatattcttttttcaggtatgtttattaaattagccaaaagttttcgaaacatatttttagggaataaatggctttcaccacctgagttatttagcaggatgtttaacagtttaaattcagaggttgacttgagaaaatgtgatgtttggaacttgggagtacttttacattgtttgttagttggagtaccccctactctagtcaataagaatgtaataattgataaaaaaatccctaaagaagtaaaagtcttattactatctttattgaaggtcgatcctcttctcagaccttctatttttgatattgaacaatacatttga

SEQ ID NO: 3975 - DNA, 972 bp, Cryptosporidium hominis
atggctgtagttgcaagaagaagcgtgaaactttctcctaagaacccaacaaaggtcaaatctacaggcacaaataaaaagaagttgcaagtttcaagaggaaggtcaaaaacacgggttaattctgaaattaagcatcatagtggaagccctcacccaacaagatgccttagaggagtttctacaagagcaacattcaagagatctccttctcccaggaaagattggccatttgatgaagcaatactctatcctccacatccaagaattggatctcctgttacaaaagtgagatctagatcatctaacccatttttatcaaatcccaaatcgaaaaaaaacgtaaagatgaacagttgttctgctaagccaatagcttcacaatctcctgctttgaaaaagtataatcaccattctggttcaccaactcatcaccttcatccaacaagatgccttagaggagtttctacaagagcaacattcaagagatctccttctcctaggaaagactgggcatttgacgaggcaatactatatcctcctcatccaagaaccgggttgccaaaaagccctaaaattaagaccagaacattaagtaataccaagaaagctatggactccgcaaaagagcaaaaaaagacgccgatacgagccatcagaagtgcttccaacaaaagcatcagccctagcaaatcaaagaagtcacccataaaatctattagcaagaaagtaggtccaatattgaagaaaaattgtaaggaaaaagtcatacatcatacagcaaatcaattaaataaggataacaaagtttgcaaatttgacattaagactgaaagcattgcaactgttttagatggagaagaagagtatattcaaagcccagtaacctcaatgcatgtcggatggggaggaaatctcttgaattattactattggaataacaagattgcaggtatagtaagaaatcattaa

SEQ ID NO: 3976 - DNA, 3420 bp, Cryptosporidium hominis
atgatgaaggttaattttaggttttcaccgataattttgttattggctattttaggaatagcatctgctcttgacagtgttcagctttcggaaatacttgctgttaatcagggaccaactttcccttataaagaaatgatgtttaatgtaggaggagttgagcaaagagctttatttgttccagaaggaacaaatgacgaatgcattaaagccgccgaagttaggtgcgatgctctcgaaaaacagggtattccttgcataatatataaattaatttctcttgattttgaatatagtggccaagatgagatgaaagatttagaacttattccaaaaggatcaaaatacaacttaacaataaaggttgatgcaaacctagaggatattacttcaaacgaggaagagtacaagaagatgataccagagattgagaaacaaatcagaggatctaacgttggtgcaaagtttgtgtttttgatttctaggcaaggtggaggaaagttcatctacacaggaaatggaggtatttctaaattagagagaggcacttctcattatgcatatctttataatgccaagacagataagaatgtagatatgctttcaggagcagatttaagaagtatcgaacgtgctagacagttatttatagaatatttaggtggaatggatgcgggaaagttgaatgagcgtcagttagctgagctggcagccagattaagagcattagactccgttttaaatagtgatggcagctgtaaggaatgtattaagctaaaaaagagttgctctcattgctcaaactttgtcagttcaaaaagaagtagggaatactatggtctggccaagaaatctcgtaaatatgatgtgtcaatcgaaaccaggattagcaaacatatcaaaaagggagcttatgcatcgctatttgtgatgagtaatgtaaatgatagcagaatcccaagctttaatcaatcaattaggatcggttctatgggaaatgttaagtcatcggttgcagttccatacaacttgggggtgaactgccaaggtctttctgaacaagatttggttattgtcagaaggatgatttcactttttaatgcatacttcgaaaatgtcaaattaagaagcgattacgatgaactttgtatagctgtaagtcagatgtccaagatgttctctgataagtctagaaagcctgtaagcccatactctgttgagacttgcgcagcagcaactgctttatctttaggaaacttttatccatcatttatgtcagagacaggcggacttgacccagtaactgaaaacagtttgattatcttctgctcagctgttttgcaccaagaacctttgggacttgtggacagcctttctcctgtttactctccaagcggagctttggtttctccaaccggaggtaagctagacgcagcgattttgttagttaagagtagatcagaagaggcagtcattacatctttactagagggaagctcatgttcattacaggatctgtttaatgccggatggaagtttgataagaagctcaagatttgggttagaggtaacaataataggattcctttaccgataatggtaagatatggtttaacagaagatggaaaattagcagcattctcattagagggtagagatgcttatttatactcgaaaggggcagatgtactcaagacagaccccatttatactccaacttattcttccttgataggagaccgttgtctttccccatcgaatattgaaaatctaaagaatgtaagtaaagtgtacgagcacgagactttagttgaactaaatgaagccaaaaagaatgttgaacttgcagccttgaattccagggctgcctctaagactgcagctgaagctgtaacgaaatacgaagaggcaattgaaaacgagaagaaggccatggaactagcaaagatagccactgaattcaagaactatcacgatgctaagttaagagccagccaaagggcagctgaattagcaaggcttgaggaaaaactcattgatgcaagcgagaaaagagctcatgcagccaatattagcgcaaaggctttaatggatgcatcagaagcagaagccagaagaagggaagcatctgataaagcaaagcttgcggcagagagggctactgagcacataaaagccgctttagatattcaaaagcaacttaagttacaattgaaaaatgaagccaaacttagtgcctcatatgagtctgccgttattacagaagatagactaagaatcgctcataatgaggcccaggaatcactggagaagattattatgaacgaacgcgaaattaataatagttttgaaaaagatatgaaattattgcttgaagaagaggagagattaagaaagtgtattgaagaatattctagcagacgtattgcactcttgagtaaattagaagagatgaatactgcattgacaggaaaagtagaagagtctaaacgaattagagatcagctccgtgaagaggccaagcttaagcaaaaaaaggttgaggcagaacgcgcagagctcggaaaactctctgatttgatggtttctcaatctgctgaggttactgcggtttcagtatcaataaaggagtcagagatactccttaaagagatggaattaattgctgaacaaaaggcaaaggaggcagaagaagctagacaaaactttgttcagatgagcataaagattaaggaactccatgttatttatgaaaccttgacaattaaacttcagagtttatcttcaaaccagaaaaacctcgaggaatcagttaaaactgcggagcaagatcttaagagcatgttagagagactttctgaagttgagacgaaaatttctaagttagaagaatccagagctgctcttgatgagaggtcaaaggaagcaattgaattactcgcaaaggagacacaacttatctcaaagattgaggaaatcaataaaaaacgttcagtacgtaaacaagagttggaaaaattattaaaagagcaggctgacgtaaaatccgaaatttcagctctattggttgctagaaactctgcgttgagcataattagaaagactttaaacgatatagaggaagctagggctgctagccaagggaaaacagctgaaatgaggtctcagtacaagagaacttcaatgctcgctgaggagtctatgaaatcagttgaaagtcttaaggaggaggtttgtaaggcattatcagaagaggagcttaagagcaaagaccttcaagaaaagattaaatgtgtgaatagaatggatttagaggtcaaaaaagctgaggatgaattatccaggttctctcagaccccggcaccggaagttcctttgacacctcagataccaagaatcagatgtgaggtaatcgaataa

SEQ ID NO: 3977 - DNA, 2532 bp, Cryptosporidium hominis
atgtatttgtttattagaatttatcttaatttttgtaattctatgaggttgaggattatagctgggaaacattttgttaatgcgcaattattcttgaaatatagatcttcaatactaatattggttttggtttttttagcaattttggatggatcgttctcaggagaagaaagtcctctagatattaatgaattgaaccgaaatgttgtcttcacagagaattttttcttgaagcatattccaggagctataaaaggtgaggaagaagagcgagagggattaaatgaaatagacagggagagtgatgtaagtttgattccgttagatgatggtattgctcctgatttagattctataacaatgactcgcgccacagccgataaaaaacaccacgaagacaaggaaaaaggcaagaaagtaatgcacacacatgacgacgagttatcattaatagatcaggatgaagatgatgatgaaggtaaatcagatagggaacaggaaaagttagatgatttagatcctgggtctgaggaacagaagaaaatactgaaatatgataatgaaatgaagaaaaaattgcttaaattaagacgcaaacacaagtataaagacattccatttgggcctcaagcacctcaccttgcaatggtggatatatttggagtaacaggagatgataaggcagatcctttgatggaaatgtatggtttggaatctcggtatgatggtgagagggatctaaaagattatgaagacttgtataaatctgtaacgagccccacaaaatttacagaaagaacgatttggggttatgaccgggaaggaaatccaattacttcaaagaaaatatggttagaacaaaaagtggaagggaaagttattacggaggctggcgataaacaaaataggaatcgcatggattatatatttcctcaaaaggtttattctacagacgggttcctagatgagtttgggacatttggagtaaagtcactattggataagtttagatttaagcaagaaaacaaatttaaagaaaaaaaaaagaaaaagtcacctaacaaagtaaaggaacctgaaattattaaaaaggagatttggaataattcagggagagttgctggacctgataaacatattggctggcaggtaacacgaagagcaatagacgtagctgcaagagataagatgataaaagacttagaaggcgtagaagatcttaatggagtcattaatgctatgaatacaaacaatccagataaacaaaggagagatgcagagaaagtattttgggattattactctaaaaaaaagcaaaaagaacacgaaaatagaaagcaaatatatggcgtggaattttcgataccaaaactttcgcttgatattaatttttcaccggcaaaaactctttttggttggagagaggttctttttgatcaggcaatggaaagtattggcaagtatgatccaagagcaagccagaggtacgattctttactagggagcgatctagtaaaaggtattccaccaagtagaattattgcagatatgtctagtgaagctattagaagaccaaaaacacaccatttgtttccaaatcccattaaaggctttagaaacatgttttgtaaaaggctagagaagaaatatagagaatatgtagccgatatattgcagttaagagctgaagatagtacttataacgaacttatggatttggctaataaatatgaagctaggcaagactggctaagccaatttgaaaattcatggatatttattccccaaggtaaagcagttcctgaaaatattattgagaataatgaagcaaattccaaggctgaagatgactatgagaaggaattactttcattagaattagatactatacctgcaagcgaaatggaaatatttatgcgccagcatctaaatggagatgttctatttgttgatgatagtgaagcagaggatgcaaaagaagcaatgttccgtaaaataattcgcaaaacagcagaatataatgaaaatcagccatataaactacctcacagaccgagagcatcgagattacttcctgtaaatgatgggtatagcccaaccgaagctattaaacaaaaagaaagcttgaatagtaaaactactatagtaaaacaaggaaaagtcgtagtagatcctttagaaaaaaagaaaatcaggctcttggaaaaagaagaaagaaagagagtcggagcagggttagatagagaagaagttagaagagatcttgaaagaaagattattcagggctctgaattagatttaagtgaccatggagcgtcgtttaaaagtagaaatcaaaagctcacagaaaacagttccgatgggtttggaatccctgaaaatgagtatatttacaaagatgagggtagaggcccaaggaatattaaggagccattttctacaaacgcagtttcctcttcgaaagccccttataaaagaaatccaatacaaaaaacagcttttgataattatacaactaggaatgagacataa

SEQ ID NO: 3978 - DNA, 348 bp, Cryptosporidium hominis
atgcgtagacgtcgaggaactagctctggatatcaaagccatggcaatagaatgtcattgaggccgcttgggagttcaggaggaaatggtgcagttggaggcgtggaacaagttggtatgggaaattcaggtttaacaattgaaaacccatatgcagatggcaatgaatcaaaccagggcaatgaaacaaaccaagataatggaccaaaccagagcaatgaaccaaaccaagacaatggaccaaatcaagacagcgaaacaaaccaagacaatggaccaaaccaagacaatgaaccaaaccaagacaatggaccaaatcaagacagtgaaaacaaaccaaggcaatga

SEQ ID NO: 3979 - DNA, 474 bp, Cryptosporidium hominis
atgcttttgaatatgaactcttcatcaaagtcattctgttttacttttttagttttgttttatctgcgtatttatttatatttatacgaagaaaaaatcgtctccagaacttatgcgatttctctagttaagctacaaacttcacctgatatagacggaattgatcggaacggtgctgttagtaatcctgagcagaaacatgatgagggagaccgggctggaaatggaggtgctattggcgtggttgacggaccccatggtcctgtaaaacatcgatgccctggtgcccccggtttcgtgatcctgtcggttgaagacattgacaaaaacaaaaataaaaaagagaaaggtcgtagaaaacgtcgccttcgtaaaagacacgagagttcagaacgggatggaaaaaagaattcttccgggcgtaaactggacactgattccggaaatgatgctgattgtgaaagtactgagtag

SEQ ID NO: 3980 - DNA, 819 bp, Cryptosporidium hominis
atgtgtacaaagcaatctttacttgtttttttcattatattaaatgtgtttctcaaactgtcagaaaacggcgaacgcttaagcttactatctgggttttctattattggactgagaagcgctggtggctgtggatttagaaaactactttgttttgggtctggcaattatggagaaggccggccgcatccgacccttgggccaactgttgatggcttgagaataagcgcccctatcattcccaaaactcaatccaccactccacctccatctccatttccacctccatctccatttccacctccatctccatctccgcctccatctccatctccgtctccatctccgcctccgcttccacctaaagtctgtgtaaaaaagggatcatctgggtgttctcaatcacaaatcccttcttttcccttatccctaccgtgtgaagaaactactgcaggtagtggcactggacaatgcactggaaatggacttaaagaaccttcaaatagggatggttgtcttggtgggaggccaagcaattctatttcaccctctctcccacgtgccccttcactttatgataatgtttcagatggcaatggaaatcctatggacggcgcgcctaaaaaaccacctttacctgccaattggagattgcctccaggtaatgagagccacaatagggctcatcaacaccatcaccaacaccatcaccaacaccatcatcatcatcatcatcatcatcatcaaaatggttgcagcgatagtggccgcccccctcaaaagcctcacttaccagatggttttagattaagaaagtaa

SEQ ID NO: 3981 - DNA, 546 bp, Cryptosporidium hominis
atgggtatattgatgtgtttgaaatccggtatttatttcctcgtatttcccgtgttattgactttttcctctaattctatcaatgtgttcgaatatactgctccttcaagcaactcagataaacttatgtttattcaattgagaagttcaaacgaaaataagattataatgccttctgatcacaaattaaggaattcgtcgggcgtctctagtagcaaatccaaaagtaattcttggaatggtttgacctcctcaaatgaatttcaagaggatcataaaccaccagaggtaccaaaaagaaccgtgtcgttaattccaggtagagatccttataaaaaaaggtctggaaaaccggatcagagtccacctcctcttcctccaagagatccctctattttccagagccataaagtcttggaaaaaagagtaacggagcaattgattgttctggatggcattttgaaggaaatagaaagtcttggttgtgtaaatattgattcctcagaacaaaatgagctgccagagaatgatgacgtgtttgattaa

SEQ ID NO: 3982 - DNA, 468 bp, Cryptosporidium hominis
atgtttcttataaacaataaaacgtttatttctattttttctattatgtttacattatttagtggaaatgatctaaactcaaaattaggcaaaatttcaatgatttctttaagggagtcgactcataaagctagatcaagtgttgtcgcagaaaatgcaatttcagaaaaggtcccaaagcttttcaatagcatatcccccttagaattggagttaagtgagaatcaagtagatccagcactacttcagaactcgaatacaagcagagcacttaattgttaccagagtttacctcaatacattttgataaaaggtatattaagtgagtattcatatttcctaaatatattctacaagttgaaatgtgagcataaacatgagtatcatgatggtacaaaatgcggcgatactctatttctgattgatctattagaaaataaagtagaaatattaagagagaatacttta

SEQ ID NO: 3983 - DNA, 642 bp, Cryptosporidium hominis
atgaaattcaattatacagaaagagaattagaagtattaaagttaagggatgagaaaatgaaaatgattattgaagaaattggttacattcatagagaatgtattgatgatctctttcaaggattgttttacataataataggtcaacaagtttctcagaaagctcaagttagtatttggaacaaagctaagacaaccctaaaaagcattgaccctgaaactatttccaattattctttggaggaaattaggaaagtaggtgtaagccttaaaaaagcaacatttattaagggtattgcagaaaaaatagttaataaagagataaacttaaatttacttcatgaaaaagatgatgaagaagtttgcgaagaactaactaaactaaatggaataggagtttggagcgcagaaatggcaatgatattttgtatgaataggaaaaacgtatttagcttttcagacactgcaataaaaagagcgctgaaaatgatctatggacataaagaaattactaaggaaatatttgaacattatagagaattgttttctccatattgttcaatagttagcctttatttgtgggaaatttctaatggagattacaaagataaactgtccaaaaagagtgtaaagttgtattaa

SEQ ID NO: 3984 - DNA, 237 bp, Cryptosporidium hominis
atgttgcattcaaatagaaagatgggtaataataggggtttaatttcacaattgtttttatcaacattcacttttacagtattaattttgtcaataaactatgtcggggatttattgaacatggggagcgaactagctcaactcaatcaattcgtagatgtttctcttttgaagctacaaagttcgagtagaggaagcggtggcgcgagcggggggggggggggggaaatgggttaa

SEQ ID NO: 3985 - DNA, 75 bp, Cryptosporidium hominis
atgcaacttacaagattttcaacatatatgaaattagtagaggtaagtttgcctattattatattaataaagtaa

SEQ ID NO: 3986 - DNA, 117 bp, Cryptosporidium hominis
atggcaacagcagttggatatcatgagcttgttaaaattgaaatgagtttcttttcggaaagtgttttagtaagtttctttacaatactaatctcaaataaaagatttgagaagata

SEQ ID NO: 3987 - DNA, 183 bp, Cryptosporidium hominis
atgaagtgtttctatgtgctccctttgaataacagtgatgtattttctgatcttggtatccggatttttgaaagtatatatgaacgtaaatcttgggtcccaaagcagatttcactgagtaacatttatgaaactgatttagactctgaggacttcaggcaaaatgtattaaattccataatt

SEQ ID NO: 3988 - DNA, 171 bp, Cryptosporidium hominis
atgaaacatattagctttgtaatattctcaccatctctccatgatttgtattcaatattattttttatattaaaaccgttcacacttcccccctttttcaagttatctttctttccaaagtatcccactattcaaaatgttacaagaaaaaaaaaaagaaaacactattga

SEQ ID NO: 3989 - DNA, 189 bp, Cryptosporidium hominis
atgaggggaaagaaaatatttggaatgtgcaacccgattttggatatagtgttaaaggcatttcctgatagaataaaagatttagggcttaagatagggtcaacgactcttggaaatgatgaggaagttttcaagttaattggagatataatttcaaacaatgaagatgccaattttgtagcaggagga

SEQ ID NO: 3990 - DNA, 86 bp, Cryptosporidium hominis
aaagttatgttttagaagtttgaaaaaaaaaggtcaatagtaaatgatcacaaaaaatagttatatctaatcataactttatataa

SEQ ID NO: 3991 - DNA, 309 bp, Cryptosporidium hominis
atggaaatgcatgttaaaacaggaaatgaacaattggaagaaactttaactaaatcagaagaaacattacatgctgaaaatagtatagaatcaagtatttcagaagaaactttgaattcttctttaaataatagtacaatagataaaagaaatgtaataaataataaaaagaaattagttctaaatgaacttaaagaaaaatggaaaaataaaaaagaaaggtatttatatgagttagacgatattattgatgatctttctgattactctttaaatgaatcattttctattgaaactaactataattaa

SEQ ID NO: 3992 - DNA, 210 bp, Cryptosporidium hominis
cagttttccaaagatatgtttcaagttattcaaagcaaggaaaatctataatttctacattttttcccacattaaccgcgccacaacagacttttttggcggttttgtggttatttttttagattaattgctcttctatatggggttaataatattaaccggccaaatttttattttttttttggacggggcacaaagctaattctttga

SEQ ID NO: 3993 - DNA, 301 bp, Cryptosporidium hominis
gctattttttccttcactatttccactttcatcttcattttcttcattattattctcctctagacttacgaaatcctgttcaaccccaaaatctcttgacaacttggatttatttctattaatttcaggaagagtaatatcctcaatccttccaatatttgaattatttccattacctttgaaaagaatattttcaaaattcaattcatcaatacttttgtttgataagtccaaaacaaaattttcagcatccaatgacaaaatcaattcaccattttcgatcattactactgctattact

SEQ ID NO: 3994 - DNA, 134 bp, Cryptosporidium hominis
tgtaccagcaatttttagttatttttattatcaatctttaggtaagtttaatttaatattaaaattaattaaaattttttttttttttaaataataatttaactgataattattatagtattttcatcatatga

SEQ ID NO: 3995 - DNA, 1647 bp, Cryptosporidium hominis
  misc_feature (983)..(983): n is a, c, g, or t
  misc_feature (1639)..(1639): n is a, c, g, or t
atgattttctgcggaacgctctcgctggttcgcaatagcacccggctgggtctggctgcgctggcatcctacggcgctgccatcgcgctgatcgccgtcatggcgccgtccgccaatctcctgctctggatcatgggcgcggcgatcccgctcgaagcctggttcgtcatgcgctcgcaaaaggcgcttgtcctctcaggcggcattgccgcggcggtgcttgccgtcctcctcggcgtgtccgtgtggatgggcggcaacgtcacgctgacggcattctccctgctggccgcgctcgcctacggggcaacgctgctggtccgttccgccggtgcgctggtggcgcgcggtcaggaagcgcgccgcgacgaccgtgtcgccgatctggagagcgccgttgacggcgtggtgatcgggcttggccgcgacggcatgatcacggcattgtcctgcaaggcgcaggagcatttcggcgtagcccgcagcctgctgatcggcacggcgctggtcgaccgtgtgcacgtttcggaccgcgtgcatttcctggcattcctgtcggatttgcgcagcgggacggccgccacggcggcggagataaagctgcgctgcgttgcaccgggcgatgcggcgaaaccggcgcataccgtgcgctttgccacctatcgcctttccggcgtgccgcagagccgggacaatggcttcgtcatcgtggcaacggatatttccggcgtcgttgccgaccgttttgcgctcgatgccgcgcgcacccaggttgagacagccgaggttaccaagggccgcttccttgcttcggtcagccatgagctgcgcaccccgctcaattccatcatcggcttttccgatgtgctgctgcaggaaattgtggcaagctgcccgatgcgcgccagcgcgaatatgtcgagctggtgcatcagtccggcacgcacctgctctccgttgtcaatgccatcctcgacgtatcncaagatcgaggccggaacctacccgatcatggccgagcccttcgccttcaaggatgcggtcaccatggtgcatgacatgatggcgcatcaggcctcgcagaagaacgtgacgctgtgcgaccgcgtcagccgcaacatcggcattgttgttgccgaccagcgcgccatccagcaggtgctgatcaacctggtgtccaatgcggtcaagttcaccgagagcggcggcgtggtgaccatcgacgccgggctgcatggcgacatgctggccttctccgtcagcgataccggcatcggcattgccgaggcggatcttctgacgctcggccagccgttccgccaggtgcagaacgattacacgcgcaggcacgaaggcaccggccttggccttgccaccgtcaagggcctgatcggcctgcatggcggccagatggacatccgcagccgtcccagtgagggcacggtgggtgaatgtcctcattccactcgccggtccgcggatcgagcccgttccgggcgaaccggtcaatatcgtcgaattccgggcccgacggcgacagtgaggaggttcgcatgcgccaagcccgcaatcggcctgacagccgaaagcgccgcgcccccaagcgcggccacatggcccgtatcgccatcggggcagncgggctga

SEQ ID NO: 3996 - DNA, 6513 bp, Cryptosporidium hominis
  misc_feature (1218)..(1218): n is a, c, g, or t
atggatatggatgttttgagacttaaaagagaatttaagaatctagatattgagtttattatacgagtactggcagtatataagtcttataatctcgctcaaaatgtacttaaatactataaagatttggagaatcaagatgatttatgtaataaagtacttggacctcttcctaatggtctttgttttactcattttcaaaataatattgtctcaagtgcaaatatagacacaattattccattccataatttatattaccttaaaagcaaaatatctaaagatagtgaaacttataaccgattattctcagatattgattttgactcttatatactgggaagagagggagagcaagaaggcgaaggagagcgagaaggcgaaagagaacgagaagaaggagaaggggagggaggagaaggagatgagtatgaagagggagaaggtgaagaaaaaaaagaaaaagtgagacatatggaaaatacaaagcttagaaaaagtactctaggaaatgagtctactggaggacaaacaatctctcctactctcacctttcctccaaatgcaattcctcccaattctaaccccacctccttaaacaaatcaatcgccaagtctatttcaaaatcattctctaaatcttcaatgaagtctttccaaaatggacttaaaagaaatcttgagaaaaaattattaaagaaaactggaattactacaagtggaaaatcatcatctaaaaaaagacttacaaaagaaaatattaataattctaattacgtgtataaaaatgttattggacaaataataccaatcaattcacaagaaaaattgttttgtcttatatcaaataatagaattgttaataaaactggtattcctttagagatttgttttattaatgaaaataatatacccatacaattatttgatatttctaatatatccatagaaaaagagttaactaatttaatattaaaccaagaagtaccaaatcatcattccaaatataaaaatatctatgatcaaaaacattttaaagaatctaaaaagttaaaattcaactcagaatatattactgataatcaattaaattataatgaaactaattcaatacctttatggttaaataatactgatattattaatacaatactcaattctatgtctcaaatttataatggagaaaatgatattcaagatatattatttgaatccttncccaattttacaaataacaataataataataataataatacaatacaaagaattaaacaaaaaagattctactattcttattttctacctaataatcatatgatgtcagttcctcaaattgctctattaaatgatcattgtaaagtaatatttagaccatgtattattggacttttggaaatatataatatacattgtcaatataataatgataatgatattgatcaaatgttatttgatcaagaaatatttcttaaatattcaaaattaatgaataattattatgatgaagatatacttaatgaagaatttcatcaaattacttatgaacttttaaaaatatttaaaacttcaaatggtgaatttattatggatttatattattctttctggaatcatttaattagtagatttactaatacaaataatcaaataatggatctttcatatcttcaatctagaggatggacacattcacctattattactaataaaaatcttaatacttctcaaacacatttttgtaatttatatccagatttcaagaattataaaaaatctgaaagtcattataaagaaaatgctatttactttcaatcttatatacaaacttatcaatctttatttccaggaaatacatgtattaaaaatattctattatatccaagcttttctttattaaatttatcaccagctattatggatattaaatttaaatcattaaatcaaaatcttcttcataaatgttcaaatgtattattcagatttaaaccaatgcatcattataatatatatcaactttctagtgaaatgaaattacaatataaagtcagaataatgttagaaactaattctttaagtgaatttcaattcaattcagaatcaagaaaaactgatcaattattatatacacaatggtcttctccaatggatttaaatttatcagatacagaaactccatttacattatactgtaataataactcaataattgacttaaaatgtacaataattgataaaacaaatcaaaatttaccgggtaagaataaatttggttctctttttggtaagatgcagaataacattattgctttaagcttaagtacttggtttattaacaaaacaaatcataacgtagtacctatttttgagaattcacctttcccttatattaacacaaaatcaggggcattctttttaaataattcaagttttcaagatgatggtgactataatgatcgtgatcgtgatcgtgatcatgaccgtgatcatgaccgtgatcatgatcatgatcatgatcattatcaaggaaacaataaaaaaggtaaagattctgagaaaagaatactaagcaagagaaaaaataagcttggagatgaagaaaaaatctttcttcttaataatagacataattatttaaaaatatacttcaactcttatgaaaatttaaaagaaaaatatggaaatattggtcaaagaattaatgatgaaatatatctcaaagaagaaaaagagattcttgaagttattaatagcagtgaagcaagtatttatagcagtggaagtggaaactatgataataataataataataataattcaaatattggattattagaaatacctccattaaatggaacctactcatttcctattgtaaatgaaggaaaagtctactttttcacagttaaaagtagtcctttattttactataatgatttctcttgttcaagtaaagttatcaccatttcacctcatattattatacaaaatactacagatgatcaatttatttggagttcatttatgtttccttcaggaaatgatgatcttgataaaattaatgcaatttcaagaattgatccaaatcatcttcttttaccaaattctgataatacagaaacaagaagatatttaggtccaattgaaaaagattttattacttcaataaaaattgataatccaatcaattctattttatctaataataacaataacaatatccataataatcatcatttacaaaatttaagatctaaatcaggatctaatatgattacggtaccttcttcttcaatatcaggatctggtatagaatcaaataattcaaataattcagaaaataataaaagtatgattaaagaccaaagtattcttttatatctaagtagatatgttgaatataaaacaaacaataatccaaaatggtcccaaccaatattaatttcatcagaaagtaatggaatattttatatgcatatacctaaaatgtatgaaaaccaaattcaagatggaataattgttaatccaaaaacttattgtattgaaattattgcatctaatggattatttattctaaaaattattaaagatttttctattggtaataaatgggatggagtaatttttactaattattgtgattatttatccaaaatctatatagaaacttatcattttgaacataattttgaagaaataaaaaagaaaagaaaactttctcttttatcatcaggatttttatcaattggaaataataaagtaacaaataataataataataataataataataatttcttatcagaaatgaatgatgatattactattagatatataattagtagtggacaaaaaaaaccaataaagatttcttggtcatctccttttgtatataactcaagaaactgtagattatatataattccaaatcaagaaacttcggaattcattgatcaaaataatattaataatattggttgttataataataattctggtatattagcttttgatatgaattttagatataatcaaaataatccatatcaatcaaaaagatatattctatcattaccagaatctgatataattaaactttgtacaatgtatccatatttaaatccaagatactttttaaataagaatgctaagaaaggaaatggtatgaataattatccaattgcaacaatttctattacagctagaaataatggactttatattgatattcttccaccaagaaatcattcatctttattattaaatttacttggtaataatattaatgataataatagtaataataatagtaataataataaaataataaataatgatgatgaaatcacgaaaaattcttttcaaaaagaaaaagtttatattgaagacttataccaaaaaagaatccatgaaattaacaaacttgttaataatgatgtttggtcactaatttatacatattatagaaaaattactttggatatttctcaaattggaatttcaataatttcagaaaatagacaagctgaaattgtatacgtggaattaagtacaatacaatttaaaaaacaagaaaagaatagaaatggaataatagaaagttataaatttgtaataggtaatttacaaattgataatcaatatatttcatcaaattcaaaattttatataaataattcaagtaaattctatggatcaccagaattagataatacagatttagaagatggtaataattcagaattagataattcaataattattggatcaaatggagtagcaccttatgtacttttagcaaacagatcaaataatgaaaaatcaatagataatatgaatccatttattacattaaaatggagttgttcaaatgcaaaatcacaatgggaaacaataatttacaattttgattgtgaattaagtgatttggaattaaattttgattttaatgtatatagaattttgaatgaatttatggaagaatgcagaaaaaattcaaataaacaatatatattagatattaaaagtattttatcaaaagatcaaatattagaaggtgttgaaccaaatatgacattttcaatagaaaagataaagattggagctttaaatttatatgtttggtgttcaattccattatcagaattgaattatattccagaatggtttagaattggacttagaattttgacagtatcaaatgctttagaattaagaggtgctccaataaaattagaatcacataatttggagaattcgattggtacaattcaaaatatagtaaatgctttttatgaatattatatggcagaactactttggagaattggtacagtattaggacatagttctttcgtaaatattccattagtaccattacaagttggtaagaatacattaaatatggcattttcaacaatttcaatggtaaattcaaatataacaagtttactttcaaatttaacattagatacagaatatataaattcaagacagagagaattactttataataattcaacaatatcttgtccaaattcttttggaaatgctccaaaattattacatggaacaaattctcaacaagcttcaagccttcgtcaaggttttgtacaagcaggtcataaccttactcaaggtatacttagtttaggtaatgtaataacaaaaccaatagaaggagctcaaaagagtggatttacaggattttgtacaggattaataaaaggagtaacatcttcagttgtaagaccaattgatcatatagggcaagctttaaataacgtaatagatggaatacaagcagaagtaaataaaccacttggtggatataaagaaagaatttatagaagaagaattcctagaatgctttactctcaatatagtaagataagtgattatgagattcaagatgcattacttcgagatattattggaccaaaatttgcaagacatcttaatcaatactttattattccaacagatcattattctatgccactaatattattattatttccaaagaatatagttttaattaaattaatgtcaagtttttcaataagcgatttaaataataattgtcaaataagtttgagaaataatatcattggtggaaatagtgttgttggtgttagtgggggtagcaatggtagtagtattggtggcaataatgggatgaattctaattttggtatcagttcttcaaatagtataggagttaatggtaaggtatcttcaggtggtggtttttcatcaggtttcacttccacttcaagtttctcatcttctggaagaaataatttttacaaatctcaaataatttggttagttaatataaacaatattagagaagtcaaagcaagttctcatgggattcttattgagctttccaacgaaaaaagagatacactacagattccaatatgtaaatttcccctaattaagaaaattatcgttgctttggataattctcaaaataatgcgtctcctcatttaatttttaagaaatga

SEQ ID NO: 3997 - DNA, 321 bp, Cryptosporidium hominis
atgataggaagagccgacatcgaaggatcaaaaagcaacgtcgctatgaacgcttggctgccacaagccagttatccctgtggtaacttttctgacacctctagctgtaattttcacagatctaaaggatcgataggccatgctttcacagtttgtattcgtactgaaaatcaaaatcaagtaagcttttccccttttggtctacatgagatttctgttctcattgagcttaccttaggacacctgcgttaccttttaacagatgtgccgccccagccaaactccccatctgactatgtcttccgcgaagatcagcaataa

SEQ ID NO: 3998 - DNA, 942 bp, Cryptosporidium hominis
atgataatgaaatcatcattcacctttttacttattattttattagtcctctcttgcgcatatgcaaatcagttctcaaattttggttcgcttgaaaaaagaatccaaagacttgaaaaagaacatttgatgcacgacttgaaacgcgaaaatctcagaaatacttatcctattgtaggaaaacttttgcttatggcaattgaacaagaaaaaaataccatagaatatccattattaggaacattccaatccgaaggaaaatgtgtcaaaacaaaattattcttctatgatctctcctcaaaaaagtttgttgttgcaaagtacaaatgttcaaatcaaactgtaaatattgaaggtaaaaatggagaatatttgttgagaactaaagattcaaaagagattaagaagcttagagacgaaaaagttaaatttattgtaaaaaaattctcatttaattatagaattcgaagtttaaataaaatatcaaattgtccaagtatacttaaaagttttgattcaagaataataccagaaaattttgatgttgagactgaccaaaaatacgaaaaaggacatgatcttgttcatagaggattttacctagtcaaatgcagaaagaatgtaaaagaagactctgaaaaagatttgacatatgcattgtttaaatctgcaacattaagttatgctgttccgattcaaagtggatgcagatgtatattagaaggaactaagcttcttgtatgtacatgcgatgatttcaattatcactttgatgttgaacaaggtatattgacagttggtgagactaaattacttacagctaatattcgtggtttaaaggtgctaacttctaaaacaaatacagaactgctagctcttattgacataactcaggaatgtgaaaatgagcaaaatggaaatgaaattgaaactaaattataa

SEQ ID NO: 3999 - DNA, 15 bp, Artificial
  synthetic oligonucleotide primer; n = variable nucleotide
  misc_feature (15)..(15): n is a, c, g, or t
gacgacgacaagatn

SEQ ID NO: 4000 - DNA, 15 bp, Artificial
  synthetic oligonucleotide primer
gaggagaagcccggt

SEQ ID NO: 4001 - DNA, 3374 bp, Cryptosporidium hominis
aagtaatttcaggtacttttaactctcttttcaaagttcttttcatctttccctcacggtacttgtttgctatcggtttctcatcaatatttagctttggatgaaaattaccacccattttatactccattcccaaggaatatgactctttgatagtaaaccgtatgtgaattaaaaataaaatatagacgggactttcaccctctatggtggtttattccaaaacacttaattttattaattcactggcattacttctagatactacaagtcaataataaaatataattattattgattttcatgttgagctttttcctgttcactcgcagttactaaggaaatcctagttagtttcttttcctccacttaataatatgcttaagttcagtgggtaatcttacttaatatcaggtcttttattaatattattatatattattaaaaaaatataaagaaataaacgtcttttttttttttttttttcttttcttaaaaaaaaaaaaagatgatatagaatattattacattaatattaatataattataaatttaaaacccattgatagacggatttccgtatcaaattaagggtaaatataatattattaaatattaaaaatattctatacttgcgtatatttttttttatattttaataattatatatacatttatcccaaaaaaactttataatatatatatattaaatattataaaatttaattttaacttaaattggttaagaaattatacaaaagaaacatatattataaatattattatatatacgtaatataataataattatattttcttttattttcttaccaatcatttacataatataatagaatacaaagaacatgaagaaaatcaaaaatattaaatttaatcaatatttttttttttttgatcctcctctcttcaaaaaacattatattatatgaagtagttaatagacactgatataaatatagtaatgtaaattactgctatttgcgttgagagatctgattgttcatagaattatgcagttcacattgcttatcgcactttgctgcgtccttcatcgttatgagaaccaagacatccattacttaaagtgttaggttatttaattttatttttattttccataaacttttttttttttttaaacttttacttttttattttttctcttttaattcaaaaagtagaaaaaaaaagaaaaaagcaaaagaaaaaaaaaaaaaaaaaaaagtgagaaaagaaaaatgacaaattattttatatgttttttaaaaaaattattttattatattacaaatttattattatatctatatatacatatatatatttttctttatatatacacataaaaataatattttataatataataaaaataaaaataaaaagaaaacaaaatgttatttctatttttattattttattatattttcttttcttttaaatatattaaaaagaataaaataaaataaaataaaataaatcttatattataaataacaaaattaaattttctttttgttcatgttcatttaatttttaaatgacatatatatataatataatataatataatataatatatcaaaaactcatttctcaaataagaatgatccttccgcaggttcacctacggaaaccttgttacgacttctccttcctctaaatgataaggtttacgaaactttccttacatgtattgctacaaagtatggtccgaataattcaccggatcattcaatcggtaggagcgacgggcggtgtgtacaaagggcagggacgtaatcagcgcaagctgatgacttgcgcttactaggaattcctcgttcaagatcaataattgcaatgatctatccccatcacgatgcatattcaaaagattacccatttccttcgaaacaggaatatatacttgatggatgcatcagtgtagcgcgcgcgcggcccaggacatctaagggcatcacagacctgttattgcctaaaacttccctgtattaaacatacaaagtccctctaagaagacagataaaaaatataatatttcttatgtctatttagcaggttaaggtctcgttcgttaacggaattaaccagacaaatcactccaccaactaagaacggccatgcaccaccacccatagaatcaagaaagagctatcaatctgtcaatccttcctatgtctggacctggtgagttttcccgtgttgagtcaaattaagccgcaggctccactcctggtggtgcccttccgtcaattcctttaagtttcagccttgcgaccatactccccccagaacccaaagactttgatttctcataaggtgctgaaggagtaaggaacaacctccaatctctagttggcatagtttatggttaagactacgacggtatctgatcgtcttcgatcccctaactttcgttcttgattaatgaaaacatccttggcaaatgctttcgcattagtctgtctttaacaaatctaagaatttcacctctgactgttaaatacaaatgcccccaactgtccctattaatcattattcttatcttagaaccaataagaaagataaaaatctttaatattattccatgctggagtattcaaggcatatgcctgctttaagcactctaattttctcaaagtaaaatttcatatactaaaaaaaatagtaatatgaattatgttaatattatataaatattcatcaaaatattttatataaattattaacagaaatccaactacgagctttttaactgcaacaactttaatatacgctattggagctggaattaccgcggctgctggcaccagacttgccctccaattgatacttgtaaaggggtttatacttaactcattccaattacaaaaccaaaaagtcctgtattgttatttcttgtcactacctccctgtattaggattgggtaatttgcgcgcctgctgccttccttagatgtggtagccgtttctcaggctccctctccggaatcgaaccctaattccccgttacccgtcattgccacggtaggccaataccctaccgtctaaagctgataggtcagaaacttgaatgatatgtcacattaattgtgatccgtaaagttattatgagtcaccaatcatattggttctttatctaataaatacaacccttccataaagtcgagttttttcgcatgtattagctctagaattaccacggttatccatgtaagtaaagattatcaagtaaactataactgttataatgagccattcgcagtttaaccgtataaaagtttatacttagacatgcatggcttaatctttgagacaagcatatgactactggcaggatcaaccaggtt

SEQ ID NO: 4002 - DNA, 3817 bp, Cryptosporidium hominis
aagtaatttcaggtacttttaactctcttttcaaagttcttttcatctttccctcacggtacttgtttgctatcggtttctcatcaatatttagctttggatgaaaattaccacccattttatactccattcccaaggaatatgactctttgatagtaaaccgtatgtgaattaaaaataaaatatagacgggactttcaccctctatggtggtttattccaaaacacttaattttattaattcactggcattacttctagatactacaagtcaataataaaatataattattattgattttcatgttgagctctttcctgttcactcgcagttactaaggaaatcctagttagtttcttttcctccacttaataatatgcttaagttcagtgggtaatcttacttaatatcaggtcttttattaatattacaatattaaaaatacaagaaataaacgtctgtaaagaaaaaaaaaaataattttaatatatttttctatctttctttagagatgatatagaatacatatatatatatatatatcattaatattaacaattacattataaatctacacccattgatagacggatttccgtatcaaattaagggtaaatataattattaaatattaaatattccatacttgcgtatatttcttatttgtattttaacaattatattccaaaactttataatacatatataaaaaaatactataaaatttagttttaacttaaattggtcaagaaaccacacaaaaaaaacgttgtacatatatattgacactcaaatatatacatataacaatatttctgtattctcttaccaatcatttacataatataatagaatacaaagaacatgagaaaatcaaaaatattaaatttaatcaatatttttttaatcttcccctcttcaaaaaacattatattatatgaagtagtcaatagacactgatataaatatagtaatataaaattactgccatttgcgttgagagatctgattgttcatagaattatgcagttcacattgcttatcgcactttgctgcgtccttcatcgttatgagaaccaagacatccattacttaaagtgttaggtgttaaaaattttactttcttttctcttgctttctcttaacgagaggataaaaaagggttttttttatcgaaaataaaatctagtcacctaaccacccctcccccttaactttgagtaagtgggttgttttgcccctggttctcaaataactattgggagatgcagcaaagtgcgttgagcaatgttaaactgcataagttctatgaacaactagatttctcattgcaaatagcagtaactcgtattactatgtttatatcactgtctgctaactgcttcatgcaataacaatgctttttaaagaaggaaaaaccaaagaaatcaaaataaaattgacattcccgattttcctcccttaaaaaacattgttattgcatgaagcagttagcagacagtgatataaacatagtaatacgagttactgctatttgcaatgagaaatctagttgttcatagaacttatgcagtttaacattgctcaacgcactttgctgcatctcccaatagttatttgagaaccaggggcaaaacaacccacttactcaaagttaagggggaggggtggttaggtgactagattttattttcgataaaaaaaacccttttttaccctctcgttaagagaaaaagaagcaaaaaagagaagggaaaaatgacagattacttacatgttcttaaaaaaatctactgcactacatatataaattgtttttattgaaattctcattgcatgtaccgcaatatatattgcacgttttttcccacacaaaaactccaataaacgcatttatataaaaaattgtaatgcaacaaaaacgagagaacaaacgccacttgttaattctttcaatatataaaagaaaaataaatagcagttaaattcttgttcatgttcatttattcttgctgacatatatatatgtatatatatatatatcaaactcacttttcaaataagaatgatccttccgcaggttcacctacggaaaccttgttacgacttctccttcctctaaatgataaggtttacgaaactttccttacatgtattgctacaaagtatggtccgaataattcaccggatcattcaatcggtaggagcgacgggcggtgtgtacaaagggcagggacgtaatcagcgcaagctgatgacttgcgcttactaggaattcctcgttcaagatcaataattgcaatgatctatccccatcacgatgcatattcaaaagattacccatttccttcgaaacaggaatatatacttgatggatgcatcagtgtagcgcgcgcgcggcccaggacatctaagggcatcacagacctgttattgcctaaaacttccctgtattaaacatacaaagtccctctaagaagacagataaaaaatataatatttcttatgtctatttagcaggttaaggtctcgttcgttaacggaattaaccagacaaatcactccaccaactaagaacggccatgcaccaccacccatagaatcaagaaagagctatcaatctgtcaatccttcctatgtctggacctggtgagttttcccgtgttgagtcaaattaagccgcaggctccactcctggtggtgcccttccgtcaattcctttaagtttcagccttgcgaccatactccccccagaacccaaagactttgatttctcataaggtgctgaaggagtaaggaacaacctccaatctctagttggcatagtttatggttaagactacgacggtatctgatcgtcttcgatcccctaactttcgttcttgattaatgaaaacatccttggcaaatgctttcgcattagtttgtctttaacaaatctaagaatttcacctctgactgttaaatacaaatgcccccaactgtccctattaatcattattcttatcttagaaccaataaaaaagataaaaatctttaatattattccatgctggagtattcaaggcatatgcctgctttaagcactctaattttctcaaagtaaaatttcatatactaaaaaaaaaaatagtaatatgaattatgttaatattatataaatattcatcaaaatattttatataaattattaacagaaatccaactacgagctttttaactgcaacaactttaatatacgctattggagctggaattaccgcggctgctggcaccagacttgccctccaattgatacttgtaaaggggtttatacttaactcattccaattacaaaaccaaaaagtcctgtattgttatttcttgtcactacctccctgtattaggattgggtaatttgcgcgcctgctgccttccttagatgtggtagccgtttctcaggctccctctccggaatcgaaccctaattccccgttacccgtcattgccacggtaggccaataccctaccgtctaaagctgataggtcagaaacttgaatgatatgtcacattaattgtgatccgtaaagttattatgagtcaccaattatattggttctttatctaataaatacaacccttccataaagtcgagttttttcgcatgtattagctctagaattaccacggttatccatgtaagtaaaagattatcaagtaaactataactgttataatgagccattcgcagtttaaccgtataaaagtttatacttagacatgcatggcttaatctttgagacaagcatatgactactggcaggatcaaccaggtt

SEQ ID NO: 4003 - DNA, 703 bp, Cryptosporidium hominis
gcaatcggccatactacatcgaatataccggatcccatcagaactccgaagtcaagcggtgtaaggttcggttagtactagggtgggggaccacctgggaagaccagaatgtcgatcgcctctttttaatttttttggttttcccccccccccccccccctctttcagggttagagattaatataataatgattatcctttaattgttatgttaattattataaatcaaaataactttttttatttgtattttagttctgtttagaataaaattttaattaaattaatggcggcaataatttttaattcattttttttccatgtaatataaacttcacatgcactaaatttaattatattgcttgcatgcagacattatagaaaagtaagaataattttgcttgagggccactatttattctctataatattaaagatagaacaataatcgagtgatttcaatttaatacttttttatctagaaaaattactattatcaattaagaattgtatcttatctttgttaaataaaaagaattgttattcaatattactattattcaaaagaaaaaaaatttaaaaaggcgatcgacattctggtcttcccaggtggtcccccaccctagtactaaccgaaccttacaccgcttgacttcggagttctgatgggatccggtatattcgatgtagtatggccgattgc

SEQ ID NO: 4004 - DNA, 120 bp, Cryptosporidium hominis
ggcgatcgacattctggtcttcccaggtggtcccccaccctagtactaaccgaaccttacaccgcttgacttcggagttctgatgggatccggtatattcgatgtagtatggccgattgc

SEQ ID NO: 4005 - DNA, 120 bp, Cryptosporidium hominis
ggcgatcgacattctggtcttcccaggtggtcccccaccctagtactaaccgaaccttacatcgcttgacttcggagttctgatgggatccggtatattcgatgtagtatggccgattgc

SEQ ID NO: 4006 - DNA, 120 bp, Cryptosporidium hominis; identical to SEQ ID NO: 4004

SEQ ID NO: 4007 - DNA, 1749 bp, Cryptosporidium hominis
gaatgatccttccgcaggttcacctacggaaaccttgttacgacttctccttcctctaaatgataaggtttacgaaactttccttacatgtattgctacaaagtatggtccgaataattcaccggatcattcaatcggtaggagcgacgggcggtgtgtacaaagggcagggacgtaatcagcgcaagctgatgacttgcgcttactaggaattcctcgttcaagatcaataattgcaatgatctatccccatcacgatgcatattcaaaagattacccatttccttcgaaacaggaatatatacttgatggatgcatcagtgtagcgcgcgcgcggcccaggacatctaagggcatcacagacctgttattgcctaaaacttccctgtattaaacatacaaagtccctctaagaagacagataaaaaatataatatttcttatgtctatttagcaggttaaggtctcgttcgttaacggaattaaccagacaaatcactccaccaactaagaacggccatgcaccaccacccatagaatcaagaaagagctatcaatctgtcaatccttcctatgtctggacctggtgagttttcccgtgttgagtcaaattaagccgcaggctccactcctggtggtgcccttccgtcaattcctttaagtttcagccttgcgaccatactccccccagaacccaaagactttgatttctcataaggtgctgaaggagtaaggaacaacctccaatctctagttggcatagtttatggttaagactacgacggtatctgatcgtcttcgatcccctaactttcgttcttgattaatgaaaacatccttggcaaatgctttcgcattagtctgtctttaacaaatctaagaatttcacctctgactgttaaatacaaatgcccccaactgtccctattaatcattattcttatcttagaaccaataagaaagataaaaatctttaatattattccatgctggagtattcaaggcatatgcctgctttaagcactctaattttctcaaagtaaaatttcatatactaaaaaaaatagtaatatgaattatgttaatattatataaatattcatcaaaatattttatataaattattaacagaaatccaactacgagctttttaactgcaacaactttaatatacgctattggagctggaattaccgcggctgctggcaccagacttgccctccaattgatacttgtaaaggggtttatacttaactcattccaattacaaaaccaaaaagtcctgtattgttatttcttgtcactacctccctgtattaggattgggtaatttgcgcgcctgctgccttccttagatgtggtagccgtttctcaggctccctctccggaatcgaaccctaattccccgttacccgtcattgccacggtaggccaataccctaccgtctaaagctgataggtcagaaacttgaatgatatgtcacattaattgtgatccgtaaagttattatgagtcaccaatcatattggttctttatctaataaatacaacccttccataaagtcgagttttttcgcatgtattagctctagaattaccacggttatccatgtaagtaaagattatcaagtaaactataactgttataatgagccattcgcagtttaaccgtataaaagtttatacttagacatgcatggcttaatctttgagacaagcatatgactactggcaggatcaaccaggtt

SEQ ID NO: 4008 - DNA, 3401 bp, Cryptosporidium hominis
aacctggttgatcctgccagtagtcataatgcttgtctcaaagattaagccatgcatgtctaagtataaacttttatacggttaaactgcgaatggctcattataacagttatagtttacttgataatcttttacttacatggataaccgtggtaattctagagctaatacatgcgaaaaaactcgactttatggaagggttgtatttattagataaagaaccaatataattggtgactcataataactttacggatcacaattaatgtgacatatcattcaagtttctgacctatcagctttagacggtagggtattggcctaccgtggcaatgacgggtaacggggaattagggttcgattccggagagggagcctgagaaacggctaccacatctaaggaaggcagcaggcgcgcaaattacccaatcctaatacagggaggtagtgacaagaaataacaatacaggactttttggttttgtaattggaatgagttaagtataaacccctttacaagtatcaattggagggcaagtctggtgccagcagccgcggtaattccagctccaatagcgtatattaaagttgttgcagttaaaaagctcgtagttggatttctgttaataatttatataaaatattttgatgaatatttatataatattaacataattcatattactatttttttttttagtatatgaaattttactttgagaaaattagagtgcttaaagcaggcatatgccttgaatactccagcatggaataatattaaagatttttatcttttttattggttctaagataagaataatgattaatagggacagttgggggcatttgtatttaacagtcagaggtgaaattcttagatttgttaaagacaaactaatgcgaaagcatttgccaaggatgttttcattaatcaagaacgaaagttaggggatcgaagacgatcagataccgtccgtagtcttaaccataaactatgccaactagagattggaggttgttccttactccttcagcaccttatgagaaatcaaagtctttgggttctggggggagtatggtcgcaaggctgaaacttaaaggaattgacggaagggcaccaccaggagtggagcctgcggcttaatttgactcaacacgggaaaactcaccaggtccagacataggaaggattgacagattgatagctctttcttgattctatgggtggtggtgcatggccgttcttagttggtggagtgatttgtctggttaattccgttaacgaacgagaccttaacctgctaaatagacataagaaatattatattttttatctgtcttcttagagggactttgtatgtttaatacagggaagttttaggcaataacaggtctgtgatgcccttagatgtcctgggccgcgcgcgcgctacactgatgcatccatcaagtatatattcctgtttcgaaggaaatgggtaatcttttgaatatgcatcgtgatggggatagatcattgcaattattgatcttgaacgaggaattcctagtaagcgcaagtcatcagcttgcgctgattacgtccctgccctttgtacacaccgcccgtcgctcctaccgattgaatgatccggtgaattattcggaccatactttgtagcaatacatgtaaggaaagtttcgtaaaccttatcatttagaggaaggagaagtcgtaacaaggtttccgtaggtgaacctgcggaaggatcattcttatttgagaaatgagtttttgatatattatattatattatattatattatattatattatattatattatatatatatgtcatttaaaaattaaatgaacatgaacaaaaagaaaatttaattttgttatttataatataagatttattttattttattttattttattctttttaatatatttaaaagaaaagaaaatataataaaataataaaaatagaaataacattttgttttctttttatttttatttttattatattataaaatattatttttatgtgtatatataaagaaaaatatatatatgtatatatagatataataataaatttgtaatataataaaataatttttttaaaaaacatataaaataatttgtcatttttcttttctcacttttttttttttttttttttcttttgcttttttctttttttttctactttttgaattaaaagagaaaaaataaaaaagtaaaagtttaaaaaaaaaaaaagtttatggaaaataaaaataaaattaaataacctaacactttaagtaatggatgtcttggttctcataacgatgaaggacgcagcaaagtgcgataagcaatgtgaactgcataattctatgaacaatcagatctctcaacgcaaatagcagtaatttacattactatatttatatcagtgtctattaactacttcatataatataatgttttttgaagagaggaggatcaaaaaaaaaaaaaatattgattaaatttaatatttttgattttcttcatgttctttgtattctattatattatgtaaatgattggtaagaaaataaaagaaaatataattattattatattacgtatatataataatatttataatatatgtttcttttgtataatttcttaaccaatttaagttaaaattaaattttataatatttaatatatatatattataaagtttttttgggataaatgtatatataattattaaaatataaaaaaaaatatacgcaagtatagaatatttttaatatttaataatattatatttacccttaatttgatacggaaatccgtctatcaatgggttttaaatttataattatattaatattaatgtaataatattctatatcatcttttttttttttttaagaaaagaaaaaaaaaaaaaaaaaagacgtttatttctttatatttttttaataatatataataatattaataaaagacctgatattaagtaagattacccactgaacttaagcatattattaagtggaggaaaagaaactaactaggatttccttagtaactgcgagtgaacaggaaaaagctcaacatgaaaatcaataataattatattttattattgacttgtagtatctagaagtaatgccagtgaattaataaaattaagtgttttggaataaaccaccatagagggtgaaagtcccgtctatattttatttttaattcacatacggtttactatcaaagagtcatattccttgggaatggagtataaaatgggtggtaattttcatccaaagctaaatattgatgagaaaccgatagcaaacaagtaccgtgagggaaagatgaaaagaactttgaaaagagagttaaaagtacctgaaattactt

SEQ ID NO: 4009 - DNA, 6378 bp, Cryptosporidium hominis
aagaaacagcatatatggtgtcgttattaacgataattaaaacaacattactttatgacgaaaagcatgaattaattaattatttgaatactgaattttgggtttggcttttagatgtattcataaggagaagagaaaatagccacatttcagttcagtgtaaaactatttttgaattaggaatcagatttgggtcatattcaacattggagaatttgttcaataaagtcaaactggttgataaggtgtcgaaatttatttatgatgggactgatctagatggcaatttaatagaagagagagagtttgtaaataagaaaacgggcaaaagaataagaagagtttttggttcaatttacaatttgtttattgttttggaacaaatttacaacaattttttgaaaattattgtaccatataatccttatatttatgaagtgattaaaaatgttatattttctcaattgaataattatagtaaaatagatgatgaagctatggaaatgttaggcttgttaataaaaaatgaatttgaaataaattatttgtcgcaagacagtgaaaaaatcgaatttgaaagcccaatagatatggatccacagaaaatatccttattagcaaatttatcttgcaataccaaatttcacgagcttgcaaaaagctatcaaagtcaaaacaaaacaaactatattcaaaattcattttcaaaagctgaagatttaagtagtaaattgacaaagaatatagaaaattccacgttgacccctaattctattaaaaaaaaaactaattcggaagatccttcgatttcaaacgagatcaatacttcaaacaatcaatctccatcaaaaattctcagaagctacttttctggaagtattgttgatttatttaattgtgacgaaaactgtgaatgcccaaaatggtcattttgcaatgttctcaacaagttgaagattgaaaaaaattgttcgactggaattccgaattttcctgttcttccgctcgaggaaagcaaaaaaattcgggagactcgaaagaggcagataaaattatgctcttcagcccaaaaaaacgattgatatatataggccattagtattctgtaagaatatctaggttataaattcataaaggtaatatttacattgcatagttaggttgataaggtagttaatctggcaatttattattgcatgcttttatatgcttaatgagctgaagaaaacaagtcttaacgcaaactagtaagaaaaaaatgatttgttttgatctagaataaaaattatgcatttttgtataatattattacgtataaccatgggcgctggagcgtgtgaatccctattgtgagccgttgacaaatttattatattctagaataaggcattcgtgaaaaagcaaaataattccaaactaaattgatcaaatttcaaagtttaaataatttggaataatccaaagtttctcataaattacttgcgtgagaataactattatttcatgaatccgtacagagaataagctcaaattgggtttatttttaaaggttatctcaaatttggttaattctattattatgaattacttcccaaaaatacttgatgttctttttgtgtgaataggtgatattattatcggcttggattactaaactaaatgttattgccatatttttaactcaattgaattcctttggtaaaaattacattaagaaataattgaaaaataaaaaaacatgtgtgatagagttgacaggcatgtattgaggaaatatgaactggtaaaaaagttggggaagggtgcatacggcatagtttggaaatctattgatcgtaggactggagaagtagttgcagtcaagaaaatcttcgatgcatttcaaaattcaacagatgctcaaagaacatttagagagattatgatattgacagaactatctggtcatgagaatattgtaaatttactaaatgtcttaagagcagacaatgatagagatgtctacttggtttttgattatatggagacggacctacatgcagtcattagagcaaatattttggagcctgttcataaacaatatgtagtttatcaacttattaaggtaattaaatatttacatagtggtgggttattacatcgtgatatgaaaccatcaaatatacttctaaatgctgaatgccatgtaaaagtagcagactttggattatctagaagctttgtcaacataagacgtgttacaaataatattccattaagtattaacgaaaatactgaaaatttcgatgatgatcagcctattctcacagactatgttgcaactagatggtatagggctccagaaatacttttaggatcaactaagtatacaaaagggattgacatgtggtctttgggctgtattttgggagagatattgtgtggaaaaccaatttttccaggttcgtcaactatgaatcaacttgaaagaattataggtgtgatagatttcccttctaacgaagatgtcgagtcgatccaatcaccctttgccaaaacaatgatagagtcgctcaaagaaaaagttgagataagacaatcaaataaaagagatatattttctaaatggaagaatttactactaaaaataaacccaaaagctgactgtaacgaggaagcattggacttattagataaattgctacaatttaatccaaataagaggatttctgcaaatgatgcattaaaacacccatttgtttcaatttttcacaacccaaatgaagaaccaaattgtgatcatataattactataccaataaacgacaatgttaagcattcgattgatgactatagaaacttggtatattcagaaatatcaagacgcaagcgagaattgatcagtaacaaacaccaaaatgttcaaaatccaaatactgcagtgagtaatcctagagttaatagagtatcgggtgctgttgaatttgctactccagaaagcaatcccaacaacattacttcaaataagtccaacgaaccaatttatagtaaattccagagtgaactacaatcaaacaaaagatcctccattaataaaaacccaccagcagataactcaaaaaaaggaggcatactaggaaactttttctcacaagtatataatacctttatttctggctcagcaactaataaaacgacttcttttggtaatagccaaaccatttccaattattccaatggtaaggttgatgagaaacacatacaacaaatgagatctgcaacttcgtactactctaactcaattaacaatagcaacccaataaagaaagggggaggattcataggaaataatttaagctctacaaatgataatacggcgaaaacagccaatagtagcactaaaaactccaagtacataacaacgggggcagtaataaaaaatgccaactccacattttcagtaagtacaaattgtggtggaaattcgcacgtttactatccaagagcatatatgtacaataatataaagcataatcttccagattactctctaattccgaactcagagttgagcaattcactttcgggtaaaaatacctcgaatctaaaatactccaataatccagaactttcaaaccaattcaaattgaattgccatggttccaatcaaactagcataattaatctacaaatgcaacaaaatcggagcaatacgagcaaaataacatattataatgagcctaatattgaaccaaattctaagttaaacgatatggtcggtagaaaaagtacttcgtctggagttggagtgaatacgttgcaccatcctcctccattttatacatctcagcaaaacaaaaacgttaacaagaattatttatataaatattagtttatattaatatagatattagaaatgcctataaacttgaaactataatctaagtgaaatcgatgtcttgtcaccattagaagtgttttctagccttccagaactttgactaagaaattggccctctgaaacttttcttttttttttattatctagaagaattgagtcttcgctataattttgaagtactgtttctttgctttgttcagaataattagcatttccattatttatatctatgtagttagagttgctgaacaaggaattgagctcatcatcgttaactataaaatgatcatctatcatctcattttcatcatcatcatcagatatgtcaattacctcattttgaacatcaaaacaatctttaatattgtttggcaaggataaatctgaattttgagaagatttttcttttattatagttagatgctcgttaattggcgaatttaacgagttggcctttggaaactcgtatttaattgaattcgaggtttttaaaaacatttctccgggcatatcttcattttgtttaattcgatcaaaaatttcagagtttatcagaattttattgttttctctgggtatagtggggcttctaataatcatcttgacaaagctgtctaatttgagcatacttggtctaattatttggtaacataaggggcatttccatctggtgttaaatgccttaattgtagagttaatttgaataaaagctttaatatcaaaacagtttatatgatggcaaaatatgccacgtccaggaagttcaatggtatccatagttagagggcataaggtatttaaatactggtctttattcaagcagattatctcatctgatgagtcatcatataattgattatatatagatgattggatcttattttctaaaatatttttgaagtgagcttttgaaatttcaatggataatgtgccttcagaaagtatagtatccaaaatattatcgcaacttattgttttggttaaaaacaaaccaattatatacggtgccgtaggaataggcaacaactcactattttctgagtctttaagtagtgcatttaatgtgctaaacgtaatgttgacattttgctttgtcatcaattgattattaactaaataatccttcaaatataatggacaatctcttctaatatgatcgtagctcggagattcaatgttttgaataacctttccgttagctttaataaataggactcttggaaattcgtgattaagatccattctatcaagtcttagacaataaaccataatattgaaagcatccgggtcattagattctaaaccattattcaaaaatagatttggagagaaagaatacttagatgtgaagtgaggaaggtggcttgagttattaaagttaatatttccatactttggatgtatattgtgaattgctgtgtaagaataaaaagtagtaaaaaaaagtggcttaattattttgttatatgggtcgattacaaagaatctacaaaacgggcaaataaaattaattaaattagccttgaattttttgccatctttttttgatatactttccatgaaaaccatcatgtgattattattgaattcagctcttttgatatcaaaacctacacagcgagagtgaaatggtctgtaacaagcatcgcagttaactataatatcggaaagatttttttggcacatggaacaagatgaatcgcaaatagcatccgaagcagtatgaaaatattcatttattttaatgatatttaaattagttgactcactaatattggacaaaattgatgtttcagaaggaaaattgtgttgatcatttgatattttttctttaagtataaaatcaagattattagaacttagaggagtgtcaggggaattattcagaatgatgtcgatacagtcacttttttttgtattggatttaatgtaaataccaagttgttttgctaaggattttaagtcctgaagtctttgcttcttcaaatattcactccagccatttctgtccatatctttacatatttcagaaacaaaatagtaattatctaatcagtttatttcaaagtgcatcgattttaatggcacaaatagtattaattacacgtcgtactttaattggcgctatctttaacaaatgattaatccgactaaaatttaaataaaagaaaatgaaatttataacaaaactactagaatataatattttgattaaataatttgagtagttaaaattgctttaacacgaacattttttatagttaaaacgaccgttttcttccccggattgtaaatcaacgattttattggcattattgttttccaagctactagaactgtttgcttcattctttccttcttgaatgtagtctaaattaggaagtgttgaagcgagctttttaaacagagacttgatgttgtatccattttttgcactagtttcaatgaacataatgttattttcttgtgcaagtttctccgcctcttcatattttact

SEQ ID NO: 4010 - DNA, 1109 bp, Cryptosporidium hominis
aagtaatttcaggtacttttaactctcttttcaaagttcttttcatctttccctcacggtacttgtttgctatcggtttctcatcaatatttagctttggatgaaaattaccacccattttatactccattcccaaggaatatgactctttgatagtaaaccgtatgtgaattaaaaataaaatatagacgggactttcaccctctatggtggtttattccaaaacacttaattttattaattcactggcattacttctagatactacaagtcaataataaaatataattattattgattttcatgttgagctttttcctgttcactcgcagttactaaggaaatcctagttagtttcttttcctccacttaataatatgcttaagttcagtgggtaatcttacttaatatcaggtcttttattaatattattatatattattaaaaaaatataaagaaataaacgtcttttttttttttttttttcttttcttaaaaaaaaaaaaagatgatatagaatattattacattaatattaatataattataaatttaaaacccattgatagacggatttccgtatcaaattaagggtaaatataatattattaaatattaaaaatattctatacttgcgtatatttttttttatattttaataattatatatacatttatcccaaaaaaactttataatatatatatattaaatattataaaatttaattttaacttaaattggttaagaaattatacaaaagaaacatatattataaatattattatatatacgtaatataataataattatattttcttttattttcttaccaatcatttacataatataatagaatacaaagaacatgaagaaaatcaaaaatattaaatttaatcaatatttttttttttttgatcctcctctcttcaaaaaacattatattatatgaagtagttaatagacactgatataaatatagtaatgtaaattactgctatttgcgttgagagatctgattgttcatagaattatgcagttcacattgcttatcgcactttgctgcgtccttcatcgttatgagaaccaagacatccattacttaaagtgt

SEQ ID NO: 4011 - DNA, 453 bp, Cryptosporidium hominis
aacctggttgatcctgccagtagtcatatgcttgtctcaaagattaagccatgcatgtctaagtataaacttttatacggttaaactgcgaatggctcattataacagttatagtttacttgataatcttttacttacatggataaccgtggtaattctagagctaatacatgcgaaaaaactcgactttatggaagggttgtatttattagataaagaaccaatataattggtgactcataataactttacggatcacaattaatgtgacatatcattcaagtttctgacctatcagctttagacggtagggtattggcctaccgtggcaatgacgggtaacggggaattagggttcgattccggagagggagcctgagaaacggctaccacatctaaggaaggcagcaggcgcgcaaattacccaatcctaatacagggaggtagtgacaa

SEQ ID NO: 4012 - DNA, 403 bp, Cryptosporidium hominis
aacctggttgatcctgccagtagtcatatgcttgtctcaaagattaagccatgcatgtctaagtataaacttttatacggttaaactgcgaatggctcattataacagttatagtttacttgataatcttttacttacatggataaccgtggtaattctagagctaatacatgcgaaaaaactcgactttatggaagggttgtatttattagataaagaaccaatataattggtgactcataataactttacggatcacaattaatgtgacatatcattcaagtttctgacctatcagctttagacggtagggtattggcctaccgtggcaatgacgggtaacggggaattagggttcgattccggagagggagcctgagaaacggctaccacatctaaggaa

SEQ ID NO: 4013 - DNA, 76 bp, Cryptosporidium hominis
gccttcgtagcatagtcttggttattgcgtcggtcttgtaaaccgaaggtcacgagttcgaatctcgtcgaaggct

SEQ ID NO: 4014 - DNA, 71 bp, Cryptosporidium hominis
gcactaatggtctagtggtatgatgaaacgttgccatcgtttcgaccggggttcgattccccgttagtgca

SEQ ID NO: 4015 - DNA, 73 bp, Cryptosporidium hominis
aggaggatggtctaggggttatgacgcttgcctcacacgcaagaggtcacgggttcgattcccgttcttccta

SEQ ID NO: 4016 - DNA, 73 bp, Cryptosporidium hominis
gctcaaatcgtataggtggttagtacaccgcgttgtggccgcggcgacccaggttcgaatcctggtttgagca

SEQ ID NO: 4017 - DNA, 81 bp, Cryptosporidium hominis
ggcagggtgcccgagttggtctaaggggtaggttttaggcacctataggtaactgcgcgggttcgaatcccgtccctgtca

SEQ ID NO: 4018 - DNA, 74 bp, Cryptosporidium hominis
gctgtcttagctcagcacggtagagcgccagccttttaagctggtggtcatgggttcgatccccatagacagcg

SEQ ID NO: 4019 - DNA, 85 bp, Cryptosporidium hominis
gcgtagatgcccgagtcggtctaaggggccagacttaagatctggtgtacacatgtactccagggttcgaatccctgtctacgca

SEQ ID NO: 4020 - DNA, 73 bp, Cryptosporidium hominis
gccttgatagctcagttgggagagcgtgagactgaagatctcaaggtccccgtttcgatcacgggtcaaggca

SEQ ID NO: 4021 - DNA, 72 bp, Cryptosporidium hominis
ggatcgatagctcagtggtagagcaggcgactgcagatcgtctggtccctggttcaaatccgggtcggtcct

SEQ ID NO: 4022 - DNA, 74 bp, Cryptosporidium hominis
ggagctgtcgcatagttggctagtgcgcgagattcataccctcgaggtcacgggttcgagtcccgtcagctcct

SEQ ID NO: 4023 - DNA, 72 bp, Cryptosporidium hominis
gcgtgtatggtgtaacggctagcatctcagttttccgaactgatggctcgggttcgactcccgatacacgca

SEQ ID NO: 4024 - DNA, 73 bp, Cryptosporidium hominis
tccgacgtagtctagtcggctaggatacatggctctcacccatgcgacccgggttcgattcccggcgtcggag

SEQ ID NO: 4025 - DNA, 73 bp, Cryptosporidium hominis
gacctggtagctccaacggtagagcgtctgactccagatcagacggttcagggttcgaatccctgtcgggtca

SEQ ID NO: 4026 - DNA, 72 bp, Cryptosporidium hominis
tcccacgtagtctaggggctaggatactcggctttcacccgggcgacccgggttcgattcccggcgtgggag

SEQ ID NO: 4027 - DNA, 73 bp, Cryptosporidium hominis
ggcctcgtcgtctaatggatatgacgttggtcttcggaaccaaaggttgtgggttcgagtcccatcggggtcg

SEQ ID NO: 4028 - DNA, 72 bp, Cryptosporidium hominis
gggtgattagtctaggggtatgattctcgctttgggtgcgagaggtcccgggttcaaatcccggatcacccc

SEQ ID NO: 4029 - DNA, 74 bp, Cryptosporidium hominis
gcttccgtggcttagtcggttatagcattcggctgttaaccgaagggtcgacggttcgattccgtccgggagcg

SEQ ID NO: 4030 - DNA, 74 bp, Cryptosporidium hominis
gcgggcttggtctaggtggttatgacgcttgccttacacgcaagagatcacgagttcgagtctcgtagcccgta

SEQ ID NO: 4031 - DNA, 75 bp, Cryptosporidium hominis
tctcctgtagctcagctcggttagagcgtcggtcttatgagccgaaggtcgcgagttcgatcctcgccgggagaa

SEQ ID NO: 4032 - DNA, 72 bp, Cryptosporidium hominis
gcctccgtagcatagtggtaatgcgttcgcttcgtaagcgaaatatccagggttcaatcccctgcgtgggct

SEQ ID NO: 4033 - DNA, 83 bp, Cryptosporidium hominis
ccgggcgtagctcaggggtagagcgattgactgtagacttggcagacatcaattggtcccgtgttcgattcacggtgcccgga

SEQ ID NO: 4034 - DNA, 85 bp, Cryptosporidium hominis
gcgtggatggccgagttggtctaaggcgttagactcaagatctaatgagcgtatgctctcgtgggttcgaatcccattctacgca

SEQ ID NO: 4035 - DNA, 72 bp, Cryptosporidium hominis
gggtgattagtctaggggtatgattctcgcttagggtgcgagaggtcccgggttcgaatcccggatcacccc

SEQ ID NO: 4036 - DNA, 72 bp, Cryptosporidium hominis
tccgagttagtatagtggttagtatatccgcctgtcacgcggatgacccgggttcaattcccggacttggag

SEQ ID NO: 4037 - DNA, 73 bp, Cryptosporidium hominis
gcccccttagcttagttggtagagcattcgcttagtaagcgaaaggtcccgggttcgattcccgtaggtggct

SEQ ID NO: 4038 - DNA, 74 bp, Cryptosporidium hominis
gccgcgatagctcaattggatagagcgttggacttctaatccagaggctcggggttcgattccccgtcgcggtg

SEQ ID NO: 4039 - DNA, 74 bp, Cryptosporidium hominis
gcgggcttggtgtagttggatatcacgtctgcctacggagcagaaggtcaggagttcgagtctcttagcccgtg

SEQ ID NO: 4040 - DNA, 72 bp, Cryptosporidium hominis
gggttgttagtctagtggtatgattcatgtttcgggtacatgaggtcccgggttcgattcccggataacccc

SEQ ID NO: 4041 - DNA, 71 bp, Cryptosporidium hominis
ggagctatagtctagcggtaggaccccggattttgattccggtagcctgggttcgattcccagtagctcct

SEQ ID NO: 4042 - DNA, 73 bp, Cryptosporidium hominis
gcgggtttggtctagtggctatgacgctcgcctaacacgcgagagatcacgagttcgatcctcgtaacccgta

SEQ ID NO: 4043 - DNA, 74 bp, Cryptosporidium hominis
ggctggatggccgagtggactaaggcgcagcattcaggttgctgttttcaggggttcgaatcccctttcagtca

SEQ ID NO: 4044 - DNA, 74 bp, Cryptosporidium hominis
ggtgggatggccgagcggtctaaggcgctagttcgaggtgctagttttcgcgggttcgaatcccgttcccatca

SEQ ID NO: 4045 - DNA, 83 bp, Cryptosporidium hominis
gacagtgtggccgagtggtctaaggcgtcagacttgaaatctgatgtggtctccacgcgcaggttcaaatcctgccactgtcg

SEQ ID NO: 4046 - DNA, 73 bp, Cryptosporidium hominis
gcactcgtggcgcaatggatagcgcgtagccctcctaaggctgaggttgagggttcgagtccctccgagtgcg

SEQ ID NO: 4047 - DNA, 82 bp, Cryptosporidium hominis
gtcgatctgcccgagtggttaaggggcttgactagaaatcaagtgcggtctccgcgcacaggttcgaatcctgtggtcgacg

SEQ ID NO: 4048 - DNA, 74 bp, Cryptosporidium hominis
agcggaatagctcagaggttcagagcgtcaggctcataacctgaaggtccgacgatcgaaacgtcgttccgctt

SEQ ID NO: 4049 - DNA, 82 bp, Cryptosporidium hominis
ggtgtggtgaccgagtggttaaggtggtggcctgctaagccattgtgctctgcacgcgcgtgttcgaatcacgcccacatcg

SEQ ID NO: 4050 - DNA, 71 bp, Cryptosporidium hominis
gcactagtagtctagtggtaggatgacgcgttcccattgcgtcggcccggtttcgattaccggctagtgca

SEQ ID NO: 4051 - DNA, 74 bp, Cryptosporidium hominis
gcacccatagctcagctggttagagcatacggctaataaccgtaaggtccgcggttcgatcccgcgtgggtgca

SEQ ID NO: 4052 - DNA, 73 bp, Cryptosporidium hominis
ggggaactagctcagatggtagagcgctcgcttagcatgcgagaggtgatcggatcgatgccggtgttctcca

SEQ ID NO: 4053 - DNA, 82 bp, Cryptosporidium hominis
ggcaaagtgctcgagtggttaagaggtcagtctcgaaaactgatagcgttccgctgcgcaggttcgaatcctgcctttgtcg

SEQ ID NO: 4054 - DNA, 72 bp, Cryptosporidium hominis
ggccctgtagtgtaatggttatcacccaggattctgattcctgtgatctgggttcgattcccagcagggcct

SEQ ID NO: 4055 - DNA, 73 bp, Cryptosporidium hominis
gggctcgtggtgcagtggtagctacgtgtgctttgcatgcacaaggtcccgggttcaattcccggcgggtcca

SEQ ID NO: 4056 - DNA, 72 bp, Cryptosporidium hominis
gggctgatagtatagtggtactacgtttcgttcgcatcgaaaagatcacgggttcgattcccgttcagtcca

SEQ ID NO: 4057 - DNA, 74 bp, Cryptosporidium hominis
gccgctatagctcagctaggtagagcgcatggctcttaaccatgtggtcctgggttcgatccccagtggcggcg

SEQ ID NO: 4058 - DNA, 24 bp, Artificial
  Synthetic oligonucleotide primer
cagctttagacggtagggtattgg

SEQ ID NO: 4059 - DNA, 21 bp, Artificial
  Synthetic oligonucleotide primer
tctccggaatcgaaccctaat

SEQ ID NO: 4060 - DNA, 22 bp, Artificial
  Synthetic oligonucleotide primer
cccgttacccgtcattgccacg

SEQ ID NO: 4061 - DNA, 18 bp, Artificial
  Synthetic oligonucleotide primer
ggccaacaagggcagaaa

SEQ ID NO: 4062 - DNA, 26 bp, Artificial
  Synthetic oligonucleotide primer
tctccagatagcataacacaatctga

SEQ ID NO: 4063 - DNA, 24 bp, Artificial
  Synthetic oligonucleotide primer
atgttgcaaacgctgttttagatg
